United States Patent
Gaiger et al.

(10) Patent No.: US 8,071,732 B2
(45) Date of Patent: Dec. 6, 2011

(54) COMPOSITIONS AND METHODS FOR THE DETECTION, DIAGNOSIS AND THERAPY OF HEMATOLOGICAL MALIGNANCIES

(75) Inventors: Alexander Gaiger, Vienna (AT); Paul A. Algate, Issaquah, WA (US); Jane Mannion, Newbury Park, CA (US); Jonathan D. Clapper, University Place, WA (US); Aijun Wang, Issaquah, WA (US); Nadia Ordonez, Seattle, WA (US); Lauren Carter, Seattle, WA (US); Patricia Dianne McNeill, Federal Way, WA (US)

(73) Assignee: Corixa Corporation, Seattle, WA (US)

( * ) Notice: Subject to any disclaimer, the term of this patent is extended or adjusted under 35 U.S.C. 154(b) by 607 days.

(21) Appl. No.: 11/542,681

(22) Filed: Oct. 2, 2006

(65) Prior Publication Data

US 2007/0238182 A1    Oct. 11, 2007

Related U.S. Application Data

(63) Continuation of application No. 10/057,475, filed on Jan. 22, 2002, now abandoned, which is a continuation-in-part of application No. 10/040,862, filed on Nov. 6, 2001, now abandoned, which is a continuation-in-part of application No. 09/796,692, filed on Mar. 1, 2001, now abandoned.

(60) Provisional application No. 60/223,378, filed on Aug. 7, 2000, provisional application No. 60/223,416, filed on Aug. 4, 2000, provisional application No. 60/222,903, filed on Aug. 3, 2000, provisional application No. 60/218,950, filed on Jul. 14, 2000, provisional application No. 60/206,201, filed on May 22, 2000, provisional application No. 60/202,084, filed on May 4, 2000, provisional application No. 60/200,999, filed on May 1, 2000, provisional application No. 60/200,303, filed on Apr. 28, 2000, provisional application No. 60/200,779, filed on Apr. 28, 2000, provisional application No. 60/200,545, filed on Apr. 27, 2000, provisional application No. 60/190,479, filed on Mar. 17, 2000, provisional application No. 60/186,126, filed on Mar. 1, 2000.

(51) Int. Cl.
*C12P 21/08* (2006.01)
(52) U.S. Cl. .................................. 530/388.1
(58) Field of Classification Search .................. None
See application file for complete search history.

(56) References Cited

U.S. PATENT DOCUMENTS

| 4,742,000 A | * | 5/1988 | Greene | 435/7.21 |
| 5,342,761 A | | 8/1994 | MacLeod | 435/69.1 |

FOREIGN PATENT DOCUMENTS

| WO | WO 00/17222 | 3/2000 |
| WO | WO 00/40716 | 7/2000 |
| WO | WO 01/24811 | 4/2001 |
| WO | WO 01/38490 | 5/2001 |
| WO | WO 01/60397 | 8/2001 |

OTHER PUBLICATIONS

Dahl et al (the Journal of Immunology, Jan. 1992, 148(2): 597-603).*
Davis, R.S. et al., "Identification of a family of Fc receptor homologs with preferential B cell expression," *Proc. Natl. Acad. Sci. USA* 98(17): 9772-9777, Aug. 14, 2001.
EMBL Database, Accession No. AAE00506, Jul. 31, 2001. Retrieved from EBI.
EMBL Database, Accession No. AAE09241, Nov. 19, 2001. Retrieved from EBI.
EMBL Database, Accession No. AAY94001, Oct. 20, 2000. Retrieved from EBI.
GenBank Database, Accession No. AF209720.1, Jan. 19, 2000.
GenBank Database, Accession No. AF319438, Feb. 6, 2001.
GenBank Database, Accession No. AF319438, Feb. 6, 2001.
GenBank Database, Accession No. AF319439, Feb. 6, 2001.
GenBank Database, Accession No. AF397452, Aug. 22, 2001.
GenBank Database, Accession No. AF397453, Aug. 22, 2001.
GenBank Database, Accession No. AF459633, Jan. 13, 2002.
GenBank Database, Accession No. AI141708.1, Sep. 28, 1998.
GenBank Database, Accession No. AW384715.1, Feb. 6, 2000.
GenBank Database, Accession No. AW405794.1, Feb. 8, 2000.
GenBank Database, Accession No. AY043464, Sep. 8, 2001.
GenBank Database, Accession No. AY043465, Sep. 8, 2001.
GenBank Database, Accession No. AY043466, Sep. 8, 2001.
GenBank Database, Accession No. K01326.1, Jun. 13, 1985.
GenBank Database, Accession No. L38562.1, Jul. 15, 1991.
GenBank Database, Accession No. R48079.1, May 24, 1995.
GenBank Database, Accession No. X06876.1, Apr. 2, 1988.
GenBank Database, Accession No. X57804.1, Jul. 15, 1991.
GenBank Database, Accession No. X57820.1, Jul. 15, 1991.
Geneseq Database (Derwent), Accession No. AAQ22491, Jul. 31, 1992.

(Continued)

*Primary Examiner* — Sean E Aeder
(74) *Attorney, Agent, or Firm* — SEED IP Law Group PLLC

(57) ABSTRACT

Disclosed are methods and compositions for the detection, diagnosis, prognosis, and therapy of hematological malignancies, and in particular, B cell leukemias, lymphomas and multiple myelomas. Disclosed are compositions, methods and kits for eliciting immune and T cell responses to specific malignancy-related antigenic polypeptides and antigenic polypeptide fragments thereof in an animal. Also disclosed are compositions and methods for use in the identification of cells and biological samples containing one or more hematological malignancy-related compositions, and methods for the detection and diagnosis of such diseases and affected cell types. Also disclosed are diagnostic and therapeutic kits, as well as methods for the diagnosis, therapy and/or prevention of a variety of leukemias and lymphomas.

2 Claims, 62 Drawing Sheets

OTHER PUBLICATIONS

Hatzivassiliou, G. et al., "IRTA1 and IRTA2, Novel Immunoglobuline Superfamily Receptors Expressed in B Cells and Involved in Chromosome 1q21 Abnormalities in B Cell Malignancy," *Immunity* 14: 277-289, Mar. 2001.

Tockman, M.S. et al., "Considerations in Brining a cancer Biomarker to Clinical Applications," *Cancer Research* 52(Suppl.): 2711s-2718s, May 1, 1992.

Xu, M-j. et al., "Molecular Cloning and Characterization of SPAP1, an Inhibitory Receptor," *Biochemical and Biophysical Research Communications* 280: 768-775, 2001.

GenBank Database, Accession No. AB027233, Jun. 21, 2001.

Miller, I.J. et al., IRTs: A new family of Fc-related cell-surface receptors expressed in B cells and implicated in lymphogenesis, *Blood* 96(11): 499a, Abstract No. 2149, Nov. 2000.

\* cited by examiner

Leukemia/Lymphoma Chip #3: Probes Used in Analysis

| Cy3 Probe | | Cy5 Probe | |
|---|---|---|---|
| Tissue | RNA# | RNA# | Tissue |
| Lymphoma, T cell | 952 | SPACT74 | Kidney N |
| Lymphoma, B cell | 955 | SPACT81 | Liver N |
| Lymphoma, B cell | 953 | SPACT78 | Lung N |
| Lymphoma | 916 | SPACT42 | Brain N |
| Lymphoma, Hodgkins | 950 | 138598B | Skin N |
| Lymphoma, Hodgkins | 950 | SPACT49 | Bone Marrow N |
| Lymphoma, B cell | CL151 | 888 | PBMC resting |
| Lymphoma, T cell | 904B | SPACT55 | Stomach N |
| Lymphoma, Hodgkins see RNA 959 | CL153 | SPACT70 | Thymus N |
| Lymphoma, B cell | CL152 | SPACT75 | Skeletal Muscle N |
| Lymphoma, B cell see RNA 958 | CL155 | SPACT73 | Heart N |
| Lymphoma, B cell | 944 | 243502B | Esophagus N |
| Lymphoma, B cell | 958 | 1006 | Colon N |
| Lymphoma, B cell | 954 | SPACT65 | Small Intestine N |
| Lymphoma | 960 | 779B | Trachea N |
| Lymphoma, T cell | 957 | S9327328 | Bladder N |
| Lymphoma, B cell | 914B | | |
| Lymphoma, B cell | 913 | | |
| Lymphoma, B cell | 944B | | |
| Lymphoma, B cell/failed | 903 | | |

*Fig. 4*

| High Differential Expression in Group 1 | | | | | All Mean Signal 1 > 0.3 | |
|---|---|---|---|---|---|---|
| All Lymphomas > N comparison for Lymphomas | | | | | Threshold : 3 | |
| Element (384) | Element (96) | Patent Matter # | BP | Ratio | Mean Signal 1 | Mean Signal 2 |
| Mean Signal 2 = < 0.1 | | | | | | |
| Seq. ID No. | | | | | | |
| 10,516 | R0439 C2 | 505 | 334 | 20.63 | 1.596 | 0.077 |
| 10,505 | R0432 F1 | 505 | 265 | 14.19 | 0.338 | 0.024 |
| 10,532 | R0458 E10 | 505 | 255 | 8.97 | 0.532 | 0.059 |
| 10,487 | R0408 A10 | 505/528 | 289 | 8.97 | 0.313 | 0.035 |
| 10,534 | R0459 D1 | 505 | 432 | 6.79 | 0.64 | 0.094 |
| 10,500 | R0424 C3 | 528 | 486 | 6.62 | 0.4 | 0.06 |
| 10,495 | R0417 D10 | 505 | 210 | 5.99 | 0.571 | 0.095 |
| 10,535 | R0459 E11 | 519 | 365 | 5.89 | 0.445 | 0.075 |
| 10,504 | R0431 C7 | 505 | 218 | 5.76 | 0.302 | 0.052 |
| 10,488 | R0408 D7 | 494 | 302 | 4.54 | 0.355 | 0.078 |
| 10,492 | R0414 F8 | 505 | 526 | 3.94 | 0.304 | 0.077 |
| 10,507 | R0433 H9 | 505 | 456 | 3.9 | 0.302 | 0.077 |
| 10,499 | R0424 A9 | 528 | 528 | 3.89 | 0.328 | 0.084 |
| 10,498 | R0421 F11 | 528 | 501 | 3.75 | 0.355 | 0.095 |
| 10,493 | R0414 H4 | 505 | 637 | 3.55 | 0.313 | 0.088 |
| 10,508 | R0436 A3 | 505 | 610 | 3.21 | 0.308 | 0.096 |

*Fig. 5A*

| High Differential Expression in Group 1 | | | | All Mean Signal 1 > 0.3 | | |
|---|---|---|---|---|---|---|
| All Lymphomas > N comparison for Lymphomas | | | | | Threshold : 3 | |
| Element (384) | Element (96) | Patent Matter # | BP | Ratio | Mean Signal 1 | Mean Signal 2 |
| Mean Signal 2 = 0.1 - 0.2 | | | | | | |
| 10,525 | R0440 F7 | 505 | 378 | 11.05 | 1.664 | 0.151 |
| 10,523 | R0440 E2 | 505 | 616 | 10.75 | 1.565 | 0.146 |
| 10,528 | R0441 D5 | 505 | 279 | 10.15 | 1.788 | 0.176 |
| 10,517 | R0439 C6 | 505 | 617 | 10.15 | 1.298 | 0.128 |
| 10,526 | R0441 B2 | 505 | 616 | 9.86 | 1.117 | 0.113 |
| 10,497 | R0421 C1 | 528 | 737 | 9.68 | 1.204 | 0.124 |
| 10,513 | R0438 E8 | 548 | 364 | 9.47 | 1.374 | 0.145 |
| 10,524 | R0440 F2 | 505 | 431 | 8.25 | 1.537 | 0.186 |
| 10,522 | R0440 E1 | 505 | 222 | 7.71 | 1.29 | 0.167 |
| 10,527 | R0441 C4 | 505 | 576 | 6.84 | 1.131 | 0.165 |
| 10,533 | R0459 A7 | 505 | 645 | 6.19 | 0.826 | 0.133 |
| 10,530 | R0458 C12 | 548 | 475 | 5.5 | 0.731 | 0.133 |
| 10,496 | R0421 A3 | 528 | 595 | 5.23 | 0.984 | 0.188 |
| 10,520 | R0440 C6 | 505 | 259 | 4.45 | 0.73 | 0.164 |
| 10,509 | R0437 B3 | 505 | 730 | 4.04 | 0.646 | 0.16 |
| 10,519 | R0440 C3 | 505 | 456 | 3.91 | 0.41 | 0.105 |
| 10,491 | R0410 A9 | 505 | 315 | 3.88 | 0.738 | 0.19 |
| 10,489 | R0408 H9 | 516 | 562 | 3.66 | 0.374 | 0.102 |
| 10,494 | R0416 G9 | 505 | 545 | 3.64 | 0.472 | 0.13 |
| 10,486 | R0407 B5 | 516 | 524 | 3.43 | 0.592 | 0.173 |
| 10,503 | R0428 D3 | 528 | 399 | 3.24 | 0.428 | 0.132 |
| 10,521 | R0440 D11 | 528/505 | 603 | 3.21 | 0.485 | 0.151 |
| 10,490 | R0409 D9 | 505/528 | 289 | 3.11 | 0.366 | 0.118 |
| 10,511 | R0437 G11 | 505 | 526 | 3.03 | 0.439 | 0.145 |
| Mean Signal 2 > 0.2 | | | | | | |
| 10,518 | R0439 G12 | 505 | 485 | 5.76 | 3.324 | 0.577 |
| 10,515 | R0439 A8 | 505 | 293 | 4.7 | 6.398 | 1.362 |
| 10,501 | R0425 A3 | 528 | 512 | 4.33 | 1.01 | 0.234 |
| 10,529 | R0458 B8 | 548 | 678 | 4.32 | 1.394 | 0.323 |
| 10,531 | R0458 C6 | 505 | 251 | 4.31 | 1.744 | 0.405 |
| 10,512 | R0438 E3 | 505 | 295 | 4.29 | 2.147 | 0.5 |
| 10,536 | R0459 E12 | 528 | 507 | 4.24 | 0.978 | 0.231 |
| 10,510 | R0437 D8 | 494 | 510 | 4.21 | 7.328 | 1.74 |
| 10,506 | R0433 F4 | 505 | 420 | 3.65 | 0.81 | 0.222 |
| 10,514 | R0438 F7 | 528 | 200 | 3.44 | 6.874 | 2.001 |
| 10,502 | R0425 A5 | 528 | 433 | 3.33 | 0.766 | 0.23 |

*Fig. 5B*

| Seq. ID No. | GenBank <1.e-25 | Access ID | GenBank Description 7/9/2001 |
|---|---|---|---|
| 10,516 | 47 | 3928244 | lg kappa light chain VJ region |
| 10,505 | 5 | 13591713 | lg superfamily receptor translocat. assoc. protein 2c (IRTA2) |
| 10,532 | 8 | 7705303 | hypothetical protein (8M-009) |
| 10,487 | 3 | 13752361 | ADP-ribosylation factor binding protein GGA2s |
| 10,534 | 25 | 32485 | heat shock protein hsp86 |
| 10,500 | 6 | 10438409 | cDNA: FLJ22136 fis. Clone HEP20890 |
| 10,495 | 4 | 13540577 | hypothetical protein DKFZp564K0822 (DKFZP564K0822) |
| 10,535 | 3 | 13775193 | hypothetical protein DKFZp434B195 |
| 10,504 | 1 | 5263056 | DNA seq. from clone RP3-437M21 on Chr. 22q13.2-13.33 |
| 10,488 | 1 | 2576344 | Chr. 16 BAC clone CIT987SK-A-735G6, complete |
| 10,492 | 3 | 7940357 | Chr. 22q11 clone b461k10, complete seq. |
| 10,507 | 3 | 14550413 | lg superfamily receptor translocation associated 2 (IRTA2) |
| 10,499 | 17 | 13652932 | protein x 0004 (LOC51184) mRNA |
| 10,498 | 3 | 14150032 | hypothetical protein DKFZp761B1514 (CKFZp761B1514) |
| 10,493 | 2 | 10047288 | mRNA for KIAA1607 protein, partial cds |
| 10,508 | 0 | 0 | 0 |
| 10.525 | 160 | 441354 | rearranged lg kappa light chain variable region (1.26) |
| 10.523 | 12 | 29773 | B lymphocyte antigen CD20 (B1, Bp35) |
| 10,528 | 171 | 33741 | rearranged immunoglobulin lambda light chain |
| 10,517 | 12 | 29773 | B lymphocyte antigen CD20 |
| 10,526 | 12 | 29773 | B lymphocyte antigen CD20 (B1, Bp35) |
| 10,497 | 0 | 0 | 0 |
| 10,513 | 24 | 703088 | MHC class II DPw3-alpha-1-chain |
| 10,524 | 11 | 29773 | B lymphocyte antigen CD20 (B1, Bp35) |
| 10,522 | 165 | 536774 | germline IGLV3S2 gene for lg lambda variable region |
| 10,527 | 12 | 29773 | B lymphocyte antigen CD20 (B1, Bp35) |
| 10,533 | 3 | 7020973 | cDNA FLJ20706 fis, clone KAIA1273 |

*Fig. 5C*

| Seq. ID No. | GenBank <1.e-25 | Access ID | GenBank Description 7/9/2001 |
|---|---|---|---|
| 10,530 | 3 | 10439253 | cDNA: FLJ22747 fis, clone KAIA0120 |
| 10,496 | 0 | 0 | 0 |
| 10,520 | 6 | 29773 | B lymphocyte antigen CD20 |
| 10,509 | 2 | 12584450 | DNA seq. from clone RP11-29716 on Chr. 13, complete seq. |
| 10,519 | 3 | 14550413 | Ig superfamily receptor translocation associated 2 (IRTA2) |
| 10,491 | 0 | 0 | 0 |
| 10,489 | 12 | 11433251 | KIAA0101 gene product (KIAA0101), mRNA |
| 10,494 | 7 | 10438413 | cDNA: FLJ22139 fis, clone HEP20959 |
| 10,486 | 12 | 11433251 | KIAA0101 gene product (KIAA0101), mRNA |
| 10,503 | 1 | 12858505 | M. musculus adult male cecum cDNA, RIKEN full-length enriched libr. |
| 10,521 | 0 | 0 | 0 |
| 10,490 | 4 | 13752361 | ADP-ribosylation factor binding protein GGA2s |
| 10,511 | 3 | 14249329 | hypothetical protein MGC11314 |
| 10,518 | 11 | 29773 | B lymphocyte antigen CD20 |
| 10,515 | 222 | 33741 | Rearranged immunoglobulin lambda light chain |
| 10,501 | 0 | 0 | 0 |
| 10,529 | 1 | 12001993 | clone 014b03 My026 protein mRNA |
| 10,531 | 201 | 33741 | rearranged immunoglobulin lambda light chain |
| 10,512 | 6 | 179307 | B-lymphocyte cell-surface antigen B1 (CD20) |
| 10,536 | 7 | 4506044 | proteoglycan 1, secretory granule (PRG1) |
| 10,510 | 11 | 29773 | B lymphocyte antigen CD20 |
| 10,506 | 0 | 0 | 0 |
| 10,514 | 99 | 14777681 | immunoglobulin lambda joining 3 (IGLJ3) |
| 10,502 | 0 | 0 | 0 |

*Fig. 5D*

| Seq. ID No. | HUEST <1.e-25 3-7/23/01 | Corixa Databs <1.e-25 3-7/23/01 | Corixa Tumor Ag <1.e-25 3-7/23/01 | Invent Disclos. <1.e-25 3-7/23/01 | GenSeq <1.e-25 3-7/23/01 | Patent Filing <1.e-25 3-7/23/01 |
|---|---|---|---|---|---|---|
| 10,516 | 14 (911537) | 2 | 0 | 2 | 0 | 34 |
| 10,505 | (20) 12000954 | 5 | 0 | 4 | 0 | 2 |
| 10,532 | 77 (8266743) | 4 | 0 | 4 | 2 | 3 |
| 10,487 | 63 (12883422) | 18 | 0 | 12 | 3 | 7 |
| 10,534 | 0 | 1 | 0 | 6 | 0 | 8 |
| 10,500 | 74 (12798470) | 1 | 0 | 1 | 4 | 1 |
| 10,495 | 111 (12946011) | 7 | 0 | 7 | 2 | 4 |
| 10,535 | 38 (7850181) | 8 | 0 | 11 | 2 | 7 |
| 10,504 | 0 | 1 | 0 | 1 | 0 | 1 |
| 10,488 | 15 (1275016) | 2 | 0 | 2 | 0 | 1 |
| 10,492 | 85 (11592124) | 3 | 0 | 3 | 2 | 2 |
| 10,507 | 2 (12000954) | 6 | 0 | 6 | 0 | 4 |
| 10,499 | 69 (13293950) | 4 | 0 | 4 | 4 | 4 |
| 10,498 | 81 (11063636) | 1 | 0 | 2 | 1 | 3 |
| 10,493 | 14 (12343165) | 5 | 0 | 5 | 0 | 2 |
| 10,508 | 1 (12070889) | 2 | 0 | 2 | 0 | 2 |
| 10,525 | 250 (13547215) | 101 | 0 | 71 | 62 | 40 |
| 10,523 | 10 (6866994) | 1 | 0 | 1 | 2 | 43 |
| 10,528 | 2 (12909772) | 1 | 0 | 1 | 0 | 38 |
| 10,517 | 40 (12019778) | 3 | 0 | 3 | 0 | 40 |
| 10,526 | 7 (11592147) | 3 | 0 | 3 | 0 | 43 |
| 10,497 | 0 | 15 | 0 | 17 | 0 | 16 |
| 10,513 | 0 | 1 | 0 | 1 | 0 | 2 |
| 10,524 | 16 (12902627) | 6 | 0 | 5 | 0 | 39 |
| 10,522 | 9 (8155824) | 4 | 0 | 5 | 1 | 35 |

*Fig. 5E*

| Seq. ID No. | HUEST <1.e-25 3-7/23/01 | Corixa Databs <1.e-25 3-7/23/01 | Corixa Tumor Ag <1.e-25 3-7/23/01 | Invent Disclos. <1.e-25 3-7/23/01 | GenSeq <1.e-25 3-7/23/01 | Patent Filing <1.e-25 3-7/23/01 |
|---|---|---|---|---|---|---|
| 10,527 | 1 (1471308) | 5 | 0 | 5 | 0 | 40 |
| 10,533 | 20 (10162753) | 1 | 0 | 2 | 1 | 1 |
| 10,530 | 8 (565914) | 1 | 0 | 2 | 1 | 1 |
| 10,496 | 0 | 8 | 0 | 9 | 0 | 9 |
| 10,520 | 0 | 7 | 0 | 7 | 0 | 15 |
| 10,509 | 38 (11593033) | 3 | 0 | 2 | 2 | 2 |
| 10,519 | 6 (5886479) | 1 | 0 | 1 | 0 | 4 |
| 10,491 | 27 (1933024) | 14 | 0 | 9 | 0 | 8 |
| 10,489 | 213 (13456724) | 27 | 1 (O597S) | 24 | 7 | 12 |
| 10,494 | 67 (10817681) | 27 | 0 | 25 | 0 | 6 |
| 10,486 | 162 (13284392) | 25 | 0 | 17 | 5 | 12 |
| 10,503 | 38 (5924697) | 1 | 0 | 1 | 0 | 1 |
| 10,521 | 31 (6892642) | 2 | 0 | 2 | 0 | 5 |
| 10,490 | 66 (12883422) | 18 | 0 | 12 | 3 | 7 |
| 10,511 | 13 (10035232) | 1 | 0 | 1 | 1 | 1 |
| 10,518 | 1 (2896816) | 1 | 0 | 1 | 0 | 16 |
| 10,515 | 233 (13442196) | 111 | 0 | 104 | 56 | 122 |
| 10,501 | 59 (1191101) | 3 | 0 | 3 | 0 | 3 |
| 10,529 | 126 (8168503) | 2 | 0 | 3 | 1 | 1 |
| 10,531 | 232 (12341574) | 226 | 0 | 211 | 41 | 128 |
| 10,512 | 1 (6638748) | 1 | 0 | 1 | 0 | 15 |
| 10,536 | 0 | 1 | 0 | 3 | 0 | 54 |
| 10,510 | 13 (12770918) | 3 | 0 | 3 | 0 | 39 |
| 10,506 | 51 (7044121) | 6 | 0 | 7 | 0 | 4 |
| 10,514 | 100 (14068988) | 103 | 0 | 102 | 56 | 123 |
| 10,502 | 0 | 3 | 0 | 3 | 0 | 3 |

*Fig. 5F*

| High Differential Expression in Group 1 | | | All Mean Signal 1 > 0.3 | | |
|---|---|---|---|---|---|
| All Lymphomas > N comparison for Lymphomas | | | | Threshold : 3 | |
| Element (384) | Element (96) | BP | Ratio | Mean Signal 1 | Mean Signal 2 |
| Mean Signal 2 = < 0.1 | | | | | |
| Seq. ID No. | | | | | |
| 10,548 | R0410 D9 | 389 | 40.12 | 0.307 | 0.008 |
| 10,552 | R0411 D1 | 274 | 37.21 | 0.406 | 0.011 |
| 10,574 | R0442 H5 | 202 | 18.27 | 0.394 | 0.022 |
| 10,555 | R0413 B9 | 509 | 13.58 | 0.368 | 0.027 |
| 10,547 | R0410 D5 | 332 | 12.1 | 0.455 | 0.038 |
| 10,561 | R0432 A11 | 729 | 9.67 | 0.554 | 0.057 |
| 10,572 | R0441 B1 | 582 | 8.79 | 0.873 | 0.099 |
| 10,553 | R0412 C9 | 363 | 6.65 | 0.341 | 0.051 |
| 10,541 | R0408 E10 | 519 | 5.33 | 0.332 | 0.062 |
| 10,562 | R0438 B1 | 384 | 4.55 | 0.324 | 0.071 |
| 10,569 | R0439 D6 | 471 | 4.4 | 0.36 | 0.082 |
| 10,551 | R0410 G11 | 530 | 3.44 | 0.328 | 0.095 |

*Fig. 6A*

| High Differential Expression in Group 1 | | | | All Mean Signal 1 > 0.3 | |
|---|---|---|---|---|---|
| All Lymphomas > N comparison for Lymphomas | | | | Threshold : 3 | |
| Element (384) | Element (96) | BP | Ratio | Mean Signal 1 | Mean Signal 2 |
| Mean Signal 2 = 0.1 - 0.2 | | | | | |
| 10,576 | R0457 A9 | 231 | 10.19 | 1.761 | 0.173 |
| 10,567 | R0438 F8 | 465 | 7.76 | 1.5 | 0.193 |
| 10,565 | R0438 C4 | 350 | 7.5 | 1.053 | 0.14 |
| 10,580 | R0459 F1 | 653 | 6.82 | 1.03 | 0.151 |
| 10,545 | R0410 A7 | 375 | 6.5 | 0.959 | 0.148 |
| 10,540 | R0408 D1 | 233 | 4.97 | 0.612 | 0.123 |
| 10,560 | R0428 D9 | 522 | 4.17 | 0.768 | 0.184 |
| 10,577 | R0457 B7 | 453 | 3.97 | 0.47 | 0.118 |
| 10,556 | R0416 A7 | 334 | 3.91 | 0.423 | 0.108 |
| 10,550 | R0410 F10 | 298 | 3.9 | 0.435 | 0.112 |
| 10,543 | R0409 B7 | 302 | 3.87 | 0.509 | 0.131 |
| 10,557 | R0416 D12 | 546 | 3.85 | 0.416 | 0.108 |
| 10,544 | R0409 D12 | 583 | 3.71 | 0.569 | 0.153 |
| 10,579 | R0459 D2 | 342 | 3.66 | 0.513 | 0.14 |
| 10,563 | R0438 C1 | 377 | 3.58 | 0.419 | 0.117 |
| 10,549 | R0410 E1 | 358 | 3.48 | 0.347 | 0.1 |
| 10,559 | R0417 E7 | 455 | 3.44 | 0.35 | 0.102 |
| 10,554 | R0413 A5 | 364 | 3.4 | 0.346 | 0.102 |
| 10,538 | R0407 B1 | 369 | 3.29 | 0.414 | 0.126 |
| 10,539 | R0407 D4 | 188 | 3.17 | 0.321 | 0.101 |
| 10,566 | R0438 F4 | 270 | 3.15 | 0.416 | 0.132 |
| 10,537 | R0406 H9 | 662 | 3 | 0.321 | 0.107 |
| Mean Signal 2 > 0.2 | | | | | |
| 10,568 | R0439 C11 | 678 | 13.02 | 3.704 | 0.285 |
| 10,546 | R0410 B8 | 408 | 10.65 | 4.045 | 0.38 |
| 10,564 | R0438 C10 | 467 | 7.79 | 1.95 | 0.25 |
| 10,570 | R0440 E11 | 411 | 6.39 | 2.361 | 0.369 |
| 10,578 | R0458 C7 | 430 | 5.36 | 3.701 | 0.69 |
| 10,573 | R0441 B8 | 339 | 4.09 | 0.905 | 0.221 |
| 10,542 | R0409 A5 | 588 | 3.69 | 0.757 | 0.205 |
| 10,558 | R0417 C5 | 499 | 3.27 | 1.776 | 0.543 |
| 10,575 | R0445 D10 | 305 | 3.26 | 1.965 | 0.602 |
| 10,571 | R0440 H9 | 303 | 3.21 | 0.816 | 0.254 |

*Fig. 6B*

| Seq. ID No. | GenBank <1.e-25 | Access ID | GenBank Description 7/03-05/2001 |
|---|---|---|---|
| 10,548 | 0 | 0 | hu repeat |
| 10,552 | 1 | 5262709 | mRNA: cDNA DKFZp586N1323 |
| 10,574 | 12 | 13642967 | poly(A)-binding protein, cytoplasmic 1 (PABPC1) |
| 10,555 | 0 | 0 | 0 |
| 10,547 | 7 | 9506672 | hypothetical protein (FLJ20323), mRNA |
| 10,561 | 2 | 12584450 | DNA seq. from clone RP11-29715 on Chr. 13 |
| 10,572 | 176 | 5925696 | Genomic, chromosome 6p21.3, HLA Class I region |
| 10,553 | 0 | 0 | 0 |
| 10,541 | 7 | 11493464 | Clone FLC0675 PRO2870 mRNA |
| 10,562 | 1 | 12000431 | 12 BAC RP11-612B6 |
| 10,569 | 12 | 12653014 | proteasome (prosome, macropain) subunit, beta type |
| 10,551 | 3 | 3327063 | mRNA for KIAA0625 protein, partial cds |
| 10,576 | 22 | 219402 | eukaryotic initiation factor 4AI |
| 10,567 | 33 | 13279085 | RAN, member RAS oncogene family |
| 10,565 | 41 | 5566605 | MIF2 suppressor (HSMT3) |
| 10,580 | 25 | 184231 | non-histone chromosomal protein HMG-14 gene |
| 10,545 | 0 | 0 | 0 |
| 10,540 | 7 | 12803596 | hypothetical protein FLJ20647, clone MGC:3443 |
| 10,560 | 25 | 4506236 | proteasome activator subunit 2 (PA28 beta) (PSME2) |
| 10,577 | 4 | 13540577 | hypothetical protein DKFZp564K0822 |
| 10,556 | 6 | 10440178 | cDNA: FLJ23476 fis, clone HSI14935 |
| 10,550 | 3 | 5103007 | genomic DNA, Chr. 22q11.2, clone KB1269D1 |
| 10,543 | 1 | 4500154 | mRNA: cDNA DKFZp586A0618 |
| 10,557 | 6 | 10437682 | cDNA: FLJ21562 fis, clone COL06420 |
| 10,544 | 4 | 143329055 | chromosome 5 clone CTC-467M3 |
| 10,579 | 1 | 6807703 | cDNA DKFZp434C1714 |

*Fig. 6C*

| Seq. ID No. | GenBank <1.e-25 | Access ID | GenBank Description 7/03-05/2001 |
|---|---|---|---|
| 10,563 | 2 | 2598184 | regulator of G protein signaling (RGS13) |
| 10,549 | 0 | 0 | |
| 10,559 | 3 | 10438346 | cDNA: FLJ22084 fis, clone HEP14920 |
| 10,554 | 0 | 0 | |
| 10,538 | 0 | 0 | |
| 10,539 | 2 | 8102860 | mRNA: cDNA DKFZp434P171 (clone DKFZp434P171) |
| 10,566 | 8 | 13633789 | hepatocellular carcinoma-assoc. antigen 65 (HCA66) |
| 10,537 | 3 | 2661068 | clone 23785 mRNA seq. |
| 10,568 | 51 | 14124943 | ribosomal protein L4 |
| 10,546 | 1 | 10185402 | DNA seq. from clone RP11-432M24 on Chr. 13 |
| 10,564 | 45 | 14141173 | high-mobility group (nonhistone chrom.) protein 2 (HMG2) |
| 10,570 | 135 | 13436316 | tubulin alpha 6 |
| 10,578 | 0 | 0 | |
| 10,573 | 44 | 5566805 | MIF2 suppressor (HSMT3) |
| 10,542 | 10 | 7022980 | cDNA FLJ10754 fis, clone NT2RP3004544 |
| 10,558 | 1 | 5817076 | cDNA DKFZp586O1224 (from clone DKFZp586O1224) |
| 10,575 | 42 | 13638568 | nuclease sensitive element binding protein 1 (NSEP1) |
| 10,571 | 0 | 0 | |

*Fig. 6D*

| Seq. ID No. | huEST <1.e-25 3-23-01 | Corixa Databs <1.e-25 3-23-01 | Corixa Tumor AG <1.e-25 3-23-01 | Invent. Disclos. <1.e-25 3-23-01 | GenSeq <1.e-25 3-23-01 |
|---|---|---|---|---|---|
| 10,548 | 21 (9704289) | 3 | 0 | 3 | 0 |
| 10,552 | 57 (13285739) | 1 | 0 | 1 | 2 |
| 10,574 | 18 (6603577) | 1 | 0 | 2 | 0 |
| 10,555 | 37 (10399002) | 1 | 0 | 1 | 1 |
| 10,547 | 60 (4763542) | 1 | 0 | 1 | 0 |
| 10,561 | 46 (11593033) | 5 | 0 | 3 | 4 |
| 10,572 | 34 (7998550) | 8 | 0 | 8 | 2 |
| 10,553 | 4 (10263969) | 1 | 0 | 1 | 0 |
| 10,541 | 159 (12604626) | 4 | 0 | 3 | 3 |
| 10,562 | 1 (7113300) | 1 | 0 | 1 | 0 |
| 10,569 | 14 (10399152) | 2 | 0 | 2 | 0 |
| 10,551 | 29 (1280909) | 1 | 0 | 2 | 2 |
| 10,576 | 4 (12674085) | 3 | 0 | 2 | 1 |
| 10,567 | 1 (13290909) | 1 | 0 | 1 | 0 |
| 10,565 | 4 (5394077) | 4 | 0 | 4 | 0 |
| 10,580 | 96 (12525443) | 3 | 0 | 4 | 1 |
| 10,545 | 22 (11155912) | 10 | 1 | 6 | 1 |
| 10,540 | 10 (13129911) | 1 | 0 | 1 | 0 |
| 10,560 | 148 (14067253) | 14 | 0 | 13 | 5 |
| 10,577 | 0 | 4 | 0 | 5 | 1 |
| 10,556 | 38 (12428993) | 3 | 0 | 2 | 3 |
| 10,550 | 4 (2968224) | 1 | 0 | 1 | 0 |
| 10,543 | 96 (12708451) | 3 | 0 | 3 | 3 |
| 10,557 | 38 (12945883) | 13 | 0 | 13 | 0 |

*Fig. 6E*

| Seq. ID No. | huEST <1.e-25 3-23-01 | Corixa Databs <1.e-25 3-23-01 | Corixa Tumor AG <1.e-25 3-23-01 | Invent. Disclos. <1.e-25 3-23-01 | GenSeq <1.e-25 3-23-01 |
|---|---|---|---|---|---|
| 10,544 | 125 (12800010) | 9 | 0 | 2 | 5 |
| 10,579 | 93 (12787237) | 9 | 0 | 8 | 3 |
| 10,563 | 0 | 2 | 0 | 2 | 0 |
| 10,549 | 35 (2910384) | 4 | 0 | 1 | 1 |
| 10,559 | 117 (12333933) | 6 | 0 | 6 | 2 |
| 10,554 | 19 (8159998) | 8 | 0 | 4 | 0 |
| 10,538 | 22 (8362796) | 2 | 0 | 3 | 0 |
| 10,539 | 59 (11681430) | 1 | 0 | 1 | 1 |
| 10,566 | 1 (12155967) | 1 | 0 | 1 | 1 |
| 10,537 | 32 (1137727) | 1 | 0 | 1 | 0 |
| 10,568 | 7 (2006441) | 1 | 0 | 1 | 2 |
| 10,546 | 38 (10731492) | 5 | 0 | 5 | 0 |
| 10,564 | 239 (14055451) | 8 | 0 | 5 | 5 |
| 10,570 | 14 (12727100) | 8 | 0 | 9 | 1 |
| 10,578 | 0 | 101 | 0 | 100 | 0 |
| 10,573 | 3 (5436308) | 8 | 0 | 8 | 0 |
| 10,542 | 31 (6657449) | 2 | 0 | 3 | 2 |
| 10,558 | 65 (12387261) | 11 | 0 | 7 | 0 |
| 10,575 | 115 (12765428) | 11 | 0 | 9 | 10 |
| 10,571 | 45 (3400628) | 3 | 0 | 3 | 0 |

*Fig. 6F*

Identification of lineage specific markers and candidate lymphoma, leukemia and myeloma antigens

| Gene | CD34+ | CD19+ | CD14+ | CD2+ | Ly | Hodgkin | Myeloma | CLL* | AML |
|---|---|---|---|---|---|---|---|---|---|
| CD20 | - | +++ | - | - | +++ | + | + | ++ | +/- |
| CD21 | - | + | - | - | +++ | ++ | + | + | - |
| TCL1 | - | + | - | - | +++ | + | - | ++ | - |
| Ly1448 | - | +++ | - | - | +++ | | ++ | | ++ |
| Ly1452 | - | +++ | - | - | +++ | + | + | ++++ | +/- |
| Ly1456 | - | ++ | - | + | ++, T-NHL | + | ++ | ++++ | - |
| Ly1464 | - | +++ | - | - | +++ | + | n.d. | n.d. | n.d. |
| Ly1483 | - | +++ | - | + | ++ | ++ | + | n.d. | - |
| Ly1458 | - | +++ | - | + | +++ | + | n.d. | n.d. | n.d. |
| Ly1481P | - | +++ | - | + | +++ | + | n.d. | n.d. | n.d. |
| Ly1485P | - | ++ | - | - | ++ | - | n.d. | n.d. | n.d. |
| Ly1480 | + | ++ | ++ | + | +++ | + | n.d. | n.d. | n.d. |
| Ly1488 | + | ++ | ++ | + | +++ | ++ | n.d. | n.d. | n.d. |
| Ly1484 | + | ++ | +/- | +/- | +++ | ++ | n.d. | n.d. | n.d. |
| Ly1482 | ++ | +++ | ++ | +++ | +++ | ++ | n.d. | n.d. | +++ |
| Ly1453 | ++ | ++ | ++ | ++ | +++, T-NHL | +++ | +++ | +++ | ++ |
| Ly1449 | ++ | + | - | + | + | + | + | n.d. | n.d. |
| Ly1447 | ++ | +++ | + | ++ | ++ | ++ | n.d. | ++ | n.d. |
| Ly1451 | ++ | ++ | ++ | +++ | ++ | + | + | ++ | ++++ |
| CD52 | ++ | +++ | +++ | +++ | +++ | ++ | n.d. | n.d. | n.d. |
| CD45 | +++ | +++ | +++ | +++ | +++ | | n.d. | n.d. | n.d. |

Figure 8

\* single probe

SEQ ID NO: 10,581

Ly1447 sequence:
CCTTCAACAGACTGCATGGGGTCCACCCACATTAGGGTGGAGTTTGTTCTGCCACTGTGCAGTTATCATTCTGGGATGGG
GGTACCTTACTCTCCCAATGAGAAATTCTAAATTTCCTCTTTTGAGCCTGGTGCCTCCACCTTCTCANAACTGCATAGGG
CGTGAGCTTTGTTGGTGATGTGACCTCCAGAACAGACTGTGACCAGATTTTTTTCTTTAATCCTGAGCCTATGCTTGCTG
CTGTCCTTCTTGACTTTCAACTAGGCCTAAAAAAGCGN

SEQ ID NO: 10,582

Ly1448 Sequence
CCAGGGTTAGGACATTCAAATGTCTTTATCCACATTCCTGAAGGATAATTGTTTATAGATTCCCCTACCTCCATAGGAATGC
TTATAATGGATTATCTATACAATCTCCACATTCCCACATTTTGCATTAGAGAATGGAATCAGTCAAACCCTGTTCCCAGA
GTTTCCCTTAGAGTTCTCACCTGTTGTCTTATATCCATCTAGGAATCCCCATCTCTAATGTAAGCTTGGAGATCCGGCC
CCCGGGGACAGGTGACTGAAGGACAAAAACTGATCCTGCTCTGCTCAGTGGCTGGGGGTACAGGAAATGTCACATTCTC
CTGGTACAGAGGAGGCCACAGGAACCAGTATGGGAAAGAAAACCCAGCCGTTCCCTGTCAGCAGAGCTGGAGATCCCAGCTG
TGAAAGAGAGTGATGCCGGCAAATATTACTGTAGAGCTGACAACGGCCATGTGCCTATCCAGAGCAAGGTGGTGAATATC
CCTGTGAGAAGACCTGATGGCTATAGAAGAGACCTCATGACAG

SEQ ID NO: 10,583

Ly1449 Sequence
CCACATTGGGAATTCTGCACACAGGTGCCTGCTCCACCANNCAGAGAGGCCTCAGGAGATTGTCCAGGGACAAGGAGACCT
GGCCGGACCTCTGCAGGGAGGTGAGGCCCCTGCCCCCATCTTGTCCCATCACATTCTGGATGTTTGGCATCCCCAGGCTC
CTGGGAGGGGAGAAGTGCTGATAAAAAGGCCAAAAATCACACAGAAAGAGGACAGAAAACTCCACGCACTTCCTACATAG
GTGCTACCGTATTCCTACGAGCACGGGGCCTGTGTTGAAGACTCCCTCTGGAAGTTACAGAAGGAAGCCACCAAGAGTTC
AGCCTCACAGCCTCTTTCTCAGATGCAGTCACCCACTTTACCAAACTTGGCACATCCAACCACTCCTTTCATAATTTTACA
CCTGTTTGTGGCCTGGCTGACAGATATTTTGTNATTGATCTTTCTAATTTCAGGGATTCTAAATGTGTTTTGAGAATCTG
GTCAGCACTCANGGATTCTGTCTTT

SEQ ID NO: 10,584

Ly1451 Sequence
CTGCTGCTAAATACCTNTGAGAAAACTCTGCTTCTATCTAAGGGGACCTACTTTTNTCNGGAATCTCAATACTTGGAACAA
GAACCTCCTANACGGACCCTTTGGCATAATGAATTGGACCAACTGTAGGTTCCAGGACTAGAGAGCCAGCAATGCCTCCA
TGAACAATCTCACCCAATTACTCTGCTCAGGAAACGAGGTAACTGATGGACAGCCGAGGCAGCCCCTTAGGCGGCTTAGG

SEQ ID NO: 10,585

Ly1452 Sequence
AAAANACCAATAGCAGCCAAAACAGAACATTTGTAAACAAAACCACAACTATCAGCCCTGTGCTTAAACACAGAATCTGC
ATTCTTTTGAAACATTAAGTATATGCAATAAAGAGAATATAGACCATCTTTTTCCTTAATATACAATACCCAATATCTAA
AACAATGTCACCAATAATAGACACAAATCGGTGTTATCATAAGGCATGTTGAACAGTCTTTTTCACAGTACTCAGGGGCA
TCATGGGGCTGCAGAGGGCCACACTTTCCAGAAGTTTTCTCCTCGCTGTGATCCTCGCACACCGGGGGCACTCGGAGGACT
GGAAGCACTGTTTTGTGAAAGCAAGCCCTGCACGCTGAACATCTTCTACATGTTGCTGTCTGAAATGGGAAGATGACAGTC
GTATTCTGGCAAAATTCACAAATAAAAGCCCTTTCCTTGACACAGCTCACAGCCAGCCACATGTGCAAGGGAAGCTTGNAG
AATGTCCTTGAGTAAGGGTGCCAGCAGCCCTTTCTTGATCCTGACCAGGTCCTCAAGGGAGAACAGGTGGAGCTCATCAG
TCAAGTGTCCCGGCCCTGCCCTACAAACTCCTTTAATGCACTGTTAGCAAACCTACAGGTCTTCAACAGCTTCTTGATAT
GGAACAGCTGCTCCTGAATTTCCTTC

SEQ ID NO: 10,586

Ly1453 Sequence
CCAAAAACTTCAGCATAAAAACTATCCTGTCTGTGTATTATATATATATTTATTACNNNATTTAATAAACAAAAACCACTTT
TGAACCAGGTAATTTTATCTAGTGTGAAAAGAAATTAATCACATGGTCATATACTGGCTAGTGCTCTCTAAAAGTAGACA
TTAAAATATTTCATAATTGGAGGGAATCTTTGGAGATTAGTGGCATCTAATCTTGGGGCCTCAGACACCCAAAAATCTATA
TATTGACCAGTGGAAGTTGATGATTTGTTATCAAATTTCAAAGCACCTAATGGAAACCCCACTTCATCTCTGTGAAGATT
TTCAGTNCCTTTACAGTTATTTGAAATTATTTCAATTCTGTGGAGCCACTTCAGAAAACTCCAATGGGCCTTTGCAATATT
AAAATGTGGAGAATGCATTAATCATTATTTAATCAATGAGTTT

SEQ ID NO: 10,587

Ly1454 Sequence
CCTCTCCCACAGGCTGCTTGAGTGTCCTCATGACACAACAGTTGGCTTACTCCAGAGTGAGCAACTCAAGAGAGAGCAAGG
CAGAAGCTACCAAATCTTTATGTTTGAAGTCATGCACCATCTTTTCCACGAGTATCCTGTTGATTATTTTGATCAGCTTG
TTCAGTCTGGGCAGGGAATTGCACAAGGGCATGAATACTCCACTGGCAAGGATCATTGGGGGCCATCTTGGAAGCTGTGTG
AATGAGAAATGAATGCACAGATAGAATATTAGCAGTGACAATGATGCTAGAGGTCAACTACCCCACTGTCCTCTTGTCC
TTCTCCCCCAAACCCTCCCCTGCTCCCAGGCAAGAAGCCCTCTAGCCTCTGCTTGATCACTTTCAGCACTCAACATCTTCA
GGGAACCTATTCCGCCGTGGGACAGTGTTAATTAGTGGAAAACTCTTTTTTCAAAAGTTGAAATCAGTTCCTCTGTGTCTA
TTACCTGCTGATCACTGTCCAGACTTCTGGAGGACACAGAGCAAGTTTTATTCCTCTTACTGATGGTAGCCTTTCAGATC
CATCCCTTCCCTCCAGTATATTAGAGTTACGTAAATTCTTAAAATGCTTAGCAGCTCATTTATCCTGAACA

SEQ ID NO: 10,588

Ly1456 Sequence
AAAGACATGAAAAATATCCCAAGATCATACTAGATCATAATAGCAATTCCTTTACAAATGAATTATGGAGGTAACTGATC
TCTAACAGTTTCCTTCATGTTGTTTTAATGCACAAGGGCAGAGGATCTGCCGACCCTTGGAACCAGCGTGAGCTAACCAC
GTGCTATAGACACTTCATGGTGTCGTACCCAGGGAAGTCAAAGCGCTTTGCTCCCTCACTGTCTGTGAGTCCTCAGCCAT
TAGTAGCCCACCCCCCGCTGCTCCAAAACTTGAGTTGTTTCAAATGTTTCTCACTGTTCATCTCTNCACTGACCCCACTC
CAGAAAGCCTGGAGAGAGGCCAAGATGCCACCCACCTTCCCCAATCCCTCGCCACAGATCTGTGTCTATCACACACTCTG
TAAGTGCCGCTTTGCTTCTTCCTCTCTTGAAAAGACTGAGAACACACATTTTTAACATGTTANGAAAATGGGGCAGGCTAA
AAAATGACTGATCCCACCGGCCAGTGACTCA

SEQ ID NO: 10,589

Ly1458 Sequence
TTGAATGCTCTATTTTGCNGNTAANNNTTTATTNACTAGTCTCAGTAATACATTAGTAAAAANCATGTCNCTTAATTAATT
GGGTTANAATCAAANAAACATANAGTNGGGCAATATACTTNATCCTACCCATCCCACCCAAATCTTACTCTACTCATNTC
ATTCTCATTAATTTTGGGAAANCATNANAANATGGGTTCGTTGAGTAANANATTAAAANAAATAAGCTTTTTGATCCCTG
CCAACACCCCATGCCCAGGGGGGNCACCCTCCAATACAATAACATGCCAGGAANAGTAAGNTGCCCTTTCTGANGCCGNA
ATCTGCCATCATNTTCCCATNTTCCAGNCTNTTTCCATTGCNAGNCACAATCTGGGTCTCAGGGATNATACCCGGTCTTA

SEQ ID NO: 10,590  Ly1464 Sequence
aaagagaactaatggaagtggattgaatacagcagtctcaactgggggcaattttgcccc
ccagaggacattgggcaatgtttggagacatttttggtcattatacttgggggggttggggg
atggtgggatgtgtg SEQ ID NO: 10,591  Ly1480 Sequence
CTGTAGCCTCTGCAAGTGAAAATCCAGGCCCGACTTGCAGTCATTGGACTGATGTCCAAGTGCAATCACCATACAGCAGCT
ACAGGCAGGGCTGGCTGATAGGGAGTATGGGAGAAGGACACGCTCAGATGAAAACATGCATGCAACGATTTTCACCACTG
AACACACTGTTTTCTGTGATAGAAACTGTCGGCCCTGCTGGGGGACAAGATATTCACGGCCTCACTAGCCAGTGAGATGC
CACCAGGGCGGCCTGCCCCTGATGCTCCTTTGTTACCTGCTAAAGAAGGACCATAAGGTAAAAGGCACCTTACCTTATGG
AGTGAGCCCAGACCCCAGGGAAAAGCTTGGGTAGAACAATCCAAGGGGCAGCCTGGGTGTGAGAATCCAGCCCAAGCTAG
CTGCTCTAGAAGCCTGGAGG SEQ ID NO: 10,592  Ly1482 Sequence
AAAAACAATCTACAGGCAGTTCTTTACAAGTCTCATATTTACAGATAGCACAAGCTATGGCATGGCGTATGGCCTCCCTC
CTAAATATACGATTCTTTGGCATATTGGAATTGGTCAGCCTCAAAGACCGGCTGGCTACATCGTCGCACGAGACAGTCCC
GCTTATTCCTCTGCACGGACTCGGAGACGGTCCTCAGCGGGAGGAGCTCAGGTCTCCCTGGGCCAGACACGTGCCCCAGA
GAGTCCCCAGAAGCATGGACAGTTCTGCTCTGTTTCCATCGCTCAGGCAGGGGAGAGAGTCCGTGG SEQ ID NO: 10,593  Ly1483 Sequence
GCTGGAGCTTCACTGTGAGTCCCTGAGAGGCTCCTTCCCGATCCTGTACTGGTTTTATCACGAGGATGACACCTTGGGGA
ACATCTCGGCCCACTCTGGAGGAGGGGCATCCTTCAACCTCTCTCTGACTACAGAACATTCTGGAAACTACTCATGTGAG
GCtTGACAATGGCCTGGGGGCCCAGCACAGTAAAGTGGTGACACTCAATGTTACAGGAACTTCCAGGAACAGAACAGGCC
TTACCRCTGCGGGAATCACGGGGCTGGTGSTCARCATCYTCGTCCTTGYWGCTGCTGCTGCTCTGCTGCATTACGCCAGG
GCCCGAAGGAAACCAGGAGGACTTTCTGCCACTGGAACATCTAGTCACAGTCCTAGTGAGTGTCAGGAGCCTTCCTCGTC
CAGG SEQ ID NO: 10,594  Ly1484 Sequence
CTGGGCATCACCAAGTCACAGTTTCCAGCGTGCTGCTCAGCCCTCCGAGTGTGTGTGCTCATCCTTTTCATAGAAGTCCC
ATCGGCCATGAGAGGGTTGGGCTGCAGAGCTGTGATTGCCAGAGGCCCTTCCTTGAGAACTGTGGGGAAGGAGGCCCTG
GGGGTTTCTTCTGTAGGCAGAGCTCAGGCCCCAGTCACCTCTGCCACCCTCAGCCTGGCACTGTTGTGCCAGAGCCTCTG
CTGCCTCTCTCTTCCTACCCATCTGCAGACCAGCAGAATATTCTCCCCCTCTCATCACCAACCAGGAGTTTGGTGTGGTT
TCTGGACACGGCCAGAGCAgGTCACTGCGGGCTGGTTTTGCTGGGCTTCCCTGTCAAAGCAATGCTAACGTCCAGCTCT
CGACTCAAGGCCAGGTTCTTCTCCCACTTGTGGCCTCTTGGGCTTGGAGGCTGAGCCAGGGGCTCCTCTCCTGCTGGCCG
TCCAGGAACAGgACATCTTCACATCCTCAGTCTTCCAAACCCGGACCATGCCGTCTTGACTCCCGGTGATGATGATCTGG
CTTGTGTCCCATGCTGGGCCCTCCATCAGGCAGCAACAGGTTATGGCTCCTTCTGGGCCCCAGGCTGTGGTGATGCTGG SEQ ID NO: 10,595  Ly1485
CTGTCTCCACTGTGGAGTTACTATTTTTCCTTTTCCCCATTTTATTCATCAGAAGCCAGTCACTAAGCGAGGTCAAACTC
CAGGACAGGGGAATTAAGTGCCACCTTCTGGAGAGGGAGCATTCACATTTATTACTTGGGATCCTTCTGTAAGGAAGAGC
TGTTTCTCCTCTAAAAAAACTCTTTAATCCTTTTAAGCCTCAATTTCTTAATTGTGAAATGGGGCTAATACCTGTATCCAA
CCAAGGGAGTAGTTAGAAGGTAACATGATAGGTGGAAAGCACTTAACATAGGCAAAATGTTATTATCAGGAATGATGGAG
AGACCCATCCAACTATCTGAAGGAGTCACTTAACTCTACTGTACTGCAaGCGCTGTAAAGTCtTGCATCTTTCACTGGGG
GTAAAGGCCCCCAGTCCCTGAGACGGGCCAGTTTGGAaGACAGGCTGGTTTTTTTCTCTGTTCTCCTGAGAGCCCTTCAGA
TGAGAAGGGAGGTCTGGAGACAGAATGCCAAAAGCCCATTAAAGGCACGGCCTTGCATTTCAGAGAGGGAGCAGGTCTAG
AGAAGAACCAGAGGAGCTCAG SEQ ID NO: 10,596  Ly1488
CTGGYCTGTGGGTGATCCCAGCTCTTACTAGGAGAGGGAASTGAaGGTCYTGGTGCCAGGGGCCCAGGCCCTCCAACCAT
AAACAGTCCAGGATGGAACCTGGTTCACCCTTCATACCAGCTCCAAGCCCCAKACCATGGGAGCTGTCTGGGATGTTGAT
CCTTGAGAACTTGGCCCTGTGCTTTAGACCCAAGGACCCGATTCCTGGGCTAGGAAAGAGAGAACAAGCAAGCCGGGGCT
ACCTGCCCCCAGGTGG

FIG. 9 (Continued)

Figure 1a. Ly1464 full length DNA sequence (SEQ ID NO: 10,597)

```
   1 gatgcaagga gatgagacag ttaaatttac ttcctctttt ctaatctgag aggtttcatg
  61 ttgaagaaaa tcagtgttgg ggttgcagga gacctaaaca cagtcaccat gaagctgggc
 121 tgtgtcctca tggcctgggc cctctacctt tcccttggtg tgctctgggt ggcccagatg
 181 ctactggctg ccagttttga gacgctgcag tgtgagggac ctgtctgcac tgaggagagc
 241 agctgccaca cggaggatga cttgactgat gcaagggaag ctggcttcca ggtcaaggcc
 301 tacactttca gtgaaccctt ccacctgatt gtgtcctatg actggctgat cctccaaggt
 361 ccagccaagc cagtttttga aggggacctg ctggttctgc gtgccaggc ctggcaagac
 421 tggccactga ctcaggtgac cttctaccga gatggctcag ctctgggtcc cccgggcct
 481 aacagggaat tctccatcac cgtggtacaa aaggcagaca gcgggcacta ccactgcagt
 541 ggcatcttcc agagccctgg tcctgggatc ccagaaacag catctgttgt ggctatcaca
 601 gtccaagaac tgtttccagc gccaattctc agagctgtac cctcagctga accccaagca
 661 ggaagcccca tgaccctgag ttgtcagaca aagttgcccc tgcagaggtc agctgcccgc
 721 ctcctcttct ccttctacaa ggatggaagg atagtgcaaa gcaggggct ctcctcagaa
 781 ttccagatcc ccacagcttc agaagatcac tcgggtcat actggtgtga ggcagccact
 841 gaggacaacc aagtttggaa acagagcccc cagctagaga tcagagtgca gggtgcttcc
 901 agctctgctg caccccccac attgaatcca gctcctcaga aatcagctgc tccaggaact
 961 gctcctgagg aggccctgg gcctctgcct ccgccgccaa ccccatcttc tgaggatcca
1021 ggcttttctt ctcctctggg gatgccagat cctcatctgt atcaccagat gggccttctt
1081 ctcaaacaca tgcaggatgt gagagtcctc ctcggtcacc tgctcatgga gttgagggaa
1141 ttatctggcc accggaagcc tgggaccaca aaggctactg ctgaatagaa gtaaacagtt
1201 catccatgat ctcacttaac caccccaata aatctgattc tttattttct cttcctgtcc
1261 tgcacatatg cataagtact tttacaagtt gtcccagtgt tttgttagaa taatgtagtt
1321 aggtgagtgt aaataaattt atataaagtg agaattagag tttagctata attgtgtatt
1381 ctctcttaac acaacagaat tctgctgtct agatcaggaa tttctatctg ttatatcgac
1441 cagaatgttg tgatttaaag agaactaatg gaagtggatt gaatacagca gtctcaactg
1501 ggggcaattt tgcccccag aggacattgg gcaatgtttg gagacatttt ggtcattata
1561 cttgggggt tggggatgg tgggactgtg gtgctactgg catccagtaa atagaagcca
1621 ggggtgccgc taaacatcct ataatgcaca gggcagtacc ccacaacgaa aaataatctg
1681 gcccaaaatg tcagttgtac tgagtttgag aaacccagc taatgaaac cctaggtgtt
1741 gggctctgga atgggacttt gtccctcta attattatct ctttccagcc tcattcagct
1801 attcttactg acataccagt ctttagctgg tgctatggtc tgttctttag ttctagtttg
1861 tatcccctca aaagtcatta tgttgaaatc ctaatcccca aggtgatggc attaagaagt
1921 gggcctttgg gaagtgatta gatcaggagt gcagagccct catgattagg attagtgccc
1981 ttatttaaaa aggccccaga gagctaactc acccttccac catatgagga cgtggcaaga
2041 agatgacatg tatgagaacc aaaaaacagc tgtcgccaaa caccgactct gtcgttgcct
2101 tgatcttgaa cttccagcct ccagaactat gagaaataaa attctgttgt tgt
```

Figure 1b. Ly1464 protein sequence (SEQ ID NO: 10,598)

```
MKLGCVLMAWALYLSLGVLWVAQMLLAASFETLQCEGPVCTEESSCHTEDDLTDAREAGFQVKAYTFSEPFHLIVSYDWLILQGPAKPV
FEGDLLVLRCQAWQDWPLTQVTFYRDGSALGPPGPNREPSITVVQKADSGHYHCSGIFQSPGPGIPETASVVAITVQELFPAPILRAVP
SAEPQAGSPMTLSCQTKLPLQRSAARLLFSFYKDGRIVQSRGLSSEFQIPTASEDHSGSYWCEAATEDNQVWKQSPQLEIRVQGASSSA
APPTLNPAPQKSAAPGTAPEEAPGPLPPPPTPSSEDPGFSSPLGMPDPHLYHQMGLLLKHMQDVRVLLGHLLMELRELSGHRKPGTTKA
TAE
```

FIG. 10

TMpred Report for Ly1464
Date:

SEQ ID NO: 10,598

MKLGCVLMAWALYLSLGVLWVAQMLLAASFETLQCEGPVCTEESSCHTED
DLTDAREAGFQVKAYTFSEPFHLIVSYDWLILQGPAKPVFEGDLLVLRCQ
AWQDWPLTQVTFYRDGSALGPPGPNREFSITVVQKADSGHYHCSGIFQSP
GPGIPETASVVAITVQELFPAPILRAVPSAEPQAGSPMTLSCQTKLPLQR
SAARLLFSFYKDGRIVQSRGLSSEPQIPTASEDHSGSYWCEAATEDNQVW
KQSPQLEIRVQGASSSAAPPTLNPAPQKSAAPGTAPEEAPGPLPPPPTPS
SEDPGFSSPLGMPDPHLYHQMGLLLKHMQDVRVLLGHLLMELRELSGHRK
PGTTKATAE

Black = intracellular, Red = Transmembrane, Blue = Extracellular

Ly1464 has 358 amino acids and 3 Transmembrane Domains
Transmembrane Domain 1:   3 - 24    Score: 1.5484
Transmembrane Domain 2:  71 - 92    Score: 1.3009
Transmembrane Domain 3: 158 - 179   Score: 1.3027

*FIG. 11*

Ly 1464 MHC class binding peptides (SEQ ID NOs: 10,599-10,819)

Ly1464 A1 binding peptides

| RANKING | SEQUENCE | STARTING POSITION | THEORETICAL SCORE |
|---|---|---|---|
| 1 | ATEDNQVWK | 243 | 90 |
| 2 | ASEDHSGSY | 230 | 67.5 |
| 3 | FSEPFHLIV | 67 | 67.5 |
| 4 | LTDAREAGF | 52 | 25 |
| 5 | SSEDPGFSS | 300 | 6.75 |
| 6 | ELFPAPILR | 167 | 5 |
| 7 | SSEFQIPTA | 222 | 2.7 |
| 8 | MPDPHLYHQ | 312 | 2.5 |
| 9 | LMELRELSG | 339 | 2.25 |
| 10 | HTEDDLTDA | 47 | 2.25 |
| 11 | CTEESSCHT | 40 | 2.25 |
| 12 | ALGPPGPNR | 118 | 2 |
| 13 | LGMPDPHLY | 310 | 1.25 |
| 14 | CVLMAWALY | 5 | 1 |
| 15 | KADSGHYHC | 135 | 1 |
| 16 | LRELSGHRK | 342 | 0.9 |
| 17 | QLEIRVQGA | 255 | 0.9 |
| 18 | WCEAATEDN | 239 | 0.9 |
| 19 | SAEPQAGSP | 179 | 0.9 |
| 20 | AREAGFQVK | 55 | 0.9 |

Ly1464 HLA A2 binding peptides

| RANKING | SEQUENCE | STARTING POSITION | THEORETICAL SCORE |
|---|---|---|---|
| 1 | YLSLGVLWV | 13 | 4047 |
| 2 | LLLKHMQDV | 323 | 1006 |
| 3 | VLMAWALYL | 6 | 739 |
| 4 | VLWVAQMLL | 18 | 301.4 |
| 5 | MLLAASFET | 24 | 271.9 |
| 6 | ILQGPAKPV | 81 | 118.2 |
| 7 | LLGHLLMEL | 334 | 83.53 |
| 8 | LLAASFETL | 25 | 33.81 |
| 9 | WQDWPLTQV | 102 | 29.84 |
| 10 | YTFSEPFHL | 65 | 29.29 |
| 11 | LIVSYDWLI | 73 | 18.29 |
| 12 | KLPLQRSAA | 195 | 17.39 |
| 13 | WALYLSLGV | 10 | 16.44 |
| 14 | CQAWQDWPL | 99 | 16.24 |
| 15 | GIPETASVV | 153 | 16.08 |
| 16 | QVWKQSPQL | 248 | 15.51 |
| 17 | ALYLSLGVL | 11 | 8.38 |
| 18 | QMGLLLKHM | 320 | 8.252 |
| 19 | VVAITVQEL | 160 | 7.309 |
| 20 | GVLWVAQML | 17 | 6.916 |

Ly1464 A3 binding peptides

| RANKING | SEQUENCE | STARTING POSITION | THEORETICAL SCORE |
|---|---|---|---|
| 1 | WLILQGPAK | 79 | 30 |
| 2 | ELFPAPILR | 167 | 18 |
| 3 | ALGPPGPNR | 118 | 9 |
| 4 | VLWVAQMLL | 18 | 6 |
| 5 | VLMAWALYL | 6 | 5.4 |
| 6 | LLKHMQDVR | 324 | 4 |
| 7 | KLGCVLMAW | 2 | 2.7 |
| 8 | PMTLSCQTK | 187 | 2 |
| 9 | LLGHLLMEL | 334 | 1.8 |
| 10 | GMPDPHLYH | 311 | 1.8 |
| 11 | PLTQVTFYR | 106 | 1.8 |
| 12 | LLAASFETL | 25 | 1.8 |
| 13 | HLYHQMGLL | 316 | 1.35 |

FIG. 12

| | | | |
|---|---|---|---|
| 14 | ALYLSLGVL | 11 | 1.35 |
| 15 | YLSLGVLWV | 13 | 1.2 |
| 16 | ATEDNQVWK | 243 | 1 |
| 17 | HMQDVRVLL | 327 | 0.9 |
| 18 | HLIVSYDWL | 72 | 0.9 |
| 19 | KAYTFSEPF | 63 | 0.9 |
| 20 | KQSPQLEIR | 251 | 0.81 |

Lyl464 A11 binding peptides

| RANKING | SEQUENCE | STARTING POSITION | THEORETICAL SCORE |
|---|---|---|---|
| 1 | ATEDNQVWK | 243 | 1 |
| 2 | WLILQGPAK | 79 | 0.6 |
| 3 | KQSPQLEIR | 251 | 0.36 |
| 4 | CQTKLPLQR | 192 | 0.24 |
| 5 | RVLLGHLLM | 332 | 0.18 |
| 6 | PTLNPAPQK | 270 | 0.15 |
| 7 | ELPPAPILR | 167 | 0.096 |
| 8 | ARLLFSFYK | 203 | 0.09 |
| 9 | GVLWVAQML | 17 | 0.09 |
| 10 | LLKHMQDVR | 324 | 0.08 |
| 11 | ALGPPGPNR | 118 | 0.08 |
| 12 | GHRKPGTTK | 347 | 0.06 |
| 13 | RVQGASSSA | 259 | 0.06 |
| 14 | LPLQRSAAR | 196 | 0.06 |
| 15 | BFSITVVQK | 127 | 0.06 |
| 16 | YTFSEPPHL | 65 | 0.06 |
| 17 | ITVQELFPA | 163 | 0.045 |
| 18 | YHQMGLLLK | 318 | 0.04 |
| 19 | QVWKQSPQL | 248 | 0.04 |
| 20 | LFSFYKDGR | 206 | 0.04 |

Lyl464 A24 binding peptides

| RANKING | SEQUENCE | STARTING POSITION | THEORETICAL SCORE |
|---|---|---|---|
| 1 | LYHQMGLLL | 317 | 200 |
| 2 | VFEGDLLVL | 89 | 30 |
| 3 | TPYRDGSAL | 111 | 20 |
| 4 | GFQVKAYTF | 59 | 15 |
| 5 | KPVFEGDLL | 87 | 12 |
| 6 | HMQDVRVLL | 327 | 10.08 |
| 7 | GVLWVAQML | 17 | 10.08 |
| 8 | LYLSLGVLW | 12 | 9 |
| 9 | IFQSPGPGI | 146 | 7.5 |
| 10 | APEEAPGPL | 285 | 7.2 |
| 11 | TFSEPPHLI | 66 | 7.2 |
| 12 | HLLMELREL | 337 | 6.6 |
| 13 | MTLSCQTKL | 188 | 6.6 |
| 14 | VLMAWALYL | 6 | 6 |
| 15 | HLIVSYDWL | 72 | 6 |
| 16 | GCVLMAWAL | 4 | 6 |
| 17 | LLGHLLMEL | 334 | 5.28 |
| 18 | VVAITVQEL | 160 | 5.28 |
| 19 | MAWALYLSL | 8 | 4.8 |
| 20 | DVRVLLGHL | 330 | 4.8 |

Lyl464 A68 binding peptides

| RANKING | SEQUENCE | STARTING POSITION | THEORETICAL SCORE |
|---|---|---|---|
| 1 | ELPPAPILR | 167 | 45 |
| 2 | ATEDNQVWK | 243 | 30 |
| 3 | ELRELSGHR | 341 | 22.5 |
| 4 | DVRVLLGHL | 330 | 18 |
| 5 | ALGPPGPNR | 118 | 15 |
| 6 | LPLQRSAAR | 196 | 10 |
| 7 | ETLQCEGPV | 31 | 9 |
| 8 | RVLLGHLLM | 332 | 8 |
| 9 | VVAITVQEL | 160 | 8 |
| 10 | WVAQMLLAA | 20 | 8 |

FIG. 12 (Continued)

| 11 | GVLWVAQML | 17 | 8 |
| 12 | KQSPQLEIR | 251 | 7.5 |
| 13 | PTLNPAPQK | 270 | 6 |
| 14 | AVPSAEPQA | 176 | 6 |
| 15 | ETASVVAIT | 156 | 6 |
| 16 | VVQKADSGH | 132 | 6 |
| 17 | WLILQGPAK | 79 | 6 |
| 18 | LLKHMQDVR | 324 | 5 |
| 19 | CQTKLPLQR | 192 | 5 |
| 20 | RVQGASSSA | 259 | 4 |

Lyl464 B7 binding peptides

| RANKING | SEQUENCE | STARTING POSITION | THEORETICAL SCORE |
|---|---|---|---|
| 1 | DVRVLLGHL | 330 | 200 |
| 2 | KPVFEGDLL | 87 | 80 |
| 3 | APEEAPGPL | 285 | 72 |
| 4 | LQRSAARLL | 198 | 40 |
| 5 | QVWKQSPQL | 248 | 20 |
| 6 | VVAITVQEL | 160 | 20 |
| 7 | IVSYDWLIL | 74 | 20 |
| 8 | GVLWVAQML | 17 | 20 |
| 9 | VLMAWALYL | 6 | 12 |
| 10 | MAWALYLSL | 8 | 12 |
| 11 | ALYLSLGVL | 11 | 12 |
| 12 | HMQDVRVLL | 327 | 6 |
| 13 | APGTAPEEA | 281 | 6 |
| 14 | SPMTLSCQT | 186 | 6 |
| 15 | DAREAGFQV | 54 | 6 |
| 16 | RVLLGHLLM | 332 | 5 |
| 17 | HLLMELREL | 337 | 4 |
| 18 | LLGHLLMEL | 334 | 4 |
| 19 | VLWVAQMLL | 18 | 4 |
| 20 | HLYHQMGLL | 316 | 4 |

Lyl464 B8 binding peptides

| RANKING | SEQUENCE | STARTING POSITION | THEORETICAL SCORE |
|---|---|---|---|
| 1 | DVRVLLGHL | 330 | 8 |
| 2 | DAREAGFQV | 54 | 7.2 |
| 3 | LQRSAARLL | 198 | 1.2 |
| 4 | PSFYKDGRI | 207 | 1 |
| 5 | GCVLMAWAL | 4 | 0.8 |
| 6 | MAWALYLSL | 8 | 0.8 |
| 7 | LLGHLLMEL | 334 | 0.4 |
| 8 | HLYHQMGLL | 316 | 0.4 |
| 9 | VLMAWALYL | 6 | 0.4 |
| 10 | AARLLFSFY | 202 | 0.4 |
| 11 | APILRAVPS | 171 | 0.4 |
| 12 | ALYLSLGVL | 11 | 0.4 |
| 13 | HLIVSYDWL | 72 | 0.4 |
| 14 | LLAASFETL | 25 | 0.4 |
| 15 | VLWVAQMLL | 18 | 0.4 |
| 16 | HMQDVRVLL | 327 | 0.3 |
| 17 | APEEAPGPL | 285 | 0.24 |
| 18 | LSGHRKPGT | 345 | 0.2 |
| 19 | GVLWVAQML | 17 | 0.2 |
| 20 | SSSAAPPTL | 264 | 0.2 |

Lyl464 B27 binding peptides

| RANKING | SEQUENCE | STARTING POSITION | THEORETICAL SCORE |
|---|---|---|---|
| 1 | LRELSGHRK | 342 | 2000 |
| 2 | VRVLLGHLL | 331 | 2000 |
| 3 | ARLLFSFYK | 203 | 2000 |
| 4 | AREAGFQVK | 55 | 2000 |
| 5 | QRSAARLLF | 199 | 1000 |

FIG. 12 (Continued)

| | | | |
|---|---|---|---|
| 6 | GRIVQSRGL | 213 | 600 |
| 7 | NREFSITVV | 125 | 600 |
| 8 | KQSPQLEIR | 251 | 300 |
| 9 | HRKPGTTKA | 348 | 200 |
| 10 | IRVQGASSS | 258 | 200 |
| 11 | CQAWQDWPL | 99 | 200 |
| 12 | LRCQAWQDW | 97 | 200 |
| 13 | HLYHQMGLL | 316 | 150 |
| 14 | ALYLSLGVL | 11 | 150 |
| 15 | VLWVAQMLL | 18 | 150 |
| 16 | CQTKLPLQR | 192 | 100 |
| 17 | VQKADSGHY | 133 | 100 |
| 18 | LQGPAKPVF | 82 | 100 |
| 19 | AQMLLAASF | 22 | 100 |
| 20 | KAYTFSEPF | 63 | 75 |

Ly1464 B35 binding peptides

| RANKING | SEQUENCE | STARTING POSITION | THEORETICAL SCORE |
|---|---|---|---|
| 1 | KPVFEGDLL | 87 | 60 |
| 2 | WPLTQVTFY | 105 | 40 |
| 3 | EPFHLIVSY | 69 | 40 |
| 4 | TPSSEDPGF | 298 | 30 |
| 5 | GPPGPNREF | 120 | 20 |
| 6 | AARLLFSFY | 202 | 18 |
| 7 | QSRGLSSEF | 217 | 15 |
| 8 | APEEAPGPL | 285 | 12 |
| 9 | VQKADSGHY | 133 | 9 |
| 10 | ASEDHSGSY | 230 | 6 |
| 11 | KAYTFSEPF | 63 | 6 |
| 12 | EAGFQVKAY | 57 | 6 |
| 13 | SSSAAPPTL | 264 | 5 |
| 14 | LSCQTKLPL | 190 | 5 |
| 15 | SSCHTEDDL | 44 | 5 |
| 16 | AATEDNQVW | 242 | 4.5 |
| 17 | KPGTTKATA | 350 | 4 |
| 18 | RVLLGHLLM | 332 | 4 |
| 19 | FPAPILRAV | 169 | 4 |
| 20 | DAREAGFQV | 54 | 3.6 |

Ly1464 B44 binding peptides

| RANKING | SEQUENCE | STARTING POSITION | THEORETICAL SCORE |
|---|---|---|---|
| 1 | LEIRVQGAS | 256 | 30 |
| 2 | WPLTQVTFY | 105 | 27 |
| 3 | SEDHSGSYW | 231 | 24 |
| 4 | REAGFQVKA | 56 | 18 |
| 5 | EAGFQVKAY | 57 | 13.5 |
| 6 | LGMPDPHLY | 310 | 12 |
| 7 | SEFQIPTAS | 223 | 12 |
| 8 | AEPQAGSPM | 180 | 12 |
| 9 | QELPPAPIL | 166 | 12 |
| 10 | SEPFHLIVS | 68 | 12 |
| 11 | SAARLLFSF | 201 | 9 |
| 12 | VAITVQELF | 161 | 7.5 |
| 13 | ASEDHSGSY | 230 | 6 |
| 14 | AARLLFSFY | 202 | 6 |
| 15 | DDLTDAREA | 50 | 4.5 |
| 16 | FSITVVQKA | 128 | 3.375 |
| 17 | EPFHLIVSY | 69 | 3 |
| 18 | AQMLLAASF | 22 | 3 |
| 19 | TEDNQVWKQ | 244 | 1.8 |
| 20 | CEGPVCTEE | 35 | 1.8 |

FIG. 12 (Continued)

ANALYSIS RESULTS OF THE PROGRAM TSITES.

..................................

These are the results of the analysis of the file --> LY1464-1.TXT
Beginning with residue: 1 and ending with residue: 359
AMPHI Window size: 11

A - AMPHI mid points of blocks.
R - Residues matching the Rothbard/Taylor motif.
D - Residues matching the IAd motif.
d - Residues matching the IEd motif.

SEQ ID NO: 10,598

```
          5   10  15  20  25  30  35  40  45  50  55  60  65  70  75
         MKLGCVLMAWALYLSLGVLWVAQMLLAASFETLQCEGPVCTEESSCHTEDDLTDAREA
         GFQVKAYTFSEPFHLIV
                                          ...AAAAAAA...
                         ....RRRR.............RRRR........RRRR.....RRRR
                    .....DDDDDD............................
                    ............................................

80  85  90  95  100 105 110 115 120 125 130 135 140 145 150
         SYDWLILQGPAKPVFEGDLLVLRCQAWQDWPLTQVTFYRDGSALGPPGPNREFSITVVQ
         KADSGHYHCSGIFQSP
         .........AA...........AAAAAAAA....................AAAAAAAA
         R...............................................RRRR..
         ...............................................
         ...............................................

155 160 165 170 175 180 185 190 195 200 205 210 215 220 225
         GPGIPETASVVAITVQELFPAPILRAVPSAEPQAGSPMTLSCQTKLPLQRSAARLLFSFYK
         DGRIVQSRGLSSEF
         AAAAAAAAAA........AAAAAAA...................................
         .....RRRR.............RRRRR.....................RRRRR.....RRRR........
         .......DDDDDD.........DDDDDD.................DDDDDD.........DDDDDD..
         ...............................................
```

FIG. 13

```
230 235 240 245 250 255 260 265 270 275 280 285 290 295 300
QIPTASEDHSGSYWCEAATEDNQVWKQSPQLEIRVQGASSSAAPPTLNPAPQKSAAPG
TAPEEAPGPLPPPPTPS
................................................AAAAA............
...............RRRRR................................RRRRR.............
.................................DDDDDDDD.............................
....................................................................

305 310 315 320 325 330 335 340 345 350 355 360 365 370 375
SEDPGFSSPLGMPDPHLYHQMGLLLKHMQDVRVLLGHLLMELRELSGHRKPGTTKATA
E
........AAA............AAAAAAAA.......AAAAAAAAAAAAAA.......
...............RRRR..RRRRR.....RRRRRRRRRR..........RRRR....
............................DDDDDD......................
..................................................
```

FIG. 13 (Continued)

Table 4. Immunogenic portions of Ly1464 (SEQ ID NOs: 10,820-10,842)

```
MKLGCVLMAWALYLSLGVLWVAQMLLAASF
         LGVLWVAQMLLAASFETLQCEGPVCTEESS
                   ETLQCEGPVCTEESSCHTEDDLTDAREAGP

CHTEDDLTDAREAGPQVKAYTFSEPFHLIV
         QVKAYTFSEPFHLIVSYDWLILQGPAKPVF
                   SYDWLILQGPAKPVFEGDLLVLRCQAWQDW
EGDLLVLRCQAWQDWPLTQVTFYRDGSALG
         PLTQVTFYRDGSALGPPGPHREFSITVVQK
                   PPGPHREFSITVVQKADSGHYHCSGIFQSP
ADSGHYHCSGIFQSPGPGIPETASVVAITV
         GPGIPETASVVAITVQELFPAPILRAVPSA
                   QELFPAPILRAVPSAEPQAGSPMTLSCQTK
EPQAGSPMTLSCQTKLPLQRSAARLLFSFY
         LPLQRSAARLLFSFYKDGRIVQSRGLSSEF
                   KDGRIVQSRGLSSEFQIPTASEDHSGSYWC
QIPTASEDHSGSYWCEAATEDNQVWKQSPQ
         EAATEDNQVWKQSPQLEIRVQGASSSAAPP
                   LEIRVQGASSSAAPPTLNPAPQKSAAPGTA
TLNPAPQKSAAPGTAPEEAPGPLPPPPTPS
         PEEAPGPLPPPPTPSSEDPGFSSPLGMPDP
                   SEDPGFSSPLGMPDPHLYHQMGLLLKHMQD

HLYHQMGLLLKHMQDVRVLLGHLLMELREL
         VRVLLGHLLMELRELSGHRKPGTTKATAE
```

FIG. 14

Ra12-LY1464 profile  
CORIXA CORPORATION  
Antigen Discovery

LY1464 and recombinant Ra12-LY1464

Researcher: Alex Gaiger, Aijun Wang, Jonathan Clapper
Reference: cloning bk813 pg150, 151, 154-157; expression bk966 pg2-3
Description: LY1464 is an antigen discovered by Lymphoma program. The full-length sequence was cloned through PCR amplification of normal tissue cDNA known to express the gene. The gene was cloned directly into the pCRX2 vector as an N-terminal Ra12 fusion, Ra12-LY1464, using restriction enzymes Nco I and Xho I, and the sequence was subsequently confirmed. The optimal protein expression conditions were determined by mini-induction screening.

Protein Diagram of Ra12-LY1464

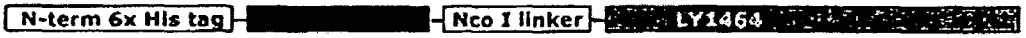

Cloning Strategy:
Tumor and normal tissue derived cDNAs (from Alex Gaiger) were each used separately as templates in PCR amplification reactions with two primers (LY1464-sense and Ly1464-antisense) flanking the 5' and 3' ends of the gene LY1464. As shown below, the primers contained short 5' restriction enzyme recognition sequences. The PCR products were separted on agarose gel and the DNA band of ~1080bp was gel purified. This 'insert' was digested using restriction enzymes Nco I and Xho I and ligated to pCRX2, which was linearized with the same two restriction enzymes and then dephosphorylated. The vector and insert were combined in equi-molar ratios with DNA ligase to create a completed plasmid construct pCRX2 Ra12-LY1464. This ligation mixture was used to transform competent E. coli Novablue cells. Ten individual colonies from both tumor cDNA derived and normal cDNA derived construct were picked for DNA miniprep. Miniprep samples were screened for insert through restriction enzyme digestion (Nco I, Xho I) and five positive samples were sent for DNA sequencing. Miniprep clone #4 (Corixa seq ID#90522) was confirmed and used for expression of recombinant Ra12-LY1464 in E. coli.

Cloning Primers:

LY1464-sense
5' - CGTCCATGGACatgaagctgggctgtgtcctc - 3'   (SEQ ID NO: 10,843)
prime       21bp 57%GC 56C Tm
full length 32bp 59%GC 68C Tm LY1464-antisense
5' - CCTTCTCGAGctattcagcagtagcctttgtggtc - 3'   (SEQ ID NO: 10,844)
prime       25bp 48%GC 58C Tm
full length 35bp 51%GC 67C Tm

Protein Expression:
Various E. coli strain/culture conditions were screened for optimal expression conditions for recombinant protein expression. Briefly, the expression construct was used to transform different expression hosts, and then mini-induction cultures were screened at varied culture temperature, culture media and/or IPTG concentration. The optimal expression condition was determined by evaluating the results of SDS-PAGE and western blot.

For Ra12-LY1464, The most optimal expression condition is pCRX2 Ra12-LY1464 in Tuner (DE3) CodonPlus-RP grown in 2xYS media at 37°C induced with 1.0mM IPTG at 25°C (room temp) for 3hr.

*FIG. 15*

Ra12-LY1464 profile

CORIXA CORPORATION
Antigen Discovery

DNA/Protein Sequence:

LY1464 (DNA) 1080bp (SEQ ID NO: 10, 465)

```
atgaagctgggctgtgtcctcatggcctgggccctctacctttccttggtgtgctctgggtggcccagat
gctactggctgccagttttgagacgctgcagtgtgagggacctgtctgcactgaggagagcagctgccaca
cggaggatgacttgactgatgcaagggaagctggcttccaggtcaaggcctacactttcagtgaacccttc
cacctgattgtgtcctatgactggctgatcctccaaggtccagccaagccagttttgaaggggacctgct
ggttctgcgctgccaggcctggcaagactggccactgactcaggtgaccttctaccgagatggctcagctc
tgggtccccccgggcctaacagggaattctccatcaccgtggtacaaaaggcagacagcgggcactaccac
tgcagtggcatcttccagagccctggtcctgggatcccagaaacagcatctgttgtggctatcacagtcca
agaactgtttccagcgccaattctcagagctgtaccctcagctgaaccccaagcaggaagccccatgaccc
tgagttgtcagacaaagttgcccctgcagaggtcagctgcccgcctcctcttctccttctacaaggatgga
aggatagtgcaaagcagggggctctcctcagaattccagatcccacagcttcagaagatcactccgggtc
atactggtgtgaggcagccactgaggacaaccaagtttggaaacagagccccagctagagatcagagtgc
agggtgcttccagctctgctgcacctcccacattgaatccagctcctcagaaatcagctgctccaggaact
gctcctgaggaggcccctgggcctctgcctccgccgccaacccatcttctgaggatccaggcttttcttc
tcctctggggatgccagatcctcatctgtatcaccagatgggccttcttctcaaacacatgcaggatgtga
gagtcctcctcggtcacctgctcatggagttgagggaattatctggccaccggaagcctgggaccacaaag
gctactgctgaatag
```

Ra12-LY1464 (DNA) 1500bp (SEQ ID NO: 10, 467)

```
atgcatcaccatcaccatcacacggccgcgtccgataacttccagctgtcccagggtgggcagggattcgc
cattccgatcgggcaggcgatgcgatcgcgggccagatcaagcttcccaccgttcatatcgggcctaccg
ccttcctcggcttggtgttgtcgacaacacggcaacggcacgagtccaacgcgtggtcgggagcgct
ccggcggcaagtctcggcatctccaccggcgacgtgatcaccgcggtcgacggcgctccgatcaactcggc
caccgcgatggcggacgcgcttaacgggcatcatcccggtgacgtcatctcggtgacctggcaaaccaagt
cgggcggcacgcgtacagggaacgtgacattggccgagggaccccggccgaattctccatggacatgaag
ctgggctgtgtcctcatggcctgggccctctacctttccttggtgtgctctgggtggcccagatgctact
ggctgccagttttgagacgctgcagtgtgagggacctgtctgcactgaggagagcagctgccacacggagg
atgacttgactgatgcaagggaagctggcttccaggtcaaggcctacactttcagtgaaccttccacctg
attgtgtcctatgactggctgatcctccaaggtccagccaagccagttttgaaggggacctgctggttct
gcgctgccaggcctggcaagactggccactgactcaggtgaccttctaccgagatggctcagctctgggtc
cccccgggcctaacagggaattctccatcaccgtggtacaaaaggcagacagcgggcactaccactgcagt
ggcatcttccagagccctggtcctgggatcccagaaacagcatctgttgtggctatcacagtccaagaact
gtttccagcgccaattctcagagctgtaccctcagctgaaccccaagcaggaagccccatgaccctgagtt
gtcagacaaagttgcccctgcagaggtcagctgcccgcctcctcttctccttctacaaggatggaaggata
gtgcaaagcagggggctctcctcagaattccagatcccacagcttcagaagatcactccgggtcatactg
gtgtgaggcagccactgaggacaaccaagtttggaaacagagccccagctagagatcagagtgcagggtg
cttccagctctgctgcacctcccacattgaatccagctcctcagaaatcagctgctccaggaactgctcct
gaggaggcccctgggcctctgcctccgccgccaacccatcttctgaggatccaggcttttcttctcctct
ggggatgccagatcctcatctgtatcaccagatgggccttcttctcaaacacatgcaggatgtgagagtcc
tcctcggtcacctgctcatggagttgagggaattatctggccaccggaagcctgggaccacaaaggctact
gctgaatag
```

Ra12-LY1464 (protein) (SEQ ID NO: 10, 468)

```
MHHHHHHTAASDNFQLSQGGQGFAIPIGQAMAIAGQIKLPTVHIGPTAFLGLGVVDNNGNGARVQRVVGSA
PAASLGISTGDVITAVDGAPINSATAMADALNGHHPGDVISVTWQTKSGGTRTGNVTLAEGPPAEFSMDMK
LGCVLMAWALYLSLGVLWVAQMLLAASFETLQCEGPVCTEBSSCHTEDDLTDAREAGFQVKAYTFSEPHL
IVSYDWLILQGPAKPVPEGDLLVLRCQAWQDWPLTQVTFYRDGSALGPPGPNREFSITVVQKADSGHYHCS
GIFQSPGPGIPETASVVAITVQELFPAPILRAVPSAEPQAGSPMTLSCQTKLPLQRSAARLLPSFYKDGRI
VQSRGLSSEPQIPTASEDHSGSYWCEAATEDNQVWKQSPQLEIRVQGASSSAAPPTLNPAPQKSAAPGTAP
EEAPGPLPPPPTPSSEDPGFSSPLGMPDPHLYHQMGLLLKHMQDVRVLLGHLLMELRELSGHRKPGTTKAT
AE.
```

Protein Info:  Ra12.LY1464
Molecular Weight 53010.15 Daltons
499 Amino Acids
29 Strongly Basic(+) Amino Acids (K,R)
46 Strongly Acidic(-) Amino Acids (D,E)
174 Hydrophobic Amino Acids (A,I,L,F,W,V)
128 Polar Amino Acids (N,C,Q,S,T,Y)
5.663 Isoelectric Point
-14.119 Charge at PH 7.0

*FIG. 16*

Ly1484. DNA Sequence (SEQ ID NO: 10,846)

```
   1 agcgagactt ccagtccgag gtcctgcttt ctgctatgga actattccac atgacaagtg
  61 gaggtgatgc agcgatgttc agagacggca aagagcctca gccaagtgca gaagctgctg
 121 ctgcccttc tcttgccaac atctcctgct tcacccagaa gctggtggag aagctgtaca
 181 gtgggatgtt ctggcagac cccaggcata tcctcctctt catcctggag cacatcatgg
 241 tggtcattga gactgcctct tctcaaaggg acactgtcct cagcacttta tacagcagtt
 301 taaataaagt cattcttat tgcctatcca agcccagca gtccctctcc gaatgcctcg
 361 gccttctcag catcctgggc tttctgcagg agcactggga tgttgtcttt gccacctaca
 421 attccaacat cagcttcctc ctgtgtctca tgcattgcct tttgctactc aatgagagaa
 481 gttacccaga aggatttgga ttggagccca agcctagaat gtctacttat catcaagtct
 541 tccttttcccc aaatgaagac gtgaaagaaa aaagagaaga cttaccaagt ttgagtgatg
 601 tccaacacaa catccagaag acagtgcaga ctctctggca gcagctggtg gcacaaaggc
 661 agcagaccct ggaggatgcc ttcaagatcg atctctctgt gaaacctgga gagagggaag
 721 tgaagattga agaggtcaca ccgctctggg aggagacgat gctcaaggcc tggcagcatt
 781 acttagcatc tgagaagaag tcactggcaa gtcgttcaaa tgttgcacac cacagcaaag
 841 tcactttgtg gagtggaagc ctgtcctcag ccatgaagct gatgccgggg cggcaggcca
 901 aggaccctga gtgcaagaca gaggattttg tgtcatgtat agagaactac agaagaagag
 961 gacaagagct atatgcatct ttatacaaag accatgtgca aaggcgaaaa tgtggcaaca
1021 tcaaggcagc caacgcctgg gccaggatcc aggagcagct ttttggggag ctgggcttgt
1081 ggagccaggg ggaagaaacc aagccctgtt ccccatggga actcgactgg agagaaggac
1141 cagctcgaat gaggaaacgc atcaaacgct tgtctccttt ggaggccctg agctcaggaa
1201 ggcacaagga aagccaagac aaaaatgatc atatttctca aacaaatgct gaaaaccaag
1261 atgaactgac actgagggag gctgagggcg agccggacga ggtgggggtg gactgcaccc
1321 agctgacctt cttcccagcc ttacacgaaa gtctgcactc agaagacttc ttggaactgt
1381 gtcgggaaag acaagttatt ttacaagagc ttcttgataa agaaaaggtg acgcagaagt
1441 tctccctgt gattgtgcag ggccacctgg tgtcagaagg ggtcctgctt tttggccacc
1501 aacacttcta catctgcgag aacttcacac tgtctcccac gggtgatgtc tactgtaccc
1561 gtcactgctt atccaacatc agcgatccgt tcattttcaa cctgtcagcc aaagacaggt
1621 ccactgacca ttactcgtgc cagtgccaca gctacgctga catgcgggag ctacggcagg
1681 ctcgcttcct cctgcaggac atcgccctgg agatcttctt ccacaatgga tattccaagt
1741 ttcttgtctt ctacaacaat gatcggagta aggcctttaa aagcttctgc tcttttccaac
1801 ccagcctgaa gggggaaagc acctcggagg acaccctcca tctaaggaga tacccggct
1861 ctgacaggat catgctgcag aagtggcaga aaaggggacat cagcaatttt gagtatctca
1921 tgtacctcaa caccgcggct gggagaacct gcaatgacta catgcagtac ccagtgttcc
1981 cctgggtcct cgcagaactac acctcagaga cattgaactt ggcaaatccg aagattttcc
2041 gggatctttc aaagcccatg ggggctcaga ccaaggaaag gaagctgaaa tttatccaga
2101 ggtttaaaga agttgagaaa actgaaggag acatgactgt ccagtgccac tactacaccc
2161 actactcctc ggccatcatc gtggcctcct acctggtccg gatgccaccc ttcacccagg
2221 cctctctgcc tctgcagggc ggaagcttcg acgtggcaga cagaatgttc cacagtgtga
2281 agagcacgtg ggagtcggcc tccagagaga acatgagtga cgtcagggag ctgacccag
2341 agttcttcta cctgcctgag ttcttaacca actgcaacgg ggtagagttc ggctgcatgc
2401 aggacggac tgtgctagga gacgtgcagc tccctccctg ggctgatggg gaccctcgga
2461 aattcatcag cctgcacaga aaggcctgg aaagtgactt tgtcagtgcc aacctccacc
2521 attggataga ccttattttt gggtacaagc agcaggggcc agccgcagtg gatgctgtta
2581 atatcttcca cccctacttc tacggtgaca gaatggacct cagcagcatc actgacccctc
2641 tcatcaaaag caccatcctg gggtttgtca gcaactttgg acaggtgccc acggtgcct aaacagctct
2701 ttaccaaaccc tcacccagcc aggactgcag caggggaagcc tctgcctgga aagatgtct
2761 ccaccccgt gagcctgcct ggccacccac agcccttttt ctacagcctg cagtcgctga
2821 ggcccctccca ggtcacggtc aaagatatgt acctcttttc tctaggctca gagtccccca
2881 aaggggccat tggccacatt gtctctactg agaagaccat tctggctgta gagaggaaca
2941 aagtgctgct gcctcctctc tggaacagga ccttcagctg gggctttgat gacttcagct
3001 gctgcttggg gagctacggc tcgacaagg tcctgatgac attcgagaac ctggctgcct
3061 gggcgcgctg tctgtgcgcc gtgtgccact ccccaacaaac gattgtcacc tctgggacca
3121 gcactgtggt gtgtgtgtgg gagctcagca tgaccaaagg ccgcccgagg ggcttgcgcc
3181 tccggcaggc cttgtatgga cacacacagg ctgtcacgtg cctggcagcg tcagtcacct
3241 tcagcctcct ggtgagcggc tcccaggact gcacctgtat cctgtggggat ctggaccacc
3301 tcacccacgt gaccggcctg cccgcccatc gggaaggcat ctcagccatc accatcagtg
3361 acgtctcagg caccattgtc tcctgtgcgg gagcacactt gtccctgtgg aatgtcaatg
3421 gacagcccct ggccagcatc accacagcct ggggccagga aggagccata acctgttgct
3481 ggcctgatgga gggccagcaa tgggacacaa gccagatcat catcaccggg agtcaagacg
3541 gcatggtccg ggtttggaag actgaggatg tgaagatgtc tgttcctgga cggccagcag
3601 gagaggagcc cctggctcag cctccaagcc caagaggcca caagtgggag aagaacctgg
3661 ccttgagtcg agagctggac gttagcattg ctttgacagg gaagcccagc aaaccagcc
3721 ccgcagtgac tgctctggcc gtgtccagaa accacaccaa actcctggtt ggtgatgaga
3781 gggggagaat attctgctgg tctgcagatg ggtaggaaga gagaggcagc agaggctctg
3841 gcacaacagt gccaggctga gggtggcaga ggtgactggg gcctgagctc tgcctacaga
3901 gtaaacccc aggggcctcct tccccacagt tctcaaggaa gggcctctgg caatcacagc
3961 tctgcagccc aaccctctcc atggccgatg ggacttctat gaaaaggatg agcacacaca
4021 ctcggagggc tgagcagcac gctggaaact gtgacttggt gatgcccagc tgcacacgaa
```

*FIG. 17*

```
4081 attacacatg actcaccta ttaagggcta ttgcactgaa aaaaaaaaaa agatgggtcg
4141 cttactggaa attattgtat tgtctttatt ttattaaagc aactatgttt t
```

Ly1484. Protein sequence (long)  (SEQ ID NO: 10,847)

```
RDFQSEVLLSAMELFHMTSGGDAAMFRDGKEPQPSAEAAAAPSLANISCF
TQKLVEKLYSGMFSADPRHILLPILEHIMVVIETASSQRDTVLSTLYSSL
NKVILYCLSKPQQSLSECLGLLSILGPLQEHWDVVFATYNSNISPLLCLM
HCLLLLNERSYPEGPGLEPKPRMSTYHQVPLSPNEDVKEKREDLPSLSDV
QHNIQKTVQTLWQQLVAQRQQTLEDAPKIDLSVKPGEREVKIEEVTPLWE
ETMLKAWQHYLASEKKSLASRSNVAHHSKVTLWSGSLSSAMKLMPGRQAK
DPECKTEDFVSCIENYRRRGQELYASLYKDHVQRRKCGNIKAANAWARIQ
EQLPGELGLWSQGEETKPCSPWELDWREGPARMRKRIKRLSPLEALSSGR
HKESQDKNDHISQTNAENQDELTLREAEGEPDEVGVDCTQLTFPPALHES
LHSEDFLELCRERQVILQELLDKEKVTQKFSLVIVQGHLVSEGVLLPGHQ
HPYICENFTLSPTGDVYCTRHCLSNISDPPIFNLCSKDRSTDHYSCQCHS
YADMRELRQARFLLQDIALEIPFHNGYSKFLVFYNNDRSKAPKSPCSPQP
SLKGKATSEDTLNLRRYPGSDRIMLQKWQKRDISNFEYLMYLNTAAGRTC
NDYMQYPVFPWVLADYTSETLNLANPKIFRDLSKPMGAQTKERKLKFIQR
FKEVEKTEGDMTVQCHYYTHYSSAIIVASYLVRMPPPTQAFCALQGGSFD
VADRMPHSVKSTWESASRENMSDVRELTPEFPYLPEFLTNCNGVEFGCMQ
DGTVLGDVQLPPWADGDPRKFISLHRKALESDFVSANLHHWIDLIFGYKQ
QGPAAVDAVNIFHPYFYGDRMDLSSITDPLIKSTILGFVSNFGQVPKQLF
TKPHPARTAAGKPLPGKDVSTPVSLPGHPQPPFYSLQSLRPSQVTVKDMY
LFSLGSESPKGAIGHIVSTEKTILAVERNKVLLPPLWNRTFSWGFDDFSC
CLGSYGSDKVLMTFENLAAWGRCLCAVCPSPTTIVTSGTSTVVCVWELSM
TKGRPRGLRLRQALYGHTQAVTCLAASVTPSLLVSGSQDCTCILWDLDHL
THVTRLPAHREGISAITISDVSGTIVSCAGAHLSLWNVNGQPLASITTAW
GPEGAITCCCLMEGPAWDTSQIIITGSQDGMVRVWKTEDVKMSVPGRPAG
EEPLAQPPSPRGHKWEKNLALSRELDVSIALTGKPSKTSPAVTALAVSRN
HTKLLVGDERGRIFCWSADG
```

Ly1484. Protein sequence (short)  (SEQ ID NO: 10,848)

```
MLQKWQKRDISNFEYLMYLNTAAGRTCNDYMQYPVFPWVLADYTSETLNL
ANPKIFRDLSKPMGAQTKERKLKFIQRPKEVEKTEGDMTVQCHYYTHYSS
AIIVASYLVRMPPPTQAFCALQGGSFDVADRMPHSVKSTWESASRENMSD
VRELTPEFPYLPEFLTNCNGVEFGCMQDGTVLGDVQLPPWADGDPRKFIS
LHRKALESDFVSANLHHWIDLIFGYKQQGPAAVDAVNIFHPYFYGDRMDL
SSITDPLIKSTILGFVSNFGQVPKQLFTKPHPARTAAGKPLPGKDVSTPV
SLPGHPQPPFYSLQSLRPSQVTVKDMYLFSLGSESPKGAIGHIVSTEKTI
LAVERNKVLLPPLWNRTFSWGFDDFSCCLGSYGSDKVLMTFENLAAWGRC
LCAVCPSPTTIVTSGTSTVVCVWELSMTKGRPRGLRLRQALYGHTQAVTC
LAASVTPSLLVSGSQDCTCILWDLDHLTHVTRLPAHREGISAITISDVSG
TIVSCAGAHLSLWNVNGQPLASITTAWGPEGAITCCCLMEGPAWDTSQII
ITGSQDGMVRVWKTEDVKMSVPGRPAGEEPLAQPPSPRGHKWEKNLALSR
ELDVSIALTGKPSKTSPAVTALAVSRNHTKLLVGDERGRIFCWSADG
```

*FIG. 17 (Continued)* a. TMpred Report for Ly1484 Long
Date:

RDFQSEVLLSAMELPHMTSGGDAAMFRDGKEPQPSAEAAAAPSLANISCF
TQKLVEKLYSGMFSADPRHILLFILEHIMVVIETASSQRDTVLSTLYSSL
NKVILYCLSKPQQSLSECLGLLSILGFLQEHWDVVFATYNSNISPLLCLM
HCLLLLNERSYPEGFGLEPKPRMSTYHQVFLSPNEDVKEKREDLPSLSDV
QHNIQKTVQTLWQQLVAQRQQTLEDAFKIDLSVKPGEREVKIEEVTPLWE
ETMLKAWQHYLASEKKSLASRSNVAHHSKVTLWSGSLSSAMKLMPGRQAK
DPECKTEDFVSCIENYRRRGQELYASLYKDHVQRRKCGNIKAANAWARIQ
EQLFGELGLWSQGEETKPCSPWELDWREGPARMRKRIKRLSPLEALSSGR
HKESQDKNDHISQTNAENQDELTLREAEGEPDEVGVDCTQLTFFPALHES
LHSEDFLELCRERQVILQELLDKEKVTQKFSLVIVQGHLVSEGVLLPGHQ
HFYICENPTLSPTGDVYCTREHCLSNISDPFIPNLCSKDRSTDHYSCQCHS
YADMRELRQARFLLQDIALEIFFHNGYSKPLVFYNNDRSKAFKSFCSFQP
SLKGKATSEDTLNLRRYPGSDRIMLQKWQKRDISNFEYLMYLNTAAGRTC
NDYMQYPVFPWVLADYTSETLNLANPKIPRDLSKPMGAQTKERKLKPIQR
FKEVEKTEGDMTVQCHYYTHYSSAIIVASYLVRMPPPTQAFCALQGGSFD
VADRMFHSVKSTWESASRENMSDVRELTPEFFYLPEFLTNCNGVEFGCMQ
DGTVLGDVQLPPWADGDPRKFISLHRKALESDFVSANLHHWIDLIFGYKQ
QGPAAVDAVNIFHPYFYGDRMDLSSITDPLIKSTILGFVSNFGQVPKQLF
TKPHPARTAAGKPLPGKDVSTPVSLPGHPQPFFYSLQSLRPSQVTVKDMY
LFSLGSESPKGAIGHIVSTEKTILAVERNKVLLPPLWNRTFSWGFDDFSC
CLGSYGSDKVLMTFENLAAWGRCLCAVCPSPTTIVTSGTSTVVCVWELSM
TKGRPRGLRLRQALYGHTQAVTCLAASVTFSLLVSGSQDCTCILWDLDHL
THVTRLPAHREGISAITISDVSGTIVSCAGAHLSLWNVNGQPLASITTAW
GPEGAITCCCLMEGPAWDTSQIIITGSQDGMVRVWKTEDVKMSVPGRPAG
EEPLAQPPSPRGHKWEKNLALSRELDVSIALTGKPSKTSPAVTALAVSRN
HTKLLVGDERGRIFCWSADG (SEQ ID NO: 10,847)

Black = intracellular, Red = Transmembrane, Blue = Extracellular

Ly1484 Long has 1269 amino acids and 5 Transmembrane Domains
Transmembrane Domain 1: 63 - 84    Score: 1.36675
Transmembrane Domain 2: 118 - 139   Score: 1.38695
Transmembrane Domain 3: 480 - 501   Score: 1.36185
Transmembrane Domain 4: 562 - 583   Score: 1.31785
Transmembrane Domain 5: 725 - 746   Score: 1.3521 b. TMpred Report for Ly1484 (short)

MLQKWQKRDISNFEYLMYLNTAAGRTCNDYMQYPVFPWVLADYTSETLNL
ANPKIPRDLSKPMGAQTKERKLKFIQRFKEVEKTEGDMTVQCHYYTHYSS
AIIVASYLVRMPPPTQAFCALQGGSFDVADRMFHSVKSTWESASRENMSD
VRELTPEFFYLPEFLTNCNGVEFGCMQDGTVLGDVQLPPWADGDPRKFIS
LHRKALESDFVSANLHHWIDLIFGYKQQGPAAVDAVNIFHPYFYGDRMDL
SSITDPLIKSTILGFVSNFGQVPKQLFTKPHPARTAAGKPLPGKDVSTPV
SLPGHPQPFFYSLQSLRPSQVTVKDMYLFSLGSESPKGAIGHIVSTEKTI
LAVERNKVLLPPLWNRTFSWGFDDFSCCLGSYGSDKVLMTFENLAAWGRC
LCAVCPSPTTIVTSGTSTVVCVWELSMTKGRPRGLRLRQALYGHTQAVTC
LAASVTFSLLVSGSQDCTCILWDLDHLTHVTRLPAHREGISAITISDVSG
TIVSCAGAHLSLWNVNGQPLASITTAWGPEGAITCCCLMEGPAWDTSQII
ITGSQDGMVRVWKTEDVKMSVPGRPAGEEPLAQPPSPRGHKWEKNLALSR
ELDVSIALTGKPSKTSPAVTALAVSRNHTKLLVGDERGRIFCWSADG (SEQ ID NO: 10,848)

Black = intracellular, Red = Transmembrane, Blue = Extracellular

*FIG. 18*

```
Ly1484 has 646 amino acids and 1 Transmembrane Domains
Transmembrane Domain 1: 102 - 123    Score: 1.3521
```

*FIG. 18 (Continued)*

Table2a: Ly1484 long MHC class I binding peptides (SEQ ID NOS: 10,849 - 10,908)

HLA A2:

| RANKING | SEQUENCE | STARTING POSITION | THEORETICAL SCORE |
|---|---|---|---|
| 1 | FLLCLMHCL | 145 | 836.3 |
| 2 | YLPEFLTNC | 783 | 818.9 |
| 3 | KLYSGMFSA | 57 | 742.3 |
| 4 | PILEHIMVV | 73 | 629.3 |
| 5 | TLYSSLNKV | 95 | 511.9 |
| 6 | FLQEHWDVV | 127 | 448 |
| 7 | ILWDLDHLT | 1093 | 431.1 |
| 8 | ALQGGSFDV | 743 | 403.4 |
| 9 | HQYPVFPWV | 654 | 400.9 |
| 10 | ALYGHTQAV | 1063 | 222.6 |
| 11 | YLVRMPPFT | 730 | 188.5 |
| 12 | CLMHCLLLL | 148 | 181.8 |
| 13 | GLLSILGFL | 120 | 130 |
| 14 | VLMTFENLA | 1010 | 118.7 |
| 15 | ILAVERNKV | 973 | 118.2 |
| 16 | YLASEKKSL | 260 | 98.27 |
| 17 | ELTPEFPYL | 776 | 97.11 |
| 18 | YLMYLNTAA | 638 | 84.56 |
| 19 | ILLFILEHI | 70 | 73.96 |
| 20 | LLQDIALEI | 563 | 72.72 |

HLA A3

| RANKING | SEQUENCE | STARTING POSITION | THEORETICAL SCORE |
|---|---|---|---|
| 1 | KLMPGRQAK | 292 | 135 |
| 2 | VLLPPLWNR | 981 | 60.75 |
| 3 | CLGSYGSDK | 1001 | 60 |
| 4 | KVILYCLSK | 102 | 54 |
| 5 | CVWELSMTK | 1044 | 30 |
| 6 | LLPGHQHFY | 495 | 30 |
| 7 | PLWEETMLK | 247 | 30 |
| 8 | FLSPHEDVK | 180 | 30 |
| 9 | SLYKDHVQR | 326 | 20 |
| 10 | FLVFYNNDR | 580 | 18 |
| 11 | KLYSGMFSA | 57 | 13.5 |
| 12 | GLRLRQALY | 1057 | 12 |
| 13 | NLANPKIFR | 672 | 12 |
| 14 | RVWKTEDVK | 1183 | 10 |
| 15 | QVPKQLFTK | 894 | 9 |
| 16 | RMPPFTQAF | 733 | 9 |
| 17 | KLKFIQRFK | 694 | 9 |
| 18 | RIMLQKWQK | 622 | 9 |
| 19 | VILQELLDK | 465 | 9 |
| 20 | IMLQKWQKR | 623 | 6 |

HLA A24

| RANKING | SEQUENCE | STARTING POSITION | THEORETICAL SCORE |
|---|---|---|---|
| 1 | QYPVFPWVL | 655 | 300 |
| 2 | FYICENPTL | 502 | 300 |
| 3 | TYNSNISFL | 138 | 300 |
| 4 | NYRRRGQEL | 315 | 264 |
| 5 | DYTSETLNL | 665 | 200 |
| 6 | SYLVRMPPF | 729 | 150 |
| 7 | RYPGSDRIM | 616 | 75 |
| 8 | RFLLQDIAL | 561 | 60 |
| 9 | LYSSLNKVI | 96 | 60 |
| 10 | YYTHYSSAI | 717 | 50 |
| 11 | PFPALHESL | 443 | 36 |
| 12 | NPGQVPKQL | 891 | 28 |
| 13 | SYGSDKVLM | 1004 | 25 |
| 14 | GFDDFSCCL | 994 | 24 |
| 15 | EFFYLPEPL | 780 | 24 |
| 16 | YFYGDRMDL | 865 | 20 |
| 17 | SPCSFQPSL | 594 | 20 |
| 18 | RGLRLRQAL | 1056 | 17.28 |
| 19 | RGQELYASL | 319 | 17.28 |
| 20 | KNLALSREL | 1217 | 15.84 |

FIG. 19

CID1096 Table 2b.Ly1484 short MHC class I binding peptides
A2
(SEQ ID NOs: 10,909 - 10,968)

| RANKING | SEQUENCE | STARTING POSITION | THEORETICAL SCORE |
|---|---|---|---|
| 1 | YLPEFLTNC | 160 | 818.9 |
| 2 | ILWDLDHLT | 470 | 431.1 |
| 3 | ALQGGSPDV | 120 | 403.4 |
| 4 | MQYPVFPWV | 31 | 400.9 |
| 5 | ALYGHTQAV | 440 | 222.6 |
| 6 | YLVRMPPFT | 107 | 188.5 |
| 7 | VLMTFENLA | 387 | 118.7 |
| 8 | ILAVERNKV | 350 | 118.2 |
| 9 | ELTPEFFYL | 153 | 97.11 |
| 10 | YLMYLNTAA | 15 | 84.56 |
| 11 | VLADYTSET | 39 | 51.94 |
| 12 | RMPHSVKST | 131 | 45.8 |
| 13 | SNPEYLNYL | 11 | 26.76 |
| 14 | KVLMTFENL | 386 | 22.54 |
| 15 | LLPPLWNRT | 359 | 21.54 |
| 16 | QLPTKPHPA | 275 | 18.38 |
| 17 | GAHLSLWNV | 507 | 16.66 |
| 18 | WDLDHLTHV | 472 | 16.5 |
| 19 | FISLHRKAL | 198 | 13.51 |
| 20 | CILWDLDHL | 469 | 12.25 |

HLA A3

| RANKING | SEQUENCE | STARTING POSITION | THEORETICAL SCORE |
|---|---|---|---|
| 1 | VLLPPLWNR | 358 | 60.75 |
| 2 | CLGSYGSDK | 378 | 60 |
| 3 | CVWELSHTK | 421 | 30 |
| 4 | GLRLRQALY | 434 | 12 |
| 5 | NLANPKIPR | 49 | 12 |
| 6 | RVWKTEDVK | 560 | 10 |
| 7 | QVPKQLFTK | 271 | 9 |
| 8 | RMPPPTQAF | 110 | 9 |
| 9 | KLKFIQRFK | 71 | 9 |
| 10 | TILGFVSNF | 261 | 4.05 |
| 11 | SLPGHPQPF | 301 | 3 |
| 12 | WIDLIFGYK | 218 | 2.7 |
| 13 | NLHHMIDLI | 214 | 2.7 |
| 14 | YMQYPVFPW | 30 | 2.7 |
| 15 | ELTPEFFYL | 153 | 2.43 |
| 16 | ALYGHTQAV | 440 | 1.5 |
| 17 | YLPEFLTNC | 160 | 1.35 |
| 18 | IIVASYLVR | 102 | 1.2 |
| 19 | DMTVQCHYY | 87 | 1.2 |
| 20 | QLPTKPHPA | 275 | 1 |

HLA A24

| RANKING | SEQUENCE | STARTING POSITION | THEORETICAL SCORE |
|---|---|---|---|
| 1 | QYPVFPWVL | 32 | 300 |
| 2 | DYTSETLNL | 42 | 200 |
| 3 | SYLVRMPPP | 106 | 150 |
| 4 | YYTHYSSAI | 94 | 50 |
| 5 | NPGQVPKQL | 268 | 28 |
| 6 | SYGSDKVLM | 381 | 25 |
| 7 | GFDDFSCCL | 371 | 24 |
| 8 | EFFYLPEFL | 157 | 24 |
| 9 | YFYGDRMDL | 242 | 20 |
| 10 | RGLRLRQAL | 433 | 17.28 |
| 11 | KNLALSREL | 594 | 15.84 |
| 12 | KVLMTFENL | 386 | 14.4 |
| 13 | TFSWGPDDF | 367 | 12 |
| 14 | FYLPEFLTN | 159 | 10.8 |
| 15 | ANPKIPRDL | 51 | 10.08 |
| 16 | SPDVADRMF | 125 | 10 |
| 17 | KTSPAVTAL | 614 | 9.6 |
| 18 | KGRPRGLRL | 429 | 9.6 |
| 19 | RNKVLLPPL | 355 | 9.6 |
| 20 | EYLMYLNTA | 14 | 9 |

FIG. 20

```
ANALYSIS RESULTS OF THE PROGRAM TSITES.

••••••••••••••••••••••••••••••••••••••

These are the results of the analysis of the file --> LY1484-1.TXT
Beginning with residue: 1 and ending with residue: 1270
AMPHI Window size: 11

A - AMPHI mid points of blocks.
R - Residues matching the Rothbard/Taylor motif.
D - Residues matching the IAd motif.
d - Residues matching the IEd motif.
```

(SEQ ID NO: 1984?)

```
         5    10   15   20   25   30   35   40   45   50   55   60   65   70   75
         RDFQSEVLLSAMELFHMTSGGDAAMFRDGKEPQPSAEAAAAPSLANISCFTQKLVEKLYSGMFSADPRHILLFIL
         .........AAAAA......................AAAA.AAA....AAAAAAAAAA................
         .....RRRRR..RRRRRRR......................................RRRRRRRRRRRR.....
         ................................DDDDDD...................................
         ..........................................................................

80   85   90   95  100  105  110  115  120  125  130  135  140  145  150
         EHIMVVIETASSQRDTVLSTLYSSLNKVILYCLSKPQQSLSECLGLLSILGFLQEHMDVVFATYHSNISPLLCLM
         ..............AAAAAAAA........AAAAAAAAAAAAAAAAAAAAAAAA....................
         .......RRRR...RRRRR.......................RRRR..RRRR.....................
         ......DDDDDD.....DDDDDD...................................................
         ..........................................................................

155  160  165  170  175  180  185  190  195  200  205  210  215  220  225
        HCLLLLNERSYPEGFGLEPKPRMSTYHQVFLSPNEDVKEKREDLPSLSDVQHHIQKTVQTLMQQLVAQRQQTLED
        .................................AAAAA.AAAAAAAAAAAA......................
        ...................................RRRR..............................R
        ..........................................................................
        ..........................................................................

230  235  240  245  250  255  260  265  270  275  280  285  290  295  300
        AFKIDLSVKPGEREVKIEEVTPLWEETHKLKAMQHYLASEKKSLASRSNVAHHSKVTLMSGSLSSAMKLMPGRQAK
        ................AAAA...AAAAAAAA..........................AAAAAAAA........
        RRR..................RRRRRRRRRRRRRR...........................RRRRR....
        ...................................ddd.................................
        ..........................................................................

305  310  315  320  325  330  335  340  345  350  355  360  365  370  375
        DPECKTEDFVSCIENYRRRGQELYASLYKDHVQRRKCGNIKAANAWARIQEQLFGELGLWSQGEETKPCSPWELD
        ......AAAAAAA...........AAAAAA.........AAAAAAAAAAAAAA...............AAA...
        .....RRRR...........RRRRR.............RRRR...........RRRR...............
        ..........................................................................
        ..........................................................................

380  385  390  395  400  405  410  415  420  425  430  435  440  445  450
        WREGPARMRKIKRLSPLEALSSGRHKESQDKNDHISQTNAENFQDELTLRRAEGEPDEVGVDCTQLTFFPALHES
        ...AAAAAAAAAAAAAAAAAA................................................AAAA.AAAA.
        ..........RRRR.........................RRRRR.............................
        ..........DDDDDD.........................DDDDDD..........................
        ........dddd..............................................................

455  460  465  470  475  480  485  490  495  500  505  510  515  520  525
        LHSEDPLELCRERQVILQELLDKEKVTQKPSLVIVQGHLVSEGVLLPGHQHFYICENFTLSPTGDVYCTRHCLSN
        ...AAAAA.................................................................AAAA
        ....RRRR..........RRRR..RRRR.........RRRR................................
        ..........................................................................
        ..........................................................................

530  535  540  545  550  555  560  565  570  575  580  585  590  595  600
        ISDPFIFMLCSKDRSTDHYSCQCHSYADMRELRQARPLLQQIALEIPFHMGYSKFLVPYMNDREKAFKSFCSFQP
        A..AAAAAA...............AAAAAAAAAA.................................AAAAAA...
        ........................................RRRRRRRRRRRRRRR.............RRRR......
        ..........................................................................
        ..........................................................................

605  610  615  620  625  630  635  640  645  650  655  660  665  670  675
        SLKGKATSEDTLNLRRYPGSDRIMLQKMQKRDISHFEYLMYLMTAAGRTCMDYMQYPVFPWVLADYTSETLNLAN
        ...........AAAAA.........AAA............AAAAAAAAA.................
        ....RRRR.RRRR........RRRRR..............RRRR.........RRRRRRRR...
        .DDDDDD...................................................................
        ..........................................................................

680  685  690  695  700  705  710  715  720  725  730  735  740  745  750
        PKIPRDLSKPMGAQTKERKLKFIQRFKEVEKTEGDMTVQCHYYTHYSSAIIVASYLVRMPPFTQAFCALQGGSFD
        AAAAAAAAAAAA........AAAAAAAAAA........AAAAA.................................A
        .RRRR...............RRRR.........RRRRR.RRRRR................................R
```

*FIG. 21*

```
                                              ...DDDDDDDDDDD...............
................dddd..................................................
     755  760  765  770  775  780  785  790  795  800  805  810  815  820  825
VADRMFHSVKSTWESASRENMSDVRELTPEFFYLPEFLTNCNGVEFGCMQDGTVLGDVQLPPWADGDPRKFISLH
AAAAAAAAAAAA.AA.AAAA..AAAAAA.........AAAAAA.............AAA..............
RRRRRRR................RRRRR......RRRRR............RRRRR............RRRR..
..........................................................................
..........................................................................
     830  835  840  845  850  855  860  865  870  875  880  885  890  895  900
RKALESDFVSANLHHWIDLIFGYKQQGPAAVDAVNIFHPYPYGDRMDLSSITDPLIKSTILGFVSNFGQVPKQLF
...........AAAAAAAAAA......AAAAAAAAAAAAAA...........AAAAA..AAAAAAAAAAAAAAAAAA
.RRRR.RRRR....RRRRRRRR........RRRR.......................RRRR..........
.....................................................DDDDDD.............
..........................................................................
     905  910  915  920  925  930  935  940  945  950  955  960  965  970  975
TKPHPARTAAGKPLPGKDVSTPVSLPGHPQPFFYSLQSLRPSQVTVKDMYLFSLGSESPKGAIGHIVSTEKTILA
...............AAAAAAAAA..............................AAAAAAA..........
.....RRRRR..................................................RRRRRRRR.......
.....DDDDDD........DDDDDD................................DDDDDD...
..........................................................................
     980  985  990  995 1000 1005 1010 1015 1020 1025 1030 1035 1040 1045 1050
VERNKVLLPPLWNRTFSWGFDDPSCCLGSYGSDKVLMTFENLAAWGRCLCAVCPSPTTIVTSGTSTVVCVWELSM
.................................AAAAAAAAAAAAAAA.........................
.............RRRR..............RRRRR......................................
.........................................DDDDDDDDDD......DDD
..........................................................................
    1055 1060 1065 1070 1075 1080 1085 1090 1095 1100 1105 1110 1115 1120 1125
TKGRPRGLRLRQALYGHTQAVTCLAASVTPSLLVSGSQDCTCILWDLDHLTHVTRLPAHREGISAITISDVSGTI
.............................................AAAAAAAAAA........AAA...AAAA
...............................................RRRRRRR..............RRR
DDD....DDDDDD......DDDDDDDDDDD..............................DDDDDD..DDDDD
.ddddddddddd...............................................................
    1130 1135 1140 1145 1150 1155 1160 1165 1170 1175 1180 1185 1190 1195 1200
VSCAGAHLSLMNVMGQPLASITTAWGPEGAITCCCLMEGPAWDTSQIIITGSQDGMVRVWKTEDVKMSVPGRPAG
A................AAA...............................AAAAAAAA..............
RR........................RRRR...................RRRRRRRR..............
D.............DDDDDDD........................DDDDDD..DDDDDD.....
..........................................................................
    1205 1210 1215 1220 1225 1230 1235 1240 1245 1250 1255 1260 1265 1270 1275
EEPLAQPPSPRGHKWEKNLALSRELDVSIALTGKPSKTSPAVTALAVSRMHHTKLLVGDERGRIPCWSADG
..........................................................RRRRR..........
.................................DDDDDDDD........DDDDDDD..........
............
```

*FIG. 21 (Continued)*

ANALYSIS RESULTS OF THE PROGRAM TSITES.

●●●●●●●●●●●●●●●●●●●●●●●●●●●●●●●●●●●●

These are the results of the analysis of the file --> LY1484-2.TXT
Beginning with residue: 1 and ending with residue: 647
AMPHI Window size: 11

A - AMPHI mid points of blocks.
R - Residues matching the Rothbard/Taylor motif.
D - Residues matching the IAd motif.
d - Residues matching the IEd motif.

SEQ ID NO: 10, 8/48

```
           5    10   15   20   25   30   35   40   45   50   55   60   65   70   75
          MLQKMQKRDISNPEYLMYLNTAAGRTCMDYMQYPVFPMVLADYTSETLNLANPKIFRDLSKPMGAQTKERKLKFI
          .....AAA..............AAAAAAAAAA................AAAAAAAAAAAAA........AAA
          ....................RRRR........RRRRRRRR....RRRR..................RRR
          ..........................................................dddd..

80   85   90   95   100  105  110  115  120  125  130  135  140  145  150
          QRFKEVEKTEGDMTVQCHYYTHYSSAIIVASYLVRMPPFTQAFCALQGGSFDVADRMFHSVKSTNESASREDMSD
          AAAAAAAAA........AAAAA...................AAAAAAAAAAA.AA.AAAA...AA
          R..........RRRRR.RRRRR...................RRRRRRRR..............
          ..................DDDDDDDDDDDD.............................

155  160  165  170  175  180  185  190  195  200  205  210  215  220  225
          VRELTPEPFYLPEPLTNCMGVEFGCMQDGTVLGDVQLPPWADGDPRKPISLHRKALESDFVSANLHHWIDLIPGY
          AAAA......AAAAAA..............AAA................AAAAAAAAAA...
          ..RRRRR.....RRRRR..........RRRRR...........RRRR...RRRR.RRRR....RRRRRRRR 230  235  240  245  250  255  260  265  270  275  280  285  290  295  300
          KQQGPAAVDAVNIPHPYFYGDRMDLSSITDPLIKSTILGFVSNFGQVPKQLPTKPHPARTAAGKPLPGKDVSTPV
          ...AAAAAAAAAAAAA..........AAAAA..AAAAAAAAAAAAAAAAAA............AAAA
          ........RRRR..................RRRR..................RRRRR............
          ................DDDDDD...................DDDDDD.......DDDDD 305  310  315  320  325  330  335  340  345  350  355  360  365  370  375
          SLPGHPQPFFYSLQSLRPSQVTVKDMYLFSLGSESPKGAIGHIVSTEKTILAVERNKVLLPPLWNRTFSWGFDDF
          AAAAA.................AAAAAA.......................
          ..............................RRRRRRRR...............RRRR.....
          D............................DDDDDD................

380  385  390  395  400  405  410  415  420  425  430  435  440  445  450
          SCCLQSYGSDKVLMTPENLAAWGRCLCAVCPSPTTIVTSGTSTVVCVWELSMTKGRPRGLRLRQALYGHTQAVTC
          ................AAAAAAAAAAAAA................................
          ..........RRRRR..................................
          ....................DDDDDDDDDDD......DDDDDD....DDDDDD.......DDD
          ..................................dddddddddd...........

455  460  465  470  475  480  485  490  495  500  505  510  515  520  525
          LAASVTFSLLVSGSQDCTCILNDLDHLTHVTRLPAHREGISAITISDVSGTIVSCAGAHLSLHHVKGQPLASITT
          ................AAAAAAAAAA........AAA..AAAAA....................AAA.
          ................RRRRRRRR...........RRRRR................
          DDDDDDDD...................DDDDDD..DDDDDD...............DDDDDD 530  535  540  545  550  555  560  565  570  575  580  585  590  595  600
          ANGPEGAITCCCLMEGPAMDTSQIIITGSQDGMVRVWKTEDVKMSVPGRPAGEEPLAQPPSPRGHKMEKNLALSR
          ........................AAAAAAAA.......................
          .....RRRR...................RRRRRRRR.......................
          D......................DDDDDD..DDDDDD.................

605  610  615  620  625  630  635  640  645  650  655  660  665  670  675
          ELDVSIALTGKPSKTSPAVTALAVSRNHTKLLVGDERGRIFCWSADG
          ......................RRRRR............
          .DDDDDDDD........DDDDDDD..............
          ................ddddd..............
```

FIG. 22

Ly1456P LifeSeqGold Clone Distribution

Ly1456P LifeSeq Gold Search

| LifeSeq Template | E Value of hit | Length (bp) | Libraries Found in | | Clone Abundance | ORFs * (>50aa) | TMpred ** |
| --- | --- | --- | --- | --- | --- | --- | --- |
| | | | Total # | Hemic & Immune # | Total Clone Count | Hemic & Immune | |
| 238330_1 | 0 | 1442 | 55 | 21 | 78 | 33 | 294bp<br>177bp<br>252bp<br>198bp | No<br>No<br>No<br>No |

\* = Template sequence was searched for ORFs using MapDraw (4 potential ORFs identified).
\*\* = Predicted ORFs were translated and were analyzed for potential TM regions using TMpred.

ORF#1 = 379>672 = 294bp = 98aa
ORF#2 = 555>734 = 177bp = 59aa
ORF#3 = 1037>1291 = 252bp = 84aa
ORF#4 = 1074>1274 = 198bp = 66aa

*FIG. 23*

SEQ ID NO: 10,475

FIG. 24

```
4861 ccgtgagcac cgccacctgt ttcccgcttt cctggccacc gtacatacat ttgttcatgt
4921 ttatagactc tgaatataga gacccacac aagaagagaa aggctcagaa aaacaatgtt
4981 atgacctgct tcctgaggca ccctgcctgc aggaagtgct tttcacagca agaaattctg
5041 actccaggac ccatatttt agcaggaaca tggtcagtca acacacatcc tctaggcctg
5101 ccctggacca gatgaccagg aggaagcagc cgtgagtcac agggagaaag ccggtggctc
5161 tgacagggac gcctgctgct ccgccgggga acagctttcc cctggtttca gttagaaagg
5221 tcaggggacg cctgaccaca caaggctcac gggaactgtg gagggcggcc cctcaggcca
5281 caatcagcag gtgcccacca tggcttctct cctggcaggt gaggacttca gttttttctcc
5341 atggcttggc tcacctgttc tcttattctc agagccataa tcaccctcct cctgccccag
5401 cctggagctc tctgagaccc tccactatag taaccagcac agcctagaga gggtaaatcc
5461 tccggtgccc ccaacatccc accttcatgt tgcagcgagg cccaaaatgt cccagaagaa
5521 aaacaaactc catcgcacac caaaaaccca ccaaaaaacg tgaaatcacc ttcataattt
5581 gggaagtata aacatagttc tatttgttct gtaacgtatt tttcatgatc aggaaatgaa
5641 gacaaagaaa ggctttggga attgttttat ggagaggaca ccatcttcca ggtcctgcca
5701 gctcagggct cccatctttc agcccctcca gagctgagcc cggagggctg gggccgccct
5761 ctccctgctc ctgagccaca gaagcccaag gctggccctg aagacctaac agcctcaggc
5821 atttgcagcc cccttggcct aaaagggctg ttaagagagg tgcagacgtg ggccctgccc
5881 attcaccctc agaggaggtc gcgacttcca ccccagcaag agtaccccta ggactgtgga
5941 gtgcagagga cagcgaccgt tgactaggta cctggtgcag ggtcttgcc tccctccctg
6001 tagcccgata tgggaagggc cacagtccaa gtccatgttc atgctgctcc tccaggaggc
6061 cttcccaaac atcttctcga tgccgagtaa ctcacagatc ccatatagaa atagaccttg
6121 gaagggatct ctcttcttgc aaatgaagaa actgaagacc agagatgtac ctcaaatcac
6181 acagcgagta accggcagag ccaggaggct cctctgcccc caggccagag agggcttgca
6241 atctggcttc cgagcagtgg ttcccaactc ccgggccatt acaatcacct gggatccca
6301 ccagtggaat gactctctgg gggtggtgct tggaaggctg gtggtggtga aagttcccct
6361 ggtgattctc atgcagccag attggagaac cctttagatt caggcatgga ggttccacct
6421 ggttccagat cacatggcca tttggtctca agaaagtcac agccctcctg agtctcactg
6481 gcaaattgct acgtaataac acgcatcttc ttgataagga acgatataa ggatccagac
6541 cctgacctc ctcaggaaaa cagagcacgc attatagat acaatcgaat aggagaagtt
6601 tttcataagc ttggagggct atggttattg gattcaaaag aatagtttc tctcttgtca
6661 cataccaatt tgaaaagtag taatacccat tcttaacag aagtgtattt ggggccagtt
6721 gcggtggctc acacctgtaa catcaatact ttgggaggcc aaggtgggtg gatcacttga
6781 ggtcaggagt ttgagaccag cctgtccatc acagtgaaac tccgtctta ctaaaaaaac
6841 aaaaattagc tgggtgtggt ggcgcatgcc tgtagtccca gctactaggg aggctgaggc
6901 aggagaatca cttaaacctg ggaggtgggg gttgcagtaa gctgagatcg tgccactgca
6961 ctccagcctc ggcgacagga gggcaaccct gtctcaaaaa aaaaaaaaaa aaaaaaagcc
7021 tatttggaat cagtcccctc ccacggggac ctctttcagg aggtcaggcc acagcaccgt
7081 ggcaggcatg tggtagcccc tccataaatg gctgagcgag tgcagttgaa gtgggagtct
7141 ggtgttcttt gaatacatcc tgctgcattg gaagaagcct gtgcaggact agacagttgg
7201 ccttctgtgg caggctcttg cctccaggcc agttgagtga gtgcagatgt cctgagagac
7261 cagcagtgca gccacacccc atgggactgt gaggcgctct cacagtgaag accaagcgca
7321 ggtagcactg gctttgtggt tcggagaaaa gtcgacactc atttccttgg ggaaaaaaag
7381 tatttatcaa aggaagtctt tccctcttgg caaaaaaaac agagacaagt aatttcctcc
7441 agcagtctga gctgggattt gggggcaaat aaccattaaa cagagacacc tgagggtgca
7501 cagatggtca ctgtggcaaa ggtcggctga agaataatag gtaataggga gccactgtgg
7561 gttcttgagt ggaggagggg catgataaag caggggctgga gagcagggg agaacggtag
7621 agcagaatgt cacaaggtgc tggggccctg actccctaag tgcaggaaac tgctgagtct
7681 tgaggtcact tgagcctcct cctgcctctg tgatagctcc cacctgccac ccccacaggc
7741 cacacggtcc aaatgtctca tcaactgcta gcatacgcta agcagaagaa agcgtgtggc
7801 tgtcccattt tttatgcacc aagccgtgag gccagaggca ccaccctct gcttggagga
7861 ttctgagggt ggtggtagtt gtcatctttc cagggaatgt gtggccttct agagcctaat
7921 aatagtgata accataactg ccgcttatgg aggacactca tgagacggta ccgagctcga
7981 attcgaatac atnnnnnnnn nnnnnnnnnn nnnnnnnnnn nnnnnnnnnn nnnnnnnnnn
8041 nnnnnnnnnn nnnnnnnnnn nnnnnnnnnn nnnnnnnnnn nnnnnnnnnn nnacccaagg
8101 gaaaaacagt gtgaagtcca gttttcagcc tgcccaatga agcctgagct acagcaacca
8161 tggtaggatg aggaaccaat gtctgcccat tggcaggagc catagataca aacccaacca
8221 cttgctccaa aaagtgctgc agcttgcggct ttcacactgc actttgcatt ctcctttcag
8281 ctctgttgcg gaggtagccg ctactaagct tactttacca gttactaatg tgccaaaaat
8341 ggatccagcc acattctcca tgagcttccc accccagga agtacccctg ttcagtagac
8401 tccagaagca aaagacacct gccagaatcc gttctcttcc tccacctcc acctcccctt
8461 tgcatgatgg atacctgcac ccttctcgct cctggagtcg gacatatcca aaatcggtca
8521 tttggggtac gggcctaata gaataagctt taatgtaaac ccaagtaaag catgtcttat
8581 gcctcctgtg ccaatgaatt gaggaggcat ctacccaggc gaggctagcc aggtgcccca
8641 cagtaccca cgggccactg tgttcctctt gattagaaaa gttcctaact tattgcaacc
8701 cagggtttac atccccacct gactcaggcc ccttaaggca ggaacccttat cctgtttacc
8761 aacaactctg ggtaatacat agctttgct agtaacaggg gctactaaca gctgggcaca
8821 gtggctcatg cctgtaatcg gagcactttg ggaggccgag gcaggtggat cacctgaggt
8881 caggagttcg agaccagcct ggccaacatg gtgaaacccc atctctacta aaaatacaaa
8941 aataagcggg gtatggtggc gcatgcctgt aattccagct actcaggagg ctgaggcagg
9001 gaggattgct ttaacccggg aggcggaggt tgcagtgagc tgagatcaca tcactgcact
9061 ccagcctggg tgacagagcg gagtctcaaa taacaaaaac aaaaagacac cttagtgtga
9121 atttaagatg aagcactatc tccccaagg atattggctt gagggatgca ggagggtgca
9181 tgaagagaga agtacagggg gctgcaatcg ggacacgggg gacaccaggc tgaaaacagt
9241 acgccttccc tcctcggtaa aggtcagtca acctggtgc tatttccatc ccccacccca
9301 ttcccttttt tttttctttt tccttttcca ttttcaggat ttcatgtca taactggttt
9361 cttgataaca gcaatgtcac atgcctgaaa aaagtaagca cttggtcatt cagagaaaat
9421 tacccaattt ttggtttccc cttgaacttt gttttcctgc tctgatgcca acctctcagc
9481 catgccaccg cccttagtg ccgagatcag aagtgaaaa gaaaggaaaa gcataaaatc
9541 agttggatat tttaaaagg ccaatggcat ctcttagata aatgggttc acggggaaag
9601 agagttagga ggccattaaa tttcttttaac tctccctcac ccatcagcac aagcaaatta
9661 aacaaagaaa aaaaggaagc caccagggca ataaattctt aacacaaacc aaaggcctt
```

*FIG. 24 (Continued)*

```
9721  tctagttgct gtatcccctt tccctaaatg aaaagtatc tcactaaccc tttcttcata
9781  tttttcttca cttactttct tctaatcact ttaggatatt agagctgcta ctccaaagtg
9841  agaaattgca ataaatgtgc ttaggcccac atttacataa acttttcttt ttgggggggt
9901  agagtgtatt attatattca cagtgtaact attgctgttc agggtgact tttcagacac
9961  catgaattca acagcatcct cgaataagca ttttttcttt cccaattgag acaagatttg
10021 gaagttaaca aaccatttaa taatatggct tcattttgtt ggcatggtct cactcactca
10081 cacacacaca cacacaaaaa acagtaggaa aacactttcc atatagtctt gctccccaaa
10141 gggtgatgat tcgggtcagg ggacaccctg taagacaatg cgctgcatgt aacctccatt
10201 tcaagccaaa gccaagacaa tgaagacggc tcccacaggg tgcacacctc cagcaagtga
10261 atacagtagt gcagcagag catggtcgtg gaagttgggg aaaagcgaga aaaccaagtg
10321 ggcaaaatta tgtcattttt gtattttca aaatgaatgt tctttggact tacattagca
10381 gctagaaatg aatgtaaatg ttctttcact tcagcaaggc attcttggaa ggatgtcatc
10441 ccactgttaa taaaaatca ggcggggcac agtggctcat gcctgtaatc ccagcacttt
10501 gagaggccga ggtgggcaga tcacctgagg tcaggagttt gagaacagcc tggacaacat
10561 ggcgaaaccc tgtctctact aaaaatacaa aaaagtagcc gagcatggta gcgggtgcct
10621 gtaatcccag ctacttggga ggctgaggca ggagaatcat ttgaaccagg gaggccgagg
10681 ctgccgtaag ctgagattgc accattgcac tccagcctgg gcaacaagag caaaactctg
10741 tctcaaaaaa aaaaaaaaaa aaaaaaaaaa aaaccacat agagggccac cccctaagaa
10801 aaacttaaaa ccactgattt gtggtcaggt agcaacatca gggtggaaat tttaatgcaa
10861 acatcatatt tgggtacaa aagtaaatta accaagatcc cggagacta tcacattact
10921 aaaaagggca gtgaaaacac attttcttga taaaatatat gacctaattt agccaatata
10981 agcatggtta cattttcctt agtcctactt ctctatcatt tttaagacca tgtgacaggt
11041 gtctcaggtg tcatctcaga tgtgccatgt tatacactgt gttctgtctg cagggcttca
11101 tcatccttcc agaataagtt taatctaaca aaatggactt atgttaacac aaatatcaac
11161 cacaaaacct taaggatgtt gttagctttg gctttttgaa ggaaaattct ccacatttat
11221 gcaactccat tatctacgtg gggagtctc cggagggtct ccaaaagctg accaaaccct
11281 aaagtatttt ttctcctttt aatctgaaat cattcccgaa tatgacaagt caaattatca
11341 cttggttttc cctgaattagg acaaccctgt attataacct tgaccctgac aaggactgct
11401 cggttctaat gcctacactc ccacctcctt ggcagaaagt gccctggcag tattgactgt
11461 aaacagagag gtagaaacaa agggatcttc agtaaaggca ccatctactg tctaaagttg
11521 gaaagcacca atcaacaggt tcttcaggtg gagaggtgga ttagggaaga gctatgagga
11581 cctgagatga gttctagatc aggactgatc ttgagccgtc cgaagagtgg ctggtgggag
11641 caactctcaa agcagaggtt ttcaaacttg cctgcacatt agaatcacct gcggcgtctt
11701 aaaaattcca ttgtccaggc tgcaaccag gcaagccgaa tccagatctc tgggagtggg
11761 acacaggcac cagtattttt taaaactctc cagatgtggg gccaagtttg agaaccaatg
11821 cccgcaaaag cattcccagc gagctttgag caacgttttg agcggcataa gcagagtcgg
11881 gagggcagcg gccttagggt gaagaacaca caaagcaaat atacaaagtt tcaaaaatcc
11941 tgtgtaacta actccaacat gacagccaaac tacctgtcta gaggccaaac agtgatgcaa
12001 cttggaaaag tcccggggag agctagaatg tgtgctccga gtgaggcggg ggctctctcg
12061 gggatgacct ccctgggcgg cgcagtggtc tggaggatcg gggagagaaa ggtcacacgc
12121 cccttttcttt ccaggggatg gtccggccga gcacgccgag gacttgtgta cgacaggata
12181 ggtcagaaac tgcttcgtgt gagtctctcc cagctgtcac tagagccgga gggtccaggc
12241 aggggtgcga aggcagaaag tccctcttca ctaaaggag gttctgcagg gcctcctccc
12301 tcccaccccg ccccgaagcg ggttcccag ggatcgcccg catctgttct gcgcctgccc
12361 tcggcggggc gcggcgcggg agtccgggtc gcatcttcga gcccaggac acgcgcggcg
12421 cgggtcaccg agagtggacg cgcggactga gcacagtgca cctgctgag cccgaacccc
12481 tgggggtccc gccgccctgg gcggccccta gcacccgaa accggctgc cggcgcacac
12541 cccgccccgc tccagcccgg agctcactca ccgccgccgc cgcctcctcc cgcgtccagc
12601 tccgccgca gccagcagag cccggccgga gtgcaaggc cgcggcgccg ccgggaggcc
12661 gagcgagccc gcgcccgcc ccgcagtcgc cgcccgccct cctgggagga ggggcagggg
12721 ctggccgggg gcctggaccc gccggggctg ccggcgggcc caaccctccc ttcaatccgc
12781 ccgcggcccg tgggacgaa cctaccagg aacccccgca ccaccgcc tcggctccgc
12841 tgggccccggg gctgcgctta gacctcaccc cttcccggag ccgttcgtcc ttccacctcc
12901 cctccgccgt cacccggcat ttttcttctc ccagcctcgg cctctccaaa ttcctggcct
12961 gcaggaagcc ctccctattt cgcgctctcg actgcgcga gtcagtttta cccctttccc
13021 ttccttttccc tgcttagcct ttttccccct cactgctcaga aacttaaggg atagcgctct
13081 tctgccaccg caaacccaca cctatttatt gagcacctac tgtgtctaga cactggtggg
13141 gaggttatcc cacttgcgcg gtaacaagaa atgtctgtct ctgttggaga aacagtaaag
13201 tgaggcgcct cgtaaggtca cacagctggc ggtagtaggg ctgggattcg aatacagttt
13261 ttaggtcctt gtttagaccc acccacgat aaactgcggc acgcctctcg ctagctgtga
13321 gaacttgggc aaaatgttat cagttctaaa cccagttca ctcatccgta aaatgaaaag
13381 ctggatactt caccagctat gaggattccc tgagaaaaca acaacctgta ctttttttt
13441 tttttttttt tttttttgga atgggagtctt gctgttttgc ccaggctgga gtgcagtagc
13501 gcgatctcgg ctcattgcct ctgcctcccg ggttcaagcg attctcgtgc ctcagcctcc
13561 cgagtagctg ggactacagg tggccaccac tacgcgcggc taatttttgt gtttttagta
13621 gagacgggt ttcaccacgt tggtcagget ggtctgaact tcctgacctt aagtaatcta
13681 cccgcctcgg cctcccaaag tgctgggatt acagatgtga gccactgcgc cctgccaac
13741 ctgtacttaa tacatgtttg ctgacatatt gaatgaaata gacccttgaa aacttaacaa
13801 ttcaaaacaa tataaaagga cttgaaaaag taataggttg gtgcaaaagt aattgcagtt
13861 ttgctattac tttcaatggg aaaagccaca gttactttg ctccgaccta ataatagtga
13921 ttcattgcca ggaaagaaag aaaaaaaaaa aaagatgcta cttatcccaa gtgggcagca
13981 tggtcaaggg agtcttttg gaggaagcgg tattgcacta tccagagct agcaggtcta
14041 ggttgggaa gacagccaag gtgatgggt gtgtgaacag tgcccagagg gtggaccagc
14101 tttcctgagc agaggctgcc tgggcagga cacacatgct agaaaatggg atgaggcata
14161 ctagaaaggt ggatgggtc agaggtgga aaaggcatca aatgccaaag tgaggggct
14221 caaggcaacc aaacagtact tggacacctc aaaatgacta gaatggaacc tgcatgcaat
14281 agagggcacc taatggccc tggaaccag acggggaga ccatgcct aggaaccagc
14341 agagtcatgg ggtagatggg gagttgcagc agggagggac aggaaagaaa gaatttttcca
14401 actgggtgca gtggcttatg cctgtaatcc caacactttg ggaggccaag gcagtggatc
14461 acctgagcac aggaattcaa gaccagcctg ggcaacatgg cgaaaactgt ctctaccaaa
14521 aaaaaaaga aaagaaaaa gaaaaaaagc gcatacacac acacacacac acacacacac
```

FIG. 24 (Continued)

```
14581 acacacacac acacacacac acacacacac acaaattagc caggcatggt agcatgtgcc
14641 tgtagttcca gctactcagg aggctgaggt gggaggatca actgatcctg ggaggttgag
14701 gttgcagtga gctgtgactg ccccagtgga ctccagcctg ggcaacagaa tgaaattgtc
14761 tcaaaaaaaa gaaagaaaag aaaagaaaga gagaaaggag agaggagggg agggagggag
14821 agaaggaagg aagggaggga gggaaggaag gaaggaagga actaatgaag gaaggaagga
14881 gagagagaag gggaagggaa ggaaaagcag aaggtaagga aaaggggaag ggaagaaaaa
14941 ggggaaggga aggaaaaagg gaagggaagg gaaggaaacg gggaagggag ggaaaaggaa
15001 gggaaggaaa aagggaaggg aagaaaaaga gaaagggagg agggagggaa ggcaggaaaa
15061 ggggaaggga aggagaaggg gaagggaagc acagggaagg aaaaggggaa gggaagggaa
15121 aagggaaggt aagggaaggg aaaagggaag ggaagggctc ttgtttggaa gaccagatgt
15181 cttggtgacc agatgtgtgc aatgagggag tggaactggc aaaggcaaag ctgaggcttc
15241 caggctgggt gccttggagc atcagaaata ggaacaatat ggaaagaggc tgcttttcag
15301 gagagctcct gaaggttcca tggagcatga agtaatggtg gaactttca gtggaaatgc
15361 cccagcaggc agctgggaag tggaggagtg tctctgggca gcatccatgt ggagggtgag
15421 gggagagtga ggaccaggag ccaggaaagg agagtgcagt gccttcactg agggtggagg
15481 aagcagaggg catcacccaa'gggagaaaga ggagggtaac tgagagctgt tgggaagaac
15541 ccaggagtct ttgacggaag cccaagggtg agggactcct gaaggagagg gcagtgccga
15601 atgtcacgaa tccacttctc acgtgggcc ttccaaggat ctgtagagag tgtgcactca
15661 ggaaatattt gttaactgtc aaaaaagcat ttcatcagca atttccctc ccatacagat
15721 attttgctga tgacaaaaat aagaggagtc attggaggta aagacagagg tgagagagat
15781 cagctaccag agatactgct ttcgttgctc ttattgtcaa gatgaatgct caagccccac
15841 caacctcaac ttaaagcaaa cagttccagg gaatgcttct gaaaaacatt tttgtctttt
15901 tttttattta atgtaagtct ggctccctta attatggttt ttgagccagt agaacgatta
15961 aggggaggaa gagcgggtc agtgccagca acttgccaaa gagaagtttc caggaggatg
16021 agtagagaaa aatcacctct ttctcctcc aaattttctg tacataaaat acgtgataca
16081 aaaatattca cataagtgct acagtataaa tgacatttga gtagtgacac agaatatagg
16141 aagggtgaca gaagggaggc tgcagcatgg aataggtctt atggcgtgca cttggaagac
16201 gtaatgcaag gccaggcgtg gtggatcaca cctgtaatcc cagcactttg gaaggccaag
16261 atgggtggat cacttgaggt caggagtttg agattaccct ggccaacatg gtaaaaccct
16321 atctgtacta aaaatacaaa aaaattagcc gggcgtggtg gtgcacgcct gtaatcccag
16381 ctactcggga ggcagagaca ggagaatcac ttgaacccag gaggcggagg ttgcagtgag
16441 ccaagatcac gtgatcgcac tccagcctga gtgacagagt gagacttcat ctcaaaaaaa
16501 aaaaaaaaaa agaaaagaaa aaagaaaaag aagaagatgt aatgcacatg gataacagaa
16561 agagtgcgga gggcatttct ggaaggtgtg gtcatacacc cgagagggg aaacaggagg
16621 aagtgaacaa aacaaaaaat aatacacggt ttatttgatt gaagtggaaa agctattccg
16681 cttgtgaagc aagatgggat tgggaagggc acctgggaag agggcttttg cttggagtca
16741 ttgggaaaca ggctgcctta atacgggttg ccctgaaggg ggagcctgtg acaagacttg
16801 cctgctggtg gtgtatttag ggtgatccct agaagcagga gagaggaagc aggaagagtg
16861 cgacaggcaa ggaggaaagg ccagtattag ggtgtgttaa tgagactggt gctatatgca
16921 gggggcctga ttcccctggg acctcctggg aagatgctga atgccccca gaattgacaa
16981 cctgaagctc aggtagctga agtattttc caagtctcca gcaaagaccg ctcctacatg
17041 ccttaccct acttctaggc tacccacctc ccatgctgag agggctcctt ggaacaaaag
17101 tgctcacttg tgatggaaag ctgtcagcac aaagttgatc tgagcttcca gggagctctc
17161 ccagcaccta tagcttctgc acctcccgtc tgctgcagtg cacatggttt caagctctgc
17221 ccctgctgtg ccaggactcc ttcaggacct ggtgcctaca tcattccaca gccagcagcc
17281 tctcctggca ctatccctct actccaagct gttgtgtggt ggagcaactc taccaaaact
17341 ctgcttcccc ataaacagct ttcccagaa cccagaggt cagattacca gtaggttcca
17401 tgggcatgac gccatagaaa cttctttccc ctccagtgag accagctgt gtcctctcca
17461 acaaggtctg gctctgagca ggagcagagg ggagactaat tccttgggtg ctcaatctca
17521 tttttggact ttgcacactt cccacatgaa gtgaagaatc tcagtcttaa actgttcact
17581 tttcaaagtg ttcactccta caagtgttga gggaagagac ttaatacatc aaacaatcat
17641 attaagtttc cgtttgaact tctagagccc cttgggcagg caaacttgct aggcctacgg
17701 aaaaagaat caaacccctt ggcaagggt ggcaagccct caaatctgg ccctgactgg
17761 cagataagtc aatgagaggg ctatgccct agccagccat ccacactctg ggccttctgc
17821 agctctatta nnnnnncnnn gnnggggnnn ggggggggc gggcggccn ngcccgcgg
17881 gggcggcggc gggcgcggcg gcgggcgcgc gggccccgc cccccgcgcg gggcggggcg
17941 gccgggggcg cccgcccggg cggggccggc ccgcgngccg gccccgcccc gccggccccg
18001 gccccgcggg ggggccccc gggcgcggg gccccgggcc gggcgccccc ccgcgcgggg
18061 gccccgcgcg ncggggcccc ggggggccgg cggcggggg cggcggcgc ccgcgcgggg
18121 ggcggcgggg cgccgggg ggccgccgg gcggggcc nggggggcc ccgccgcgcg
18181 tccgggcgct ttccccctt cccgcttcc cgttcccc cttgttcccg ctttcccg
18241 ccccgccgtt tccgggcnn nnnnnnnnnn nnnnnnnnnn nnnnnnnnnn nnnnnnnnnn
18301 nnnnnnnnnn nnnnnnnnnn nnnnnnnnnn nnnnnnnnnn nnnnnnnnnn nnnnnnnnta
18361 tgatacgaat tcgatctcgg tacccctctta gatgccagcc cctccgtctt gcactttcca
18421 gcctctagaa ttataagaaa taaattcctg ttattcttt ttaattactc agtctcaggt
18481 attctgtcat agcatcagaa tacacactaa gatacctgcc taggccatga ggacccaag
18541 acacagcaca aatttttgtac aaactctaac cagaccacct ttttcctact cccagggtga
18601 ggtccttcct tcccctgtcc cttgcagccc tatgggcttt tttgctttct ctcattctcc
18661 gggccttctg cagctctatt tcctgcaaga ttgcatcttt tctcctggat atttggtcgt
18721 cgctgggctg aggtggcagc ctagtgttgg gagcaggctt ctggctggcc tctgatcagt
18781 aagccagagg ggtcaccttg tcctgaaata caaccagcc attggccatg ttttccacca
18841 tcttatgagt attcccagtg accaccctca gcagttcaag acaagttggg ttacacaaca
18901 aggcagcaca ataatgaagc tcccacccct ggcttgggcc tgggcgttag aaagccctgc
18961 ctgcgggggg ccctctcaca tgcagaaggc aatgggtagt agcttcacca gacgatcctc
19021 tgcctacctg ctccaggtct cccctgggg ccatcccacc tcttcctcat taaagcctgt
19081 gctgaaagga gcggggttgt ttttcaaatt ctttcagcag tgagttattg atcaacactg
19141 atagtgcgag cagcttgatc tcacctgaa ctggcagaga ttaattagct tgattccaa
19201 gcataattcc taattaggca caggaagaaa ggaaagaaa cacaaggaa ctattcttct
19261 ccaggaacca ccgaccttct gtccaggggt ggaggaggaa gaaacaggta agcatgtccc
19321 agcaccagag tgcttcctgc ccattccaaa gctgggcagc cagcccgtca gcacaaacaa
19381 cacggaggac ggtgccagtg ccatcctgca agggtctcag aagaaaatgt gcatttaatt
```

*FIG. 24 (Continued)*

```
19441 tgtttgcttt actctctgcc taatgatggg cagggaaggc acaattaagc aggaggcttt
19501 gaagtacctg ctctaggctt gcttagccac cagaggctga ggatgcagca aggggagagt
19561 tcagctccaa taggctgggg aagaaaggtt ggatggggag ggtgtagtgg ccctgagact
19621 tgagcagaaa tagtgaaagg aaccacttcc tgcagctgag aggcaggagc catcatgttc
19681 tgttgtgggc attttctaga atgttccagc caggaccagc agctcaaatg gctcttccct
19741 ggtggtgggt agggcaatag gagataggag ggaccttcaa tgtggcaact gtgaggtttg
19801 gccaatcaac ttacccatgc tgagcttcgg tttctcttca gtgaaatggg gataattaat
19861 gatcgtatca gcttacatga cggttgtgag aattaactga agaattcaga gatgcatggc
19921 acataggagg cacttcctaa cccacctaaa gaaagcaaac ccacagggca gcaaatcaga
19981 aatggatgag ggctgaccte ctctttattc agtagcacat gtctaataga cccgactgtg
20041 tctcgcacat gctgccctg aggaagactt attataggga gctacaaaca gtgtcacctg
20101 ggaaagacag tgaactcagt tatagaacaa gaacacctgc cgggctgac tgggggccag
20161 gatgcaggga aggctgcctg gaggaagtga catacccctg agtctcaatt ggccagggaa
20221 acaactgagc aatgatttgt gaaaatgagt tcagtagagg ttaataaaaa ttgggagtcc
20281 tggccagtgg ctcacgcctg taatcccagc acttcgggag cccaaggcag gcggatcaca
20341 aggtcaggag ttcgagacca gcctgatcaa catgatgaaa ccctgtctct actaaaaata
20401 caaaaattag ccaggcatgg tggtgcctgc ctgtaatccc agctactcag gaggctgagg
20461 caggagaatc gcttgaaccc aggaggcgga ggttgcagtg agctgagatc atgccgctgc
20521 actccagcct gggcaacaga gcaagactcc gtctaaaaaa aaaaaaaaaa agggaatccc
20581 tgctgtctgc agtaggccaa tcaagtgtcc aagaattgtg agaatgtgct tccccatcac
20641 caccaccagc ccacacccac accaaaatgt gtcacccttc aatcccttca agtctgtctg
20701 ctcagcatcc tgatccaaac aagccacttt aaaagtgca gttatgaaac aattcgaaca
20761 ctgactggac tactgtttat atttttagat gtgatactgt ggttatgttt ctctaaaagt
20821 ccttgtctgt tagagataca cactgaagtg tttacagaga gaatgataca atcgctgtct
20881 ggaatccgct tcaataccat ccattgttgg agggtgggta gtgggttag gggttttga
20941 ggaaacaaga ttggcccggt ctatcagcat tgatgctggg tgagataggt aaatggggt
21001 tcattataca cttttacttt gaaaatgaag tttttcgtaa taaaagttg aaagaaagaa
21061 ggaagggaga tgggaaggca gggaagggaa aaagggaagg agagaaggaa aagattctgc
21121 tcaaatgtcc ctttggaaac cttccttgac cccgcgttg gtgtggggcc ggggggaatgg
21181 ggaggctgtt ttctgctcag ccagagcaac aaggcccatg aggagacagg agggatgtct
21241 ggggagcagt cccaagccac agagtccttc tggggaccag ccacaccatg agagagagca
21301 gaacaggag catagcacag acctatgaca tagcactgtg ccatgacatc agctggcaaa
21361 ggcccatggg accaggaggg aggcattaga agggcgaaca ctagcagctg ttgagtagga
21421 agaaatgtga gccgacttct ctacctaagg aagcggtggc aaggccgtgg aggttcggga
21481 tggggacggg ttccaggatt agagtgcttt ttttttctt tctttctttt gaaggaggag
21541 aggctatggg agcctcaggt accgagcatc tggtgtctgg agagatcag ctactcaagg
21601 cagtttctga tctggaacca ggaagtctct gtttcccgac cagccagcaa acgttctgga
21661 cttggtgctg ggcctgccac caccaaaggt ggagatgccc cacatacctg cgtcaggcat
21721 gacaggtcac ccctgagtcc ttgggtctcc ccaaggcttc tccagggctt cccaacaggg
21781 ctgagattca agaaaacgct caaggtccac cccactgctc cgaccctctc accagaagaa
21841 aagggctgtg tcccaagggc agcctgcttg ggaaaagaat atgtggggtg acttgtccag
21901 atctgcccag ggaggctggg aatggagaga gaaaggaatc tgcccaccag ttggggggaaa
21961 agtggatttc gcaacaacct tcatgatatt aaatgcttgg ggggcctggg aagaccaaat
22021 gtttaatatt tggagaagag gctgtctaaa cagagtaatt agggaggctcc tttgtagtga
22081 tatgaaagag atgaattggg tatatttgac atcaaagaca ggagatccag tggggaatga
22141 gacccacggc cgggcgtggg cagcgctgga ggacaggctc tccagtgtg ctgcggggga
22201 gggcagcccc tgcagtgtgc gtgttgagtg ctgggaaacc cccaagtaac acttcccccc
22261 tcatttaaca cacttcctaa aacctctcct ccccaaactg cactttgcaa aagcagcgat
22321 taccaccaac cacgagaaac acaggagcct gccttccact gtttactact gggcaggaag
22381 tcgtttatgg accagtctct tgcccaggct aaactcagaa gtggacactg agggccggtt
22441 gtgggtgcca ccaggcaagc tagggcatcg gagttcagca gagctgggtg ggaattctgc
22501 ttctccctcc actacctggg taacctggg caagtcactt agcctctccg agcataaact
22561 ggtttgcttg taatatgcaa ataataaggg gtgggggaaa tttttttttt tttttttga
22621 gacagagtct cgctctgtca cccaggctga agtgcagtgg cgtgatcteg gctcattgca
22681 acctccgcct cctgggttca agcaattctc ctgcctcagc ctcctgagta gctgggatta
22741 caggcgccgg ccaccactcc cagctaattt ttgtattttt agtagggacg aggtttcacc
22801 atgttggtca ggctggtctc aaactcctga cctcgtgatc tgccctcctt ggccttccaa
22861 agtgctggga ttacaggcgt gatggagatg atactcccta aatcacaagg gtgtggtgtg
22921 aagatgaaat ggctgcacgt gacagaggag ttgagaacaa ggaagcaagt ggattacttg
22981 gatgaactgt gatgggccca agaagaacta agccaatcac tccagggggc gttttcccag
23041 gatccaggca gagagctgat tccagcatcc acgttgtatc ccctccgc tgtggccggg
23101 gtctccaaga gccgggcacc cactgcagag cttccaagcc caggcccatt tgaacacagg
23161 aggactttg aggttcattt aaccccaaaa tcagtgattc tacatctcaa gctcatattt
23221 tgaagtgttt acgggtaagt catatgatac tggtcattta tttttaaat attctagcca
23281 aagtacatg gtagacaaag tgagaatgtt agaatgttga taattagtga aactagacga
23341 agatacatga aagtttaatt ttgattctca cctactttca tgtgcattag gaaactttca
23401 taataagtta aagtaacaaa ataggccaga ctcggctgct catgcctgca atcccagcac
23461 tttgggcggc taaggcaggc ggattacttg aggtcaggag tttgaaacca gcctggccaa
23521 cgtggtgaaa ccccatctcc cctagaaaat aaaacaaaaa aaaaaattg tagctgggca
23581 tggtggcagg ccctgtaat cccacctact caggagggtg agggaggaga atcgcttgag
23641 cctcagaggc agaggttgca gtgagccaag attgcgccat tgcactccag cctgggtgag
23701 agagcgagac tccatctctg aataaataaa gtaacaaaat acatttcagt ctcgagctcc
23761 agttccctgc caggaagagc tgaagctgag ctctggcacc ccctgcttct tctccctcat
23821 ccctaaaaca tgtgggtac tgggtgccaa aggagatctg aagatggcca ccactcagac
23881 cagcagtaga ggccaagaag gatgtgagaa attttaagat attgtagcat atgctctcca
23941 gggtgaggac acaggatgct gggacctaag gagggagaag ttaacccaga gagggcccaa
24001 gtcagggagg acctgactgt ggtgacagag ccagtcatgc taataatagg agcagtggtt
24061 ttgcaatcac aaatattggt ctgggggact gcgggcccaa tgtggtggga gttttagagc
24121 agggacccct ccactgtacg tggattctta tacttgctaa gttgcactga attctcaatc
24181 aacccatttg gaggctctca ccaagacagg agtccctttg aattggtagg atgttaaaag
24241 cttcctccag ccattgaccc tgggtcccat tggtagaaat cagataataa atcagatttt
```

FIG. 24 (Continued)

```
24301 ccaggtaatc ctcagtttaa tgtccattcc ctcattcaat caattattca attacaaatc
24361 atttttaata tgattttatg gttcaggaat tcaggcaggg ctcagatggg cagttcttct
24421 gccccacatg gcattggctg ataacaggct accccaagga aatcacagtg taatgggaga
24481 tgggaaatag gttaacacaa agttactata ctacaagaaa aatcttcaaa tcttcaatct
24541 tcattcttca tgggtgtgag tcttctctgg tggagaagag agttctttgc taaattatat
24601 tcctgtgtta gccagcaag cacacacgga gtacagctgt cccttgctat tcatggcaga
24661 ttgatcccag acactgccac ccccagccct gtgaacacca aaacccatgg atgctcaagt
24721 ccttgatata aaatggtatg gtatttgcac ataacctaca cacatcttcc catatacttt
24781 aaatcatcac tagattactt ataatacctta atgcaatgta aatgctatgt aagtagttgc
24841 tacgctgtat tgcttaggga ataatgacaa gaaaaaaagg ctgtacaact tcagtacaaa
24901 tgctatcatt catttttta tctgaatatt atgatccatg aatacagagg gctggctgta
24961 aaaagaatgt acagtttggt actttactcc tagtttaagt catctctttc ggcccataca
25021 ggttgcctgg ggcagggcgg tggtgagtgt gttgagtcgg ccctatccc tgttccacaa
25081 tgcctggtgt ccttggcacg tagcttgcag ggctgcttcc atggatggct gcctcatccc
25141 ccaccctcc ttcatggcac cctcttttct ccaactcctt ttcctctgct gagtcctacc
25201 ttttcttgcc agaccaggga tttgccaatt attctggatg ggcacaggga aggggcctc
25261 agatcctgca gagggagcat ctgaaagaca atgagaccct gtacacaacc aagctgagcc
25321 tcctgtaagc acatcctctg ggtgtcacta tgcgaaaaga ctctttgtct gttacattg
25381 cacaacgaat tgtccctctg attgtcctag cgttggtgca tgcatggatc caggaagagc
25441 aggtattgg acccaacgag acaggttcat cttggcagtt tgtctcctgt ggttgctttg
25501 tgcctgcccc gtatctatcc acccaacttc tggcagcaat ccctccagga cccacctctg
25561 tcttcatggt ttgtgtgttc tgatcctgct ccttggcccc agaatacacc ctccacatct
25621 aagctatgca gtgcctcatc cccacagctg cagcgattgg tttaggaatg ggaaaataat
25681 ccaatcaaag taagattgtc taatatctga tcccgcttac cccggagcca gaagtcccac
25741 ctttccaggc tcctccatgt tcctttctgg agcaatgagg aggaaggttc attccctct
25801 cagggaactt gctgcggtgt cccagtcctg actgtcccct ctctaccct gcctgtggct
25861 ctcccgtctc ctggcattct aacctgccac tgaattcttc ccacgccaaa cgcaggttag
25921 gaacctaagc tcggatgaaa tgctggctta gacctcattg ctactgagaa gcagaaacca
25981 cacttttttag ttggtagagg tggatgtgga ttgggccat aaagtttcct caatcattga
26041 ataaggattt cattatttgg actaactaaa tacattagat tatttatact aactaaataa
26101 attagattta tttttcgaag tttaaaatca ttttcaatag tgacgaaaaa ggctgtagat
26161 gagatgggag aatctttcga cgccaaattc ttcccatctc ctgcctagta tgtatcacta
26221 caccttgccc agagagactg tagggtgct cagcaaaaac catggctggt tgattccctg
26281 gaaaaagggg tgctgtccca gggagctctg tgcccttcct gccaacactg gggtctagag
26341 gaggcaagtt cccctctgaa ggtgagtatg attcactcat taaaactaag aaatttacat
26401 tggtatgtta ctgttaacta acctacagac tttttttaga tttcaccgtt ctttacactc
26461 tcgtcctttc caatttccgg gatccaatgc aggataccag gttgcatttt tggatgtgtc
26521 cagtctgtga tcatttctca atcttttcctc attttttgac gactttttgac atttattat
26581 ttatttattg tgtgagactg agtctcactc tgttgcctag gctggagtgc agtggcccca
26641 tcctggctca ctacaatctc cacctccgg gttcaaatga ttctcctgcc tcagcctccc
26701 aagcagctgg gattacaggc gcacaccacc acgcctggct aatttgtatt tttagtagag
26761 atggggtttc accatgttag ccagctggt ctcaaactcc tgacttcagg tgatctgcct
26821 gcctcggcct cccaaagtgc taggattaca ggcgcaggcc accacgccca gcctgacttc
26881 tgacattaga gtacagggag ggattctgta gaatgtccct caatttgggt gtgtctggtg
26941 ttttgccatg agactgggt tatgcttctg ggtgccacac agaggtgaaa tgtccttctc
27001 atcacattat tcgagaggta catggtacca atgggactta tcgctgctga tgttaacctt
27061 gatctcttgg ttcaggtggt gcctgccagc tgtctccact gtggagttac tatttttcct
27121 tttccccatt ttattcatca gaagccagtc actaagcgag gtcaaactcc aggacagggg
27181 aattaagtgc caccttctgg agagggagca ttcacatttta ttacttggga tccttctgta
27241 aggaagagct gtttctcctc taaaaaactc tttaatcctt ttaagcctca atttcttaat
27301 tgtgaaatgg ggctaatacc tgtatccaac caagggagta gttagaaggt aacatgatag
27361 gtggaaagca cttaacatag gcaaaatgtt atgatcagga atgatcgaga gacccatcca
27421 actatctgaa ggagtcactt aactctactg tactgcagcg ctgtaaagtc tgcatctttc
27481 actggggta aaggccccca gtccctgaga cgggccagtt tggagacagg ctggtttttt
27541 ctctgttctc ctgagagccc ttcagatgag aagggaggtc ttcaaactcc tggagacaga atgccaaaag
27601 cccattaaag gcacggcctt gcatttcaga gagggagcag gtctagagaa gaaccagagg
27661 agctcagctg agatatggtg tatggattgg attttggtag aagatgggaa gaaccaaaca
27721 cctgagaaac cactttgaag atcggggtca gagtaaggcc taacacatag ttggctccca
27781 gtaattattg gttgattgaa cagctcaaag agcaactcga ccaagaacac tggactggga
27841 gtccagttac ttggatcttg cattcctgat ttatttttat tttatatgta tttttttctat
27901 ttttttgaga cgaagtctca ctactctgt cgcccaggct ggactacaat ggcacgatct
27961 cggctcactg caaactctgc ctcccaggtt caagcgattc tcctgcctca gcctctcgag
28021 tagctaggat tacaggcatg caccaccacg ctggctaatt tttgtatttt taggagagac
28081 ggggttttgc catgttggcc atgctggtgt ccacctcctg acctcagttg atcttcctgc
28141 ctcagccttc caaatgttg ggattacagg cgtgagccac cgtgcctggc cgtgatttat
28201 ttttttgtg tatgtttgtt tttgtcaact tgctgtgtga cttaagcaa gttacttaac
28261 ttctctgggc ttcacttcc atggatgaac attgtaaaga ggctggagag agatgaggac
28321 taggtacagg ctttagagga gagccaccgc cccggacttc tccctctgtc accccgcttt
28381 ccatgaccct ccttgcctga ctttgtgact ccttgcctcg ctatcaaaac aagtgctgca
28441 atctcagtgc tttccaagag ccctgcattg ttagaaactt cccagcacgc agcaaaggct
28501 gctgcaatac tcgctctgcc tgccttgcc ctgcgcttcc tacttaccct ccttttgttt
28561 ctcccaaaca tctgtccctg actatgctca tctcatgttt gtcctcagct gctgaaaggg
28621 ccacgtttgc tttcattaca aataagacca ccgagtgggc tcctggcgtg ggggcgggag
28681 cagccgcgcg cagtcttcag aggcagcccc ccaggctgtc tctgagggt gtgtctctgc
28741 ttcccttcc ccgtgtttat tttcagacga agccaagtgg cccgggggga ccctccggac
28801 tcccagcctt cagagaggag ggcagctcgg gctttcgccg cagtgcttcc tgcccgtcac
28861 gtgtgtgctc ctagccgggg tcggggagc tggtatcttg gcccttctgg gaggacgcgc
28921 acagcccgag gaggcagagc cccagacggg aatgggcttt tcagaggtgg ggtgcgggcg
28981 aggggacgat gcattatttt taatatttga ttttttttt caactggact tcttcccggg
29041 gctcttcctg ggcccagctg cctttgtgat ccgcgcccc ggtcctcggc ctctcacctc
29101 cagcgccggg gcgcccctg ctgtcggaag cggctgtgac cgggcagagg tgctatctgg
```

*FIG. 24 (Continued)*

```
29161 gactctgggt tctcagcccg gggacagcga accgaggggc agatgatcca tcagaaaaga
29221 gccggcactg cccagcccg cgccectgcc cctgccttt tccgggagcg cgccgcgccg
29281 cacccgctac ggccgcttga ccccatcttt gagcccgcc ccaagctctg ggaccgtcgt
29341 gcccctcatc aaggaagagc caaggacccc aaggagaagg tcaggagcgg cggtgtggat
29401 gtcccttggc tgcaggcccc gccgcgcact cccttcagtc cttccttct ctagggacca
29461 ggtagcatca gtgcctggat ctcggccttg tgtgcctgc tccctgcccc acctactaag
29521 aaccaagtct ggttcacgg ctcccaagag ctggaaccca ttctcagcta gctgggggcc
29581 caggccaccc cttccctcca gacctgtgtg ccttctgccc tggctccagg gccccccaca
29641 ccgtgaccag ggcgggatcc ctatggggct ggccagtcgg caccgtgcca ggcccacagt
29701 gccctgggcg tccatgaag tcgttctgtg tctttaaaat cagaaggaag acattaacct
29761 ttaggctgaa gaaaatgttt tagtacacag caataactta tttgtcttta tccaacagcc
29821 ataaatata actttaaata ttctattgat agagaaagga gttcatgaag gcagaaatgc
29881 ctggggccca cgaacatccc agtgtggccc tggacgggac atcatgctgg gcaacacagc
29941 taaaatgcgg gtgaagacca gatttcttgc acatggcggt gacgggatgc tccctagaga
30001 gcttcaagtg gattcttgc tttttatttt ctctcttaat aaaaatgtat gatgtttaca
30061 ttgtcagaga acaaacagaa ctgtgccttg tgtttcagt cttacgaaat gggtcttgtg
30121 tactttggc tgttcttca tgttcttagc agttatagat ttggcccctc tggaatggag
30181 gggccatata tcaggggtt tggggcaggg gacacggcc tctgttcacc ctgccctccc
30241 tgataggttg atttatctcc ctgcaatccc ttattcgcct tccgggctgg tctccttccc
30301 agtccgagat ctgccccaa ggctttgtt ggcaccgccc caccctgcc ttccccagta
30361 gtctttctac agatcacccc ttccatgtg tcctcagcgc accctgcct tcccaatag
30421 tctttctaca gatcacccct tcccatgtgt cctcagcgca ccctgcctt ccccagtagt
30481 cttctacag atcacccct cccatgtgtc ctcagcgcac ccctgcctc cccaatagtc
30541 tttctacaga tcaccctc ccatgtgtcc tcaacgctgg ccttctcagg agttctagca
30601 cccgtctcca ctgctttagc ctgctaagac tgccataaca aaccaccaca gcttggggga
30661 ttcaaccaca gaaatgtgta tgctcataat tctggaagac agaagtctga gatcaaggtg
30721 tccacagtgc tgatttcttc tgaggccgt ctccttggtt tgtcaagagc ctcttctccc
30781 tgtgtcttca cagggtcttc cctctacgcc tgtcagtgtc ctgatctcct ctcagtcaca
30841 ttgggttagg gatcaccata tgaccttgtt taaccttact cgtgtcttta aagactctat
30901 ctttttttt tttttttt ttgagacagg gtctcactat gttgcctggg
30961 ctggagtgca gtggcgccat ctcagctcac tgcaagcctc tgcctctggg gctcaagcaa
31021 ttgtcctgcc tcagcctcc gagtagctgg gattacaggc gtgcgccacc accctggct
31081 aatttttgt attttagga gagacggcgt ttcaccatgt tggccacgct ggtcttgaac
31141 tcctgacctc aagtgatcca cccgcctcgg cctcccaaag ttcggagatt acaggtgtga
31201 gccaccacgc ccagccgtct ccaaatacaa tcacattgtg cattactaca gttaggattt
31261 caacatgtga atttgagggg gactcaaatc agtccataca cccaccaca cctccactc
31321 cattcacaga aatgattgcc agaactacag accttgagct tgtgtgggg gacaatccga
31381 caagcaacag tgagacagag ctgagagggc tgcagaccag gatggtggga ccgaggttgc
31441 taacaaagcg ctgctgagac ctgcacagca tggaggtgct gctggggag aggggtcccc
31501 gtgagtggat ctgcttggtc tgcccttgca aatagttctt gtcaacggga aggacttaga
31561 gcccctgat ctacactcat ggatactttt ttgaactcaa ggtttacagt agaaaccagc
31621 agcacccat cccctaggc tctctaaccc actgtgtctc taccctgacc ttacctacct
31681 tttttttt tttttttgt gagacagagt ctcgctccat cgcccaggct ggagtgcagt
31741 ggtgcgttnn nnnnnnnnnn nnnnnnnnnn nnnnnnnnnn nnnnnnnnnn nnnnnnnnnn
31801 nnnnnnnnnn nnnnnnnnnn nnnnnnnnnn nnnnnnnnnn nnnnnnnntt ttccagaatg
31861 tcatctagtt ggaatcatac attccgtagc cttttcagat gggcttattt cacttgacaa
31921 taagttcct ccacgtcttg tcatggcttg gtagctcctc tttagtgctg aacaatattt
31981 cgttgcctgg gtgtaccaca gtttatatat ccagtcacct acatcttggt tgcacaagga
32041 catctcggtt gcttccaagt ttcagcaatc atgaataaag ttgctataaa cattcatggg
32101 ogggttttg catggatata agtttttaac ccatttgagt aaataccaag gagtgtgatt
32161 gctggatggg atggtaggag tatgcttagt tttgtgagat acttcccaac tgtcttccac
32221 agtgctgca ttctcatcag caatgaatga gagctcctgt tgcctcacat cctcaccagc
32281 actggatgtt gttggtgttc tggattttgg ctgttctcat aggtgtgcag tggcattggt
32341 gttttaattt gcatttccct gtaacatatg atgtggagca tcttttcatg tttattttgc
32401 atctgtataa cttctttggt gaggcgtcta taaagctctc tggtccactg taaaatcacg
32461 ttgtctgttt tctcattgtt gagttttgt tttgttttg agatggggtc ttgctctgtc
32521 acccaggctg gagtgcagtg gcataatcac agctcgctgc agacttgacc tcctgagctc
32581 aagctatcct cccacctcag cctctcaagt aactgggact acaggcatgc gccaccatgc
32641 cttgctaatt tttattttt tgtagagatg aggtctcctt ctgttgcccg ggctggattc
32701 ttgagttgta agttctctgt atactacgtgt atattactat actggtggac
32761 acatattaga aatgggtgca aacccataga ctacgcaaca ccaagagtga accctaatgt
32821 aaactgagtg acagtggact ctgagtgatt ataacgtgtc agtgtaggtt caccatttgc
32881 aacaaatgta ccgctctggt gggaagtgtta aaatgagggg ctgcgaagca tgcatgggct
32941 cagggaggat gtggggaatc tccgtatttt ctgctcaatt ttactgcgaa tttaaaactg
33001 ctctaaaaaa taaactgtat taaaacagaa aaaataatt taggattaat caacgtgtaa
33061 gttcctggtc attgaagtca gaacctcacc tcatttggaa gcaggaaatc ccttctgtac
33121 tcaccgtgtg catgggacac actgaccaaa agcccctgcc cattggcctt cctgggcctg
33181 aagtggcact tcatgcttgc cctccacttg cctgtcgcca catgcatgcc agggtggcct
33241 cagccctgcc ttacccttg caggcccaga tcagcgggt catccccaga aaggacttgg
33301 tgtcatttct ggaacaagtc atttctgggg gtgccctgc tgtcacttcc ctctgctcca
33361 gggaaccctc tcctaggccc tgccagggtg tgggacttct tgctgacccc agtccttggc
33421 tcatctccct ctttcttctc ccagggtcgt tgaagaggga gcctattcct tccaagcctt
33481 aaagccaccc tccttggctt taagttacag ccaacattct ggcagtcgta ggatccacca
33541 gcagaagcta tgttctcctg cttggtctat gggtgaatct ccgcagggcc ctctgttccc
33601 cactcggtcc ccactgtgag gccccgcctg gcccctctag gttctctgcc cccaactggt
33661 cctgcccact tctgctctct ccttccccttc tcctcaatca tcacgccctt gttctcaggc
33721 ctcactgccc cagcacttag cacagaggat caggaacttc cacagtgatc ctaaatctcc
33781 ctgttctttt taaatttact ttattttta gagcagtgtt gggttcacag tagttttgc
33841 ttccgtcaaa aaatgcttgt tgactcggaa cctcttcctt ggaaatttca actgcaaatc
33901 tgagagctgc tttagagaac cctctgtggg agagtgcctg ccaccgtttg ctccagtttt
33961 ctgtacataa tctatgatcc tcctggcaat cccatgatgt gggcattgtt attcctgcgt
```

FIG. 24 (Continued)

```
34021 tataatcgag gatgttcagg acagagccta tctaggtggg aagtggcatg gccaggatat
34081 gcccctcggg tgccctagga ccagctctgt tcccatctct gagctccctc tgcccatcgg
34141 gtaaggtctg gtcacttcca tactgttttc aatctactct gtgccaggca gggggtcaat
34201 cactgagatt tgtaaggtac atgggtgggg ctggaggtta gaagagagtt ttcaaatcac
34261 tttcagccta gtggggaagg caggcccatc accaaggcag tccaccaaca aggctagagg
34321 gagctgtgct tagcctgagg gaagagcccc attttctgtgg cattatgggt gacattgaa
34381 caactaacca ctcattttcat tacccagggt caaacttcgc cccagggata ttcattagta
34441 agatgaagag gcttactgtt tgctgtggtc ctaatgtctg tgtcccccaa aattcgtatg
34501 ttgaaatctt aaccctcaag tcgatgatat taggaggtag ggttttgggg agaagattgg
34561 gccataagga gtgaagttcc atgaatggga ttaatgccct tatgaaacag gccccagaga
34621 gaaccatcgt ttctttttgcc atgtgaggtt acagtgagaa gtcgctggct aggcgttgat
34681 ggctcttgcc tgtaatccca gcactttggg aggccaaggt gggaggatca cttgaggtca
34741 ggagttcgag accatcctgg gcaacatagg gaaaccacgt ctctacaaaa aacacaaaaa
34801 ttaggccagg cacaatggct cacgcctgtg atcccagcat tttggggaggc tgaggcaggc
34861 agatcacttg aggtcaggag ttcaagacca gcctggccaa cacagtgaaa tcccaactcc
34921 actaaaaata caaaaactag ctggatgtgg tggtgcgcac ttgtagtccc agctacctgg
34981 gaggctgaga caggagaatt gcttgaacct gggaaagcgga ggttgctggg agccgagatc
35041 gtgccactgc actccagcct ggacaacagc atgagactcc atctttaaaa aaaaattagc
35101 ctggtgtggt ggtgtgtgcc tgtaggtcca gctactcaag aggctgggag gattgcttga
35161 gcctaggagt ttgaggttgc agtgaactat gaccgcacca ctgcactcca gcctgggcaa
35221 caaagaaaga ccctgtctct aaaataaaat aataataata ataataataa aagaaaggcc
35281 atttatgacc cagaaatcag gcccttacta gataccagat ctaccagcac cttgatcttg
35341 gacttcccag cctccagaac tgtgagctgt acattttctat tttttaaaag ccaaccagtt
35401 tatggtatttt ttgttatagc agcctgaatg gacacagtta aacctgactc cagaaagtaa
35461 agcaggcccc tgtgaaggaa ggaagaggga ggaaggagga aggaagaagg gggagggagg
35521 aaggaagagg gaaggaggga gaagggcggt ggcctcacac cccacatcct catccgcccc
35581 tggtgggcag cctcccccaag ggattgattc cttcctcagc aacagttgct cagagttgag
35641 cacaggaact tgccttttttc caagtagcag acacaggccg aggcacagag tgggctgag
35701 gaaatgtgcc gtgaatggat ggtgaacagg aagggacact gaagaaggga gcggtactga
35761 gagcagccat cttggagctt ggaaacggag acgcatgtga agccgtttgc acagtatttt
35821 tcccttaaaa tatgggtggg gaacaagggg ctgtcatttg tcttttttctt tgggatggtg
35881 agcagtgagc agggcacgcc gcgaggagca aactgcagcc caagcacacg cggtcagcac
35941 gcggagcaca ggtggggaga agcggctgac ggtggcgtgg cccgcgtac ctgggtgtgg
36001 acgcccgcc gccccgcagg ggaaagctcc tggagtctgg ggtctgctgc cccgagctct
36061 gggtgtccag gtaggaaaca ggtagagagt atcgggtttt cctacctctc ctgcagggg agggcaaacc
36121 gctgtgcctc cccatcctcc tgctcccctc cttccctccc tccgcagggg agggcaaacc
36181 caaccccag gtgagggtct gttctgcggg agtgggaaac agctggcaca ggctcaggcg
36241 gcaggtggtg gccctgctcc tgctgtgaga gatggaagcc aggaggcggc gggcgggccg
36301 tgctcaggag accatgcccc cacccagcct gagactctgt cattcccttc cactgggctc
36361 cccatgagaa gccccaaagc aaagtgggtg tggctggtca gggtgagtag ggcaggccgg
36421 aacggacccg gaccccagaac ggaggagggt ggtgtggacc aggtgggccc gggaaggcac
36481 ctagcctaac aggagaggga caggcgcacc cccagacggt gggaaagcgc cctctgcctc
36541 cagctgggct cggcccagac cctccacttc ccagcccctt gttctctgt gccttggagg
36601 tttcagggtg ggctggtggg tgggaggaca tgtgagagtt cctgtgtcag tgcttgaagc
36661 ccatcttggc cacttgcctg ccggggccct gtagaaaccc ctgaagctat aaacaggtgc
36721 tcgtcaaagt tgattccagg ggagggtggc aggagcagtg gcgggtggtg tgggaagaga
36781 aggactgctc tctagagagc tgatggcacc aggccgtcac caccgtggtg acagcacaca
36841 cacatccaca cacacatgca cacacgcacg cacacacgtg cacacacgac acacatgcac
36901 acacatgcaa gcacacatgc acttgcacgc acacacgtac acgcgcacac gcatgcacgc
36961 acgcacacgc acatgcatga cacacatgca cacacatgca ccccactcct ctactgggac
37021 cagcacagcc cctccgttcc tgctcgccccg gaaggagggc gcccagccag gtttcctccc
37081 catgaattga gcgccagaga ccaacagtga cctgtggtgg ttttttccaat tctcttccca
37141 ttctgtcaag gacagaggag atgctttgtg atacaagggg aaaaaaggga aggtggaaag
37201 ggaagaaagg gaagggaggg aagtccccc cagagcagcc tgggagggg tctgggacca
37261 ggcctaggcc caggcactte ctgaagagat caggtgacgg cctcccggc ctgcagacct
37321 caaggcggcc caggcctcct ctgcgctccc tacgcgttgc tctggtgctg acatccctgg
37381 ctatgctctc catgtagatg ttccttttag cctctgcctc aactgaaatc tgaagatcag
37441 gccaatttcg tggtctctca gacgtcggta aacaagaggc cttggctcct caggagaccg
37501 agagtctctc actgtacttc ctttctcttgg ctccaaggac atagaaacggt tgctatgggg
37561 attccttcat ttgtaaagta agttttcaga aaaaataatg actcacaagt cctttaagca
37621 ggaacaaagt caatccttgg ggacgatatg atctaataggg gtttaaaaga ggaactgtga
37681 cgggctgcag ttggcgggct ttcttctttt tcctctttga tcctcacgcg tggacgaaac
37741 ccaccagtgg ctcaggtgcc ctgcaccac catttgcttc ttttgtgacat ctgaggacag
37801 gtgttaaaaa taacttagaa atggctaact aaggcctgac acactggctc acatctgcaa
37861 tccagcact ttgagaggct gaggtgggag aattacttga acccaggagt ttgagaccag
37921 cctgagtaac gtagtgaaac cttgtttcca caaataatta aacaaaaaaa actagccagg
37981 tgtggtggtg catgcctgta gtcccagcta ctcggaggt tgaggctgga ggatcacttg
38041 agcccaggcg gttgagggtg cagtaagcca tgattgtgcc actgcactcc agcctgggag
38101 acagaatgag atcttctctt agaaaaaaaa agaaagaaaa aagaaaaga aagaaaaga
38161 aaaggtatgt ctagctaggc taacctggag agttactgtc agagtttcca aaagggtctt
38221 catggccact tctgggcctc gctggctggg tgaagttatt agtccaagag tgccacatgg
38281 cctttgcaca ttcatctgta ttatgcctgg cgaggcagag ggctttccct gcattgattc
38341 tcctggaagc ctggggttag cagtatagac tggaaagtaa ggtcacacaga gtgagggac
38401 tgaaccaggt cccccttatat gtgagtacat acagttactt aggccgggaa gccaggtctt
38461 ctaagcagct agggccaaca gagcaggagc caggaggaat acttttatga acaaacttat
38521 tttctaacat cagaaaaaag aaagttggct gttgggagtg acaaggagaa aggaatgatga
38581 ggagctcaaa tcaggtggac acctgattga gatgatcctt cttttgtttta gaaaagagta
38641 ccacactggc tgtcagctgt gtgaccttga gaaagtcact ctctctctca actttctcat
38701 ctgccaggta aaagggctga gcttgaatga gcttgggtcc cttccagcaa tgatgcttgt
38761 gtactgcacc tgtgctagga ataccagtaa ggggctctcc atgctaaaat cagcgttcca
38821 ggattccacg tggcccacag caccaagccc agccttctca gctttgagct gaaggctccg
```

FIG. 24 (Continued)

```
38881 ggtaacctga tcccagccca acggttctgt gttatctccc tctcaccatt tcctgtggat
38941 tacttattgt tctatcctcc cagccgccag ggccttgttc gcacctgcta ccagcaaaga
39001 ataccctcc tacccagtg ccctggcctg aagacgtcct gttagtcttt cagctgtcaa
39061 tgaagatggc cccctttca agaacccttc ctggaatcct gagtttgggg gtcgtgatct
39121 ttccaatccc gtatccacgg tcactgcctt cacctgaatg cgattgcaat tcgctagccc
39181 ttcaattcaa caaatattct ggaatgatta gcgtgtgctg tgacaatgac aaattccgat
39241 acgggaagac atgaattaaa tgatcacgtt cacccacgcg tgattagaaa caggggaaggg
39301 taaagaagga agagaaaacg gcttcctgag agcttgcctg gggtctggaa ggatgaacac
39361 ggagctgggg gcatggaagg gagctgttcc caggagagtt gagtgggctg ggctggcctc
39421 ttgaggctgg gagaggtaga cggtgtgtct tgatcagagg agccatctgg gaatcctttg
39481 agggtttaaa aaggggagta acagaatccaa tttttatttc aggacaatca tgctggctgt
39541 tagtgaagaa tggcctggag cactgggtct ccgccccagc tgcctgggag aaactgtgtt
39601 gaaggagcca taccccctgg cctccctcc agactccaga caacccagt cagctggctg
39661 ggagggaggc agaagagaaa caggggtgca cctggggctc ctgcaggggt ccagccagga
39721 gatgggggca acttggacag ggacggtgag agaggaatgg gctcggggggg catttgggag
39781 atgaaaaggg caaggcttgg ccatgaattc ccatgggatg aagagaagg aattgtcagg
39841 attgagtccc aagttttctag ctcatgcaaa taaacaaacg gggcatccgc tgagctcaag
39901 agcatgggga aggggtgttg gagactctcc cgggggaccc tgcagacttc tgtaaccct
39961 ttgagttctc gcaggcagag gccacggtgg gtggggagca ggccttggca gggtacccgc
40021 cccccaccag gcacctcca tcctagtagc ccttggggag acatactgtg gccagaggaa
40081 gggtacggag aggtagagga agccaaccgg tgttcccggg cagccaccat gtggtcaaag
40141 gaccaggcag cttgtttgga agcgtctctg aggcacaaag tgccaggacc cagtgctccc
40201 tgagccctcc cagcaggaaa atgaaactc agcaatgggc tcccagggag gcgggactgg
40261 gggtgccttc cattatgag aggccgcag agcaattcct gccgcagggg tttctgatca
40321 gtcagaacat ctgcccacgt tgatgtcttc cagccacctg atgcagtggc ttgggcctgt
40381 gggtggggg gagtgggatc ttaggcctgt tttttgggtt aataaatttt gtgaccttgg
40441 atgacatgtc acttatctca cagatcctgg gaagggcagg aggaggagtg agacctggcc
40501 tgccctctcc ctagaggctc atcagctccc tggagacaga cacgccctgg gtaaagaaca
40561 gatcccactc agccaggcag agtttcctgg aggaggagga gggagagaaa gagggcagga
40621 agaagagggg agggtgcaga gggggagaaa gaaaggaggg gaggaggtga agagaaaagg
40681 gaggaggaga aaggaaaagg agaaaacctg ttttctgtct ttaactgtcc ttccctcaa
40741 ctgggaccct gtgctcctcc tcctcagtca gaactcccc ctcaggtccc cccacttcac
40801 gtccctccac acttcctgtc cctcccccac tcatgtccct ctcccttat gtccctcccc
40861 ctattgtgtc cctcctcccc ttgtgtccct cctcccttg tgtccctccc cctctcaggt
40921 ccctcccct cctcatgtcc ctccccatct caggtccctc ccctcctcat gtccctcccc
40981 atcacaggtc cctccctcc tcatgtccct cccatctca ggtccctccc cgcctgtgt
41041 cttcctcccc ctcaggtccc tcccaacctc ctatccctcc tcagcttgtg ttcccccacc
41101 cctgtgtccc tcaccccctc atgtccctct cccctcaggt cctcccct ctcaggtccc
41161 tcctatcctc gtgtccctcc ctccctcagg tccctccccc actcaggttc ctccctcct
41221 cctgtccctc cccgctcag gtccctcctc ccctcacatt cttctgtctt catttacagg
41281 caggagaaat ttcaaagtgt gttttgtacca caattacttt aaaactctaa agttgacctt
41341 taacggtttg tggatgtttt aatttactt ttacgtgata acctgcaata actacacaga
41401 tgcatgcatt tttgtgctta tttgtaagtg cttttcttaa aactgctttt ttcttacatc
41461 ctttcagttc ctttccctat gcctggagcc tgggtaccag ctattgaaaa ctgcttttct
41521 ccttgttcat tcaaacatat tcacacataa aggttgtcat tcctttttgt cactatttga
41581 caaaaattgg atcataccgt atacaattct ctgctatttg ttttgctcac ctaacaataa
41641 atacactgtg aaaaatacct tcagatgagt agatatcaat cttgttcatt cttttttttt
41701 tttttttttg agacagggtc tcactccctt gcccaggttg gagtgcagtg gttcagtcac
41761 agctcactgc agcctcgcct cccaggctca atcgatcctt tcacctcagc ctctcgagta
41821 gatggaacta caggcatgca ccactgaacc tggcgaattt tcatattctt tgtagagat
41881 ggggtttttga catgttgcct aggctggtct taaattccta agctcaagag atccgcctac
41941 ttcagcctcc gaaagtgctg ggattacagg cctgggccac cttgcctgc ctcttactca
42001 ttttttatt ccaggttgca gggttttatt tcagcaacac agagacagtc aagcacagcc
42061 atacagcagg ggcatccaca gctgcctcag gaggcggcag cgtggcctct tttgcagctt
42121 ttctctcttc cagcatcctc tgcttgtgtt tggccggca cttcctggca gaatggtggg
42181 ccccaggtc ctgatagcgg tcctggtaag ccttggccac ctgggtgaa ctccactc
42241 cttggccag ttctacctgt agttgtcttc ttcccactac tgacaggtct tgagccgctc
42301 ctggataata ttgacgattt cttgatcgac tttgtagtcc ctcctccact gcatttcggc
42361 ttcatatatg cacagtgttt cacgtgtcca tgtgaagaca cgtgagacca ccaagcaggc
42421 tttgtgtgag caacaagcct gtttatttca cctgggcgca ggggctgag tcctaaaaga
42481 aagccagcaa agggtggtgg attatcatta gttcttacag gttttgggat aggcggtgga
42541 gtttggagcg atgttttgct ggcagggggct ggatctcaca aagtacattc tcaagggtgg
42601 ggagagaatt gcaagaaacc ttcttcaggg tggggagat tacaaagtac attgatcagt
42661 tagggtgggg cagaaacaaa tcacaatggt ggagtgtcat cagttaaggc tatttttcact
42721 tcttttgtgg atctttagtt gcttcaggcc atctggatgt gtacgtgcca gtcacaggg
42781 atatgatggc tcagcttggg ctcagaggcc tgacacacaa gatgttcttc tccttgcgct
42841 cagtgatgcc cagcacgcgg cagtactgcc ggtggtagta gtaatacctg ttctttgcgt
42901 gctgccactc tataaactct cacgagggtc gccgatcggt ccactaggag gtcgaaggcc
42961 ttcatcaggt agacgacggg gttggcagc caagtctgcg atgacagtgc tggcatgtgg
43021 cgcggggggcg cagggtacac atccttgtct caoctgtccc acatggcagc agtgagcgcg
43081 gacttcgctc ctggatgcgc tgccctggcc tccacctcgg tcccggtccc tactgattct
43141 ttgtaatggt tgtgtaatat tacatggtgt ggacttaata aaggacccct acgcagccaa
43201 gagagttttt ttccccaatg ggaaaacaga tttttttttt ttaatgtttg agatttttagt
43261 gaattatttt tacctggcaa gggagctgaac tacctgtact gttcagaagc caagttcagc
43321 agtcttgtat gtgggatgtc tgtaaagatt aagaaagggg gcgggcgtgg tggttcatgc
43381 ctgtaatccc agcacttttg gaggccgagg tgggtggatc acgaggtcag gagttcgaga
43441 ccagcctggc caacaaaggg aaaccccccgt ctctactaaa aatacaaaaa ctatccgtgc
43501 gaggtggtgg gtgcctgtaa tcccagctac tgggaggct gaggcaggag aattgcttga
43561 acccgggagg tggaggctac agtaagcaa gatcgtgcca ctgcactcca gcctggcgac
43621 aaagcaagag tctctctcaa aaaaaaaaaa aaaaaaaaa aaaagaata agaaatggac
43681 tctgccccaa ggagtctgtg ctcttaccag ggggcagagc cacacgtggc catgagacag
```

FIG. 24 (Continued)

```
43741 ctgccctgg cagctgcacg gaggagagct tgaccgagca tgcgggaggg agggcttgag
43801 gctggcccgc tgggagggga cagctctggc aggaatcctg gaagggcagg tgtggagtca
43861 gacatgatct gatgttctgt gtggccaagg cagaaggcca ggcaggaaaa acccggttac
43921 taagaagatc ggttgagcag ccatctccct cccactgacc gcccccccagg aatctgtata
43981 acttcagctt attttcagcc tttagtttcc cctcgttgga ggttgagtgc ctggtctctt
44041 gattttctaa ctgaagaagg gatgaaagtc tgagattca atcaaaagct taagaaaata
44101 ataatccttg gttggcccaa ttcttcctg aaaatacctc acactaagag aaattgcctt
44161 taagcccctt ttctttctt tcatgcttta aattctttc ttaattaaaa agagttgttt
44221 acttgatgtg ggctccaaag tgcttattta ttttaacgta tcttgtttct ttttcctta
44281 tcttcatgac ttgataactc tataactctc tcttcttgtg tcttaaaatg ccggtcgtgt
44341 ctgtcactga catgtgataa ggaacttcat aatcagccct tttctattct cacagaatag
44401 aagttgtgtc aataacaaat ggaaatcact gagctccaaa attcagctgc cctaacctgg
44461 ctgcttgtcc ctatcagaga ttttagaatg ttttcccctt cagatgaatt tcagtttcac
44521 tcaatcctac cagtgtttga tgacaacact catggaaaac taatggtaaa ttaatgtctg
44581 ccttccaaag tacgtggttc agttcactgt gtaaaaaaat aatgataata atactaaagg
44641 cagccaaact gctgattggc agaattttt cccatcactt aaggcatttg agttgcagta
44701 cgcagtctga gaatccctca gagacacacc acccagggac ttggatcctt gatctcagaa
44761 agattgtgat cgaattaagt ctgactcaac aaataaggtc gctgggaaga agtgctggca
44821 ttaaatttac cgttaacgcc agggtcaatt tactaaacag tcatcgacgt gtggttccac
44881 aagacctctg ggtaaattcc agaaactgac tgggaggaag atagcttgcg catgaagtca
44941 ctgaatcctg gtcagtgtga ctcttgatga tcatctctca gtacaccaga aagcatttcc
45001 aaagacagga cgccacttgg cgtgaaaagc ctttggaagc tatggaaggt gacttcttaa
45061 gttaagtcta gaaacgggat ggcaggagga caagaaactg ggactctggt gcgggagcc
45121 tggagtcctc attccactac agatgttaac tgggcttcgc tattcaggtc actcagtggt
45181 tcatcttaga gttgtttcta gactagatat ttattgccct gcattacaaa gacgggaaag
45241 taagagttct gtccatcagc cagttgtcag gcgtaaatga cgtctttccc tcgcttcctg
45301 cgccgcagtt tgcttatctg tcagatggag acgctactta cttacttatc tactcatcac
45361 ctccaggact attcacatga ataagaagag aatatagata tgaatttggc atacagaggg
45421 aaaagttcca cacaaataga aaacactagc ggaaataatt tctagattct tcctggtgaa
45481 gcttttcaac tacttccaaa acacatcatt gctgagcctg tgcaaattca aatggcacaa
45541 cccgaagagt cagtggcatg gcctcttctc tggccagac cttggggggcc atcagcctgc
45601 acctgcctgt tgttctgcc attgcctcat gttctcttcc tcagacaccg gggaagccag
45661 gatcacagag gcacttgtca gcttccttct gaaacagccc tcctcagctt ctctgctgtg
45721 tctcccgggt cttctcacag aattcttggc cgggaagcca ccttccttaa aggaaatcaa
45781 gtctcccgat ttcctagagc cagagtagca tagggggcag ctgtggggct tggagccaga
45841 cagagcctta ttaattatcc atggatcttg ctgagccttg gtttctcatc tgtaaaatga
45901 gggtaataaa gctactttcc tggtcatcta tgagtttgaa ataaaagaat atgggggcca
45961 ggtgcagtgg ctcttgcctt taatcccagc actttgggag gctgaggcag gtggattacc
46021 tgaggtcagg agttcaagac caccctggcc aacatagtga aaccctgtct ctactaaaaa
46081 tacaaaaatt agccaagtat ggtggagggt gcctgtaatc ccagctacac gggagactga
46141 gtcaggagaa tcacttgaac acaggaggtg gaggttgcag tgagctgaga tggcgccact
46201 gcacttcaac ctcattgaca gagcaagact ccatctcaaa atgaagacaa aaacaaagaa
46261 gagtatgggt gaaagggcct ggtgtgtcac gggagttgaa tgtgtgtcct tttccttttt
46321 ccccctgttcc ttccctgtgc agctgcctac caggcactgt ctcctctctc tcggggaggc
46381 gctgcatttt ttccctgcaa aggaggtcca gaaagcagac ccagcccaat gtctgtgcat
46441 ctgcctggag aaggcctcct gaggagcaca ccaacactct ccccttccat gttggccttc
46501 tctgcactat tcaggttctt gcctctttgg aattgtgtgt atgtggaggg aacatctgga
46561 ggtgtcactt aatttttcat gttacatctg gacctgtcac atagccacaa ccgtaactgt
46621 acatggagaa tcatgctcgtg tgtgctgtgg acaagccaag aggtggcttt gtgtgctctt
46681 ctgccacaca gaagagctgg gtgctgccca gcgcgggtgc tgggtgaccc cggaggaaag
46741 agtcattccg agggcctgaa gaaggagga atcggtggct tgtaaggtgc actcccactt
46801 cctgtggttt tcacaggcga tgacatgagg actggagatg aaatgaagca aaacctctg
46861 gggtcacttg agctatttct tttgagtcca cgtctctggg atggcatggc ctgtcagcca
46921 caccgtttc tctcctgttg gcagctccat tctgcagggg agcaagtgtc cagtcctggg
46981 agcactggca gcagggatgc tcggaatgcc caacctgtcc tggggcctgc cttgcctct
47041 gcccctcagc tgccttgcca tctctcttcc tcctcttat ttttgtctgt ccctatggct
47101 gtcagtgggg tcttgagtca cctatgtcat catatcagga acattgtgtg ttccaaagtg
47161 tgcttggtgg aacacttgtt acttgaaaca gtgctttgta aaatggatcc tggggctagc
47221 agctggagat gccgcatcct ctatctcctt ctcgtggatt tgcaattcag attctctcta
47281 ttaaccctga agaatcccat aataaatggt ttaattttgc ttagtagttt cgcccaaacg
47341 ttttgatca cggatccttt cgtatgaact cccaagaaac acttattagc agtgtttggt
47401 gaatcacact ctgggtaaag cgggcatgaa caacatatta ttcgtaggaa tgctgtgacg
47461 tcaaactcac cagtgaaaaa tctggcatca gagggttatg gaaaaatgcg tgtgcttttt
47521 ttttttaata caaatatgac attggtgcag atcagacgtt cccaccccctc tcaccacaaa
47581 aagaaccttt ttagtccttt cctcaaggga ttccatgttt taaaggcttt taactaccta
47641 acaaactaca atttattgaa taataattta tttctttgag ttttatttat caaagacatc
47701 caacggccaa ttagggcttc tgatcagtcg agataaccat agttgccaca ctgagttgat
47761 atgactccag cccaaagcaa ataaacttaa tgttttattt agtctgggaa cgtcattgag
47821 gtaaatgtat ggtttcctct gggcttttttg atatcttgaa aatagcttgc agacccccct
47881 tgctgccttc atggagtgca ggataggtgg gaagcaggac catgaatgga aatgcagagg
47941 acgcacagct gttaggagg cgggagggac ggggggaggg ggtggtgact ggggctacac
48001 caggacactg gatagtagag actaagtggc cacagccact gtgaagactg ggggtccatg
48061 ggttggggtg tccagatcct ggtgaacaag caagaagcca ctagccaaag gcacattcat
48121 ggtgcaccct taatgtgggc aaaacctggg cacagcacct tccctctgta cgctggctgc
48181 attgcaccca cccttccccc agcacccaga agaggcccag ggaggaggac agggcaaagg
48241 ggagtgaggc aggcttcttt gacgggatac tttcccccaga cctccctgat gcatttttca
48301 atcacgagct actatgaggt ggatgtattg ccatggccac cttcagtgtc agtagagccc
48361 ctggagatt aaggccctg aggattctgc ggtcggcttg ctcctcacct cgaaggagag
48421 acctctgccc agggagctca tccttgctta gcagaaccgt tgccactgtt catatggaaa
48481 ggatgaggca ctagaccac attcaggtc atcagcagt tctgtctcag atgatggaga
48541 gccatgcgct ccctaaatag aggttttcct ggtgcattgg agatgggatt cgacatcctg
```

*FIG. 24 (Continued)*

```
48601 taatccactt tccacctgac tttacagaag agctgttact cgaagtaaga gagagggctc
48661 ctccgcagga gaaaagtgct caggccatgc cctttgcagc cccattcagc ctccatgggc
48721 tgggtcctaa gccoctcctg gaccccagt tactctcaca gccccagacc cctgcttagc
48781 aatggccttg aactaaaacg catgatccta cttttttgcct cccctccctc attagtcagg
48841 acagcatttt cccaaaagat acaatctgtg tctggcggaa gcctacttgc aaaaataaat
48901 tcttccctga acattttcca ggcccatttt agaaataaat ctgggtgatg cctttactc
48961 atttccaaag ccaaacaacc tgaaccccga ggccttgttc tgcagtgtaa atgttacgag
49021 gaggagggaa tcaggatcgg ctcctcagaa gaacccatct ccacctctag cagggaggct
49081 gagcagtccc cacagctgta cccaccgcaa accactgctg ctcagatctg gggacacagg
49141 tggatggagc tcacagcctg ggtcccagga cagcacagcc gcacccatcc ctctcaccct
49201 gccaggctct cccgcagcag ggagccttcc tctggtttct gggtgcactg acggctgcag
49261 cagctacaat ctccctgata cccattcatt cattcactca ctcactaaat atttctgctg
49321 agcgcctgtt atgtgtcagg caccgtgcta agagctagaa atacagcagt gagcaagtgc
49381 ccacggggcc tggcatatat ggggcactct actcacagca caatgaccaa gtgcatgagc
49441 tggaaggcag gaggaaggga gaaaaggaag cgtctgtgca gtcagctccc tctgcttttg
49501 tgtgcaccgt ctcattgaat ctcccaacc gcattccgtg attagaaggt gtccccatcc
49561 ccatattcac agaaaaacag ccaagttcca aaggaaaggg gagaggtgga ttgatacagt
49621 ttgtctgatt tcagagctcc gaactctctc atccacgcac actacaaagg cactcacaag
49681 ctcacaaaca cacagggaca catattcacc cccacacata cctggactgt gcctccctcc
49741 tccgggggta cccagtgatt gagccatgcg ttaacattct acttttcttt cttttctt
49801 cttttttagac agagtctcgc tctgtcgccc aggctggagt acagtggtgc gatcttggct
49861 cactgcaacc tctgcctcct gggctccagc gattctcctg tctcagcctc ccgagtagtt
49921 gagattacag gcatgtgcca cctcacctgg ctaatttttg tatttttag aatagagaca
49981 gggtttcacc atgttgatca ggctggtctc aaactcctga cctcaggtga tccgcccgcc
50041 tcggcctccc aaagtgttgg gattataggc gtaagccact gtgcccgcc aacattctac
50101 ttttttttcat cataaccatg ttctgagcac ccgctccggc tcctgtatgc tcctgtctgg
50161 gcccaggaac ccagagcaac aggggagact gagtccctgc ccttcagtca tgtgctgtct
50221 agaaggaagc cactggctgt ggctactaaa cgtgtgaatt gtggttaact ctacattgac
50281 atgtgctgtg agtgtgaaat acacactgag ttctaagac ttagtaagaa gaaaagaatg
50341 caaaatattc catactttaa ccaggttgag tacccttat ctgaaatgct tcagaccaga
50401 agtgttttgg atttcgcatt tgttctgttt ttggaatact atttgtgtat acataaatga
50461 gatatcttgg ggatgggacc taagtttaaa catgaaattc atatatgttt tttatacacc
50521 gtatatacat agcctgaagg taacttcata taaaattta aataattttg ttcatgaaac
50581 agaagtttg gctgcatgtt gactgtgacc tggaacatga ggtcaggggt ggaactctcc
50641 ttttgcggtg tcatgtcagc actcaaacgc tttcggattc tggagaattt caaagctcag
50701 atttttttaat tcgggatgct caacctgtct tgatcacatg ttgaaattat acatttttg
50761 gatatattgg gttaaagaaa aagtatgtaa aagataattt tccatgcttc ttttaaaaaa
50821 atgtggtggc tacttacctg tttgagcttg caggagcgta ttttaaaaac gtggctacta
50881 aaatatgtaa ggtcacatat gaggctcacg tgtgtgctca catgatattg cttagggaca
50941 gtgtggctgg agatggaaag acaaaccata agcaagcgta cgcatgcgga acaagggtgc
51001 ctgcgagtgg gggtacaggt caggaggaa gcagtacagg gcgggtggat gccagcagtc
51061 aggatgggtg gcctcacggg tggaggggaa gccaggagag ggaggagccg ggagtgagcc
51121 cagtatgagt catttcttat cctgcgaggg actgggcct gggtcctgaa ggaaggaagg
51181 aaggagatcc agggagctgt ataggcgcct gcctttattc ttccccgac tgagtgaggg
51241 gtcctggcgc tgcaggggcc ctctggaggt caccacctcc atccagcctc tcagtttcat
51301 agggtcagtg tctgccacgg tcctgatctc gggttggcaa acggtcctca ggccctgccc
51361 tcgcgggtgc tcactccaca ggtgcattaa tccagtgcct gtgatagtcc aagcctgctc
51421 taagcgctgc ggaggtggtg gtgaccaatc aaagtgccca ctccagggca gctcacagca
51481 agggtggggt ggctggagac agacaacagg caaaggaaca actacatgtg tcaggtgtgg
51541 tcggtgaaaa gaaacatcaa gagggagcat ggatgggtgg gagctgtgtt agagagaagg
51601 tgacatttca ggagggacct gaatgaattc agggatggag ccatgatcac accaaga
```

FIG. 24 (Continued)

SEQ ID NO: 10,476

```
ggcacgagca atgggactta tcgctgctga tgttaacctt gatctcttgg ttcaggtggt      60
gcctgccagc tgtctccact gtggagttac tatttttcct tttccccatt ttattcatca    120
gaagccagtc actaagcgag gtcaaactcc aggacagggg aattaagtgc caccttctgg    180
agagggagca ttcacattta ttacttggga tccttctgta aggaagagct gtttctcctc    240
taaaaaactc tttaatcctt ttaagcctca atttcttaat tgtgaaatgg ggctaatacc    300
tgtatccaac caagggagta gttagaaggt aacatgatag gtggaaagca cttaacatag    360
gcaaaatgtt attatcagga atgatcgaga gacccatcca actatctgaa ggagtcactt    420
aactctactg tactgcagcg ctgtaaagtc tgcatctttc actggggta aaggccccca     480
gtccctgaga cgggccagtt tggagacagg ctggttttt ctctgttctc ctgagagccc     540
ttcagatgag aagggaggtc tggagacaga atgccaaaag cccattaaag gcacggcctt    600
gcatttcaga gagggagcag gtctagagaa gaaccagagg agctcagctg agatatggtg    660
tatggattgg attttggtag aagatgggaa gaaccaaaca cctgagaaac cactttgaag    720
atcgggtca gagtaaggcc taacacatag ttggctccca gtaattattg gttgattgaa     780
cagctcaaag agcaactcga ccaagaacac tggactggga gtccagttac ttggatcttg    840
cattcctgat ttatttttat tttatatgta ttttttctat ttttttgaga cgaagtctca    900
ctcactctgt cgcccaggct ggactacaat ggcacgatct cggctcactg caaactctgc    960
ctcccaggtt caagcgattc tcctgcctca gcctctcgag tagctaggat tacaggcatg   1020
caccaccacg ctggctaatt tttgtatttt tagtagagac ggggtttgc catgttggcc    1080
atgctggtgt ccacctcctg acctcagttg atcttcctgc ctcagcctc caaaatgttg    1140
ggattacagg cgtgagccac cgtgcctggc cgtgctgctc tttttttgtg tatgtttgtt   1200
tttgtcaact tgctgtgtga ccttaagcaa gttacttaac ttctctgggc ttcactttcc   1260
atggatgaac attgtaaaga ggctggagag agatgaggac taggtacagg ctttagagga   1320
gagccaccgc cccggacttc tccctctgtc acccgcttt ccatgaccct ccttgcctga    1380
ctttgtgact cctggcctcg ctatcaaaac aagtgctgca atctcagtgc tttccaagag   1440
ccctgcattg ttagaaactt cccagcacg agcaaaggct gctgcaatac tcgctctgcc    1500
tgcctttgcc ctgcgcttcc tacttacect ccttttgttt ctcccaaaca tctgtccctg   1560
actatgctca tctcatgtt gtcctcagct gctgaaaggg ccacgtttgt tttcattaca    1620
aataagacca ccgagtgggc tcctggcgtg ggggcgggag cagcegcgcg cagtcttcag   1680
aggcagcccc ccaggctgtc tctggagggt gtgtctctgc ttccctttcc ccgtgtttat   1740
tttcagacga agccaagtgg cccggggga ccctccggac tccagcctt cagagaggag     1800
ggcagctcgg gctttcgccg cagtgcttcc tgcccgtcac gtgtgtgctc ctagccgggg   1860
tcggggagc tggtatcttg gccttctgg gaggacgcgc acagcccgag gaggcagagc     1920
cccagacggg aatgggcttt tcagaggtgg ggtgcgggcg aggggacgat gcattatttt   1980
taatatttga tttatttttc caactggact tcttcccggg gctctttctg ggcccagctg   2040
cctttgtgat cccgcgcccc ggtcctcggg ctctcaccte cagcgccggg gcgccccctg   2100
ctgtcggaag cggctgtgac cggcagagg tgctatctgg gactctgggt tctcagcccg    2160
gggacagcga accgaggggc agatgatcca tcagaaaaga gccggcactg cccagccccg   2220
cgccctgcc cctgcctttt tccggagcg cgccgccgcc caccgctac ggccgcttga      2280
ccccatcttt gagcccggcc ccaagctctg gaccgtcgt gcccctcatc aaggaagagc    2340
caaggacccc aaggagaagg tcaggagcgg cggtgtggat gtcccttggc tgcaggcccc   2400
gccgcgcact cccttcagtc cttcccttct ctagggacca ggtagcatca gtgcctggat   2460
ctcggccttg tgtgccctgc tccctgcccc acctactaag aaccaagtct ggttcaccgg   2520
ctcccaagag ctggaaccca ttctcagcta gctgggggcc caggccaccc cttccctcca   2580
gacctgtgtg ccttctgccc tggctccagg gccccccaca ccgtgaccag ggcgggatcc   2640
ctatggggct ggccagtcgg caccgtgcca ggcccacagt gccctgggcg tccatggaag   2700
tcgttctgtg tcttaaaat cagaaggaag acattaacct ttaggctgaa gaaaatgttt    2760
tagtacacag caataactta tttgtcttta tccaacagcc ataaaatata acttttaaata  2820
ttctattgat agagaagga gttcatgaag gcagaaatgc ctggggccca cgaacatccc    2880
agtgtggccc tggacgggac atcatgctgg gcaacacgac taaaatgcgg gtgaagacca   2940
gattcttgc acatggcggt gacgggatgc tccctagaga gcttcaagtg gattctttgc   3000
ttttattttt ctctcttaat aaaaatgtat gatgttaca ttgtcagaga aaaaaaaaa     3060
aaaaaaa                                                             3067
```

*FIG. 25*

SEQ ID NO: 10,477

```
gcaatgggac ttatcgctgc tgatgttaac cttgatctct tggttcaggt ggtgcctgcc    60
agctgtctcc actgtggagt tactattttty ccttttcccc atttwattca tcagaagcca   120
gtcactaagc gaggtcaaac tccaggacag gggaattaag tgccaccttc tggagaggga   180
gcattcacat ttattacttg ggatccttct gtaaggaaga gctgtttctc ctctaaaaaa   240
ctcttcaatc cttttaagcc tcaatttctt aattgtgaaa tggggctaat acctgtatcc   300
aaccaaggga gtagttagaa ggtaacatga taggtggaaa gcacttaaca taggcaaaat   360
gttatkatca ggaatgatcg agagacccat ccaactatct gaaggagtca cttaactcta   420
ctgtactgca gcgctgtaaa gtctgcatct ttcactgggg gtaaaggccc ccagtccctg   480
agacgggcca gtttggagac aggctggttt tttctctgtt ctcctgagag cccttcagat   540
gagaagggag gtctggagac agaatgccaa aagcccatta aaggcacggc cttgcatttc   600
agagagggag caggtctaga gaagaaccag aggagctcag ctgagatatg gtgtatggat   660
tggatttttgg tagaagatgg gaagaaccaa acacctgaga aaccactttg aagatcgggg   720
tcagagtaag gcctaacaca tagttggctc ccagtaatta ttggttgatt gaacagctca   780
aagagcaact cgaccaagaa cactggactg ggagtccagt tacttggatc ttgcattcct   840
gatttatttt tatttatat gtattttttc tattttttttg agacgaagty tcactcactc   900
tgtcgccag gctggactac aatggcacga tctcggctca ctgcaaactc tgcctcccag   960
gttcaagcga ttctcctgcc tcagcctctc gagtagctag gattacaggc atgcaccacc  1020
acgctggcta atttttgtat tttwagtaga gacggggttt tgccatgttg gccatgctgg  1080
tgtccacctc ctgaccctcag ttgatcttcc tgcctcagcc ttccaaaatg ttgggattac  1140
aggcgtgagc caccgtgcct ggccgtgatt tatttttttt gtgtatgttt gttttgtca  1200
acttgctgtg tgaccttaag caagttactt aacttctctg ggcttcactt tccatggatg  1260
aacattgtaa agaggctgga gagagtgag gactaggtac aggctttaga ggagagccac  1320
cgccccggac ttctccctct gtcaccccgc tttccatgac cctccttgcc tgactttgtg  1380
actccttgcc tcgctatcaa aacaagtgct gcaatctcag tgctttccaa gagccctgca  1440
ttgttagaaa cttcccagca cgcagcaaag gctgctgcaa tactcgctct gcctgccttt  1500
gccctgcgct tcctacttac cctccttttg tttctcccaa acatctgtcc ctgactatgc  1560
tcatctcatg tttgtcctca gctgctgaaa gggccacgtt tgytttcatt acaaataaga  1620
ccaccgagtg ggctcctggc gtggggcgg gagcagccgc gcgcagtctt cagaggcagc  1680
cccccaggct gtctctgag ggtgtgtctc tgcttccctt tccccgtgtt tatttcaga  1740
cgaagccaag tggccgggg ggaccctccg gactccaagc cttcagagag gagggcagct  1800
cgggcttcg ccgcagtgct tcctgccccgt cacgtgtgtg ctcctagccg gggtcggggg  1860
agctggtatc ttggcccttc tgggaggacg cgcacagccc gaggaggcag agccccagac  1920
gggaatgggc ttttcagagg tgggtgcgg gcgaggggac gatgcattat ttttaatatt  1980
tgatttattt ttccaactgg acttcttccc ggggctcttt ctgggcccag ctgcctttgt  2040
gatcccgcgc cccggtcctc ggcctctcac ctccagcgcc ggggcgcccc ctgctgtcgg  2100
aagcggctgt gaccgggcag aggtgctatc tgggactctg ggttctcagc ccggggacag  2160
cgaaccgagg ggcagatgat ccatcagaaa agagccggca ctgcccagcc ccgcgccct  2220
gcccctgcct ttttccggga gcgcgccgcg ccgcaccgc tacggccgct tgacccatc  2280
tttgagcccg gccccaagct ctgggaccgt cgtgccctc atcaaggaag agccaaggac  2340
cccaaggaga aggtcaggag cggcggtgtg gatgtccctt ggmtgcaggc cccgccgcgc  2400
actccccttca gtccttccct tctctaggga ccaggtagca tcagtgcctg gatctcggcc  2460
ttgtgtgccc tgctccctgc cccacctact aagaaccaag tctggttcac cggctcccaa  2520
gagctggaac ccattctcag ctagctgggg gccaggcca ccccttccct ccagacctgt  2580
gtgccttctg ccctggctcc agggccccc acacgtgac cagggcggga tccctatggg  2640
gctggccagt cggcaccgtg ccaggccac agtgcactgg gcgtccatgg aagtcgttct  2700
gtgtctttaa aatcagaagg aagacattaa ccttaggct gaagaaaatg ttttagtaca  2760
cagcaataac ttatttgtct ttatccaaca gccataaaat ataactttaa atattctatt  2820
gatagagaaa ggagttcatg aaggcagaaa tgcctggggc ccacgaacat cccagtgtgg  2880
ccctggacgg gacatcatgc tgggcaacac agctaaaatg cgggtgaaga ccagatttct  2940
tgcacatggc ggtgacggga tgctccctag agagcttcaa gtggattctt tgcttttat  3000
ttctctctct aataaaaatg tatgatgttt acattgtcag agaaaaaaaa aaaaaaaaa  3060
ctcgtaggg gggcccgtac ccaatcgcct gtgatgatgg tatac                   3105
```

FIG. 26

Ly1488 Protein Sequence (SEQ ID NO: 10,969)

ELLKSIWYAFTALDVEKSGKVSKSQLKVLSHNLYTVLHIPHDPV
ALEEHFRDDDDGPVSSQGYMPYLNKYILDKVEEGAFVKEHFDELCWTLTAKKNYRADS
NGNSMLSNQDAFRLWCLFNFLSEDKYPLIMVPDEGDEGNHPSPEPVPSTKHPNKTQDP
PESPKQSVPKSCWGRLWEPDRALPGVGAGNTTCCSYQAFLLLLQVEYLLKKVLSSMSL
EVSLGELEELLAQEAQVAQTTGGLSVWQFLELFNSGRCLRGVGRDTLSMAIHEVYQEL
IQDVLKQGYLWKRGHLRRNWAERWFQLQPSCLCYFGSEECKEKRGIIPLDAHCCVEVL
PDRDGKRCMFCVKTANRTYEMSASDTRQRQEWTAAIQMAIRLQAEGKTSLHKDLKQKR
REQREQRERRRAAKEEELLRLQQLQEBKERKLQELELLQEAQRQAERLLQEEEERRRS
QHRELQQALEGQLREAEQARASMQAEMELKEEEAARQRQRIKELEEMQQRLQEALQLE
VKARRDEESVRIAQTRLLEEEEEKLKQLMQLKEEQERYIERAQQEKEELQQEMAQQSR
SLQQAQQQLEEVRQNRQRADEDVEAAQRKLRQASTNVKHWNVQMNRLMHPIEPGDKRP
VTSSSFSGFQPPLLAHRDSSLKRLTRWGSQGNRTPSPNSNEQQKSLNGGDEAPAPAST
PQEDKLDPAPEN*

Ly1488 DNA Sequence (mRNA) (SEQ ID NO: 10,970)

```
   1 gaactgctca agtccatctg gtacgccttt acgcgctgg acgtggagaa gagtggcaaa
  61 gtctccaagt cccagctcaa ggtgctgtcc cacaacctgt acacggtcct gcacatcccc
 121 catgacccg tggccctgga ggaacacttc cgagatgatg atgacggccc tgtgtccagc
 181 cagggataca tgccctacct caacaagtac atcctggaca aggtggagga gggggctttt
 241 gttaaagagc actttgatga gctgtgctgg acgctgacgg ccaagaagaa ctatcgggca
 301 gatagcaacg ggaacagtat gctctccaat caggatgcct tccgcctctg gtgcctcttc
 361 aacttcctgt ctgaggacaa gtaccctctg atcatggttc ctgatgaggg tgatgaaggg
 421 aaccacccga gccctgaacc agtgccctct actaaaccac caaacaagac ccaggatccc
 481 ccagaaagtc ctaaacagag tgtcccaaaa agctgctggg gcaggctctg ggagccagat
 541 agagcactcc ctggtgttgg tgctggcaac accacctgct gcagctacca ggccttcctt
 601 ctcctgctcc aggtggaata cctgctgaaa aaggtactca gcagcatgag cttggaggtg
 661 agctgggtg agctggagga gcttctggcc caggaggccc aggtggccca gaccaccggg
 721 gggctcagcg tctggcagtt cctggagctc ttcaattcgg gccgctgcct gcgggggcgtg
 781 ggccgggaca ccctcagcat ggccatccac gaggtctacc aggagctcat ccaagatgtc
 841 ctgaagcagg gctacctgtg gaagcgaggg cacctgagaa ggaactgggc cgaacgctgg
 901 ttccagctgc agcccagctg cctctgctac tttgggagtg aagagtgcaa agagaaaagg
 961 ggcattatcc cgctggatgc acactgctgc gtggaggtgc tgccagaccg cgacggaaag
1021 cgctgcatgt tctgtgtgaa gacagccaac cgcacgtatg agatgagcgc ctcagacacg
1081 cgccagcgcc aggagtggac agctgccatc cagatgcga tccggctgca ggccgagggg
1141 aagacgtccc tacacaagga cctgaagcag aaacgccgcg agcagcggga gcagcgggag
1201 cggcgccggg cggccaagga agaggagctg ctgcggctgc agcagctgca ggaggaagg
1261 gagcggaagc tgcaggagct ggagctgctg caggaggcgc agcggcaggc cgagcggctg
1321 ctgcaggagg aggaggaacg gcgccgcagc cagcaccgcg agctgcagca ggcgctcgag
1381 ggccaactgc gcgaggcgga gcaggcccgg gcctccatgc aggctgagat ggagctgaag
1441 gaggaggagg ctgccggca gcggcagcgc atcaaggagc tggaggagat gcagcagcgg
1501 ttgcaggagg ccctgcaact agaggtgaaa gctcggcgag atgaagaatc tgtgcgaatc
1561 gctcagacca gactgctgga agaggaggaa gagaagctga gcagttgat gcagctgaag
1621 gaggagcagg agcgctacat cgaacgggcg cagcaggaga aggaagagct gcagcaggag
1681 atggcacagc agagccgctc cctgcagcag gcccagcagc agctggagga ggtgcggcag
1741 aaccggcaga gggctgacga ggatgtggag gctgccaga-gaaaactgcg ccaggccagc
1801 accaacgtga aacactggaa tgtccagatg aaccggctga tgcatccaat tgagcctgga
1861 gataagcgtc cggtcaccag cagctccttc tcaggcttcc agccccctct gcttgcccac
1921 cgtgactcct ccctaaagcg cctgaccgc tggggatccc agggcaacag gacccctcg
1981 cccaacagca atgagcagca gaagtccctc aatggtgggg atgaggctcc tgccccggct
2041 tccacccctc aggaagataa actagctcca attagcctct cttagccct
2101 tgttcttccc aatgtcatat ccaccaggac ctggccacag ctggcctgtg ggtgatccca
2161 gctcttacta ggagagggag ctgaggtcct ggtgccaggg gcccaggccc tccaaccata
2221 aacagtccag gatgaaacct ggttcaccct tcataccagc tccaagcccc agaccatggg
2281 agctgtctgg gatgttgatc cttgagaact tggccctgtg ctttagaccc aaggacccga
2341 ttcttgggct aggaaagaga gaacaagcaa gccggggcta cctgcccca ggtggccacc
2401 aagttgtgga agcacatttc taaataaaaa ctgctcttag aatgaa
```
//

FIG. 27

TMpred Report for Ly1488 (SEQ ID NO: 10,969)

```
ELLKSIWYAFTALDVEKSGKVSKSQLKVLSHNLYTVLHIPHDPVALEEHF
RDDDDGPVSSQGYMPYLNKYILDKVEEGAFVKEHFDELCWTLTAKKNYRA
DSNGNSMLSNQDAFRLWCLFNPLSEDKYPLIMVPDEGDEGNHPSPEPVPS
TKHPNKTQDPPESPKQSVPKSCWGRLWEPDRALPGVGAGNTTCCSYQAFL
LLLQVEYLLKKVLSSMSLEVSLGELEELLAQEAQVAQTTGGLSVWQFLEL
FNSGRCLRGVGRDTLSMAIHEVYQELIQDVLKQGYLWKRGHLRRNWAERW
FQLQPSCLCYFGSEECKEKRGIIPLDAHCCVEVLPDRDGKRCMFCVKTAN
RTYEMSASDTRQRQEWTAAIQMAIRLQAEGKTSLEKDLKQKRREQREQRE
RRRAAKEEELLRLQQLQEEKERKLQELELLQEAQRQAERLLQEEEERRRS
QHRELQQALEGQLREAEQARASMQAEMELKEEEAARQRQRIKELEEMQQR
LQEALQLEVKARRDEESVRIAQTRLLEEEEKLKQLMQLKEEQERYIERA
QQEKEELQQEMAQQSRSLQQAQQQLEEVRQNRQRADEDVEAAQRKLRQAS
TNVKHWNVQMNRLMHPIEPGDKRPVTSSSFSGFQPPLLAHRDSSLKRLTR
WGSQGNRTPSPNSNEQQKSLNGGDEAPAPASTPQEDKLDPAPEH
```

Black = intracellular, Red = Transmembrane, Blue = Extracellular

Ly1488Rp3-329A5Chr6 has 756 amino acids and 1 Transmembrane Domains
Transmembrane Domain 1: 199 - 220    Score: 1.3061

*FIG. 28*

Ly1449 and Ly1480 matches Lung cancer associated
polynucleotide sequence SEQ ID 10,478

```
cttaaagagg taatttagcc atcattctta tgccagcaga tataaataaa cttggaccca     60
tctggtcttc agctaaacct gagacatttt aaagtgcatg gacagccatg gacagcaggc    120
cctcctctaa caggggatgc aaggcatgga gaaagacaat cagtacccaa gctcagccac    180
agaagacagg agtcactcat ataacttgtg tttagaagtt tttggcagcc acgcacactt    240
tctgaaatca cactatctgg tggtttaatc atatttttaa agacagaatc cctgagtgct    300
gagcagattc tcaaaacaca tttagaatcc ctgaaattag aaagatcaat gacaaaatat    360
ctgtcagcca ggccacaaac aggtgtaaaa ttatgaaagg agtggttgga tgtgccaagt    420
ttggtaaagt ggtgactgca tctgagaaag aggctgtgag gctgaactct tggtggcttc    480
cttctgtaac ttccagaggg agtcttcaac acaggccccg tgctcgtagg aatacggtag    540
cacctatgta ggaagtgcgt ggagtttcct gtcttcttcc tgtgtgattt ttggcctttt    600
tatcagcact tctcccctcc cagaagcctg gggatgccaa acatccagaa tgtgatggga    660
caagatgggg gcagggcct cacctccctg cagaggtccg gccaggtctc cttgtccctg    720
gacaatctcc tgagcctctc tgcttggtgg agcaggcacc tgtgtgcaga attcccactg    780
tggccagcac gaggaagtct tttctagtga aaatgtgtct tgtggtcagg aataattatc    840
ctttcccctg tagccaccaa ggagggcaaa tagagaaagg taacctaatt gaaggattgg    900
tcatgtgaaa agggctacat ttgggaagct gggaaaggcc tccaggcttc tagagcagct    960
agcttgggct ggattctcay acccaggctg cccccttggat tgttctaccc aagcttttcc   1020
ctggggtctg ggctcactcc ataaggtaag gtgccttta ccttatggtc cttctttagc    1080
aggtaacaaa ggagcatcag gggcaggctg ccctggtggc atcacactgg ctagtgaggc   1140
cgtgaatatc ttgtccccca gcagggccga cagtttctat cacagaaaac agtgtgttca   1200
gtggtgaaaa tcgttgcatg catgttttca tctgagcgtg tccttctccc atactcccta   1260
tcagccagcc ctgcctgtag ctgctgtatg tgattgcac ttggacatca gtccaatgac    1320
tgcaagtcgg cctggatttt cacttgcaga ggctacagct gcattgtcag gtctcccagc   1380
cctgcagaga gctccctcca ctggttagca gtgtgttgtg ttttccattc atttcagaag   1440
agctacattg tgtcactgga catttttaaaa aactgtgatt ttaataaaa attttaaatt   1500
tgaaaaaaaa aaaaaaaaac ctcgggggta acttttrggg gggccgggggc ccwtgcgttt   1560
t                                                                  1561
```

*FIG. 29*

Homo sapiens chromosome 17, clone RP11-956N15, complete sequence (bp1-10 000)
(SEQ ID NO: 10,474)

```
   1 tgtatgtatg tgtgtggtgt gtgaaggtgt atgtggtatg tgtttggtat gtgtatatgt
  61 gtactgtgtg gtgcatgcat gtctctgtgta tttgtgtgca tgtgtatgta tgtgtgcccg
 121 tctctgcata tgtgtatgta tatgtgtgca tgtgggtaca ggtgtatgta catgcatgca
 181 catgtgtgca catgtgtgaa tgcatgtgta catttgtgca tgtgcttatg tgtgtggatg
 241 catgtgttca tgtaaatgca tgcatttgtg cccatgcaca tgtgtatgta catgtgtgca
 301 tatacatgta tgcactgaca tatatgcatg tgtgcatatg tacacgtgtg catgcctcct
 361 gtgcatgtgt gaatgcatgt gtgcatgtgt atgtatatgt gtgcatgtct gcgcatgtgt
 421 gtaacctcct tagaacaggc agaaattggg gctctggaat cctttctttg cctaccgcag
 481 ttccttttag gctgtcttca tagagaaagg gatagctcaa aacccacagc cctgctttgg
 541 cctgatgggg gatttctggg tctcctcagt ctgtctttta ttaggcaggc catgggctgt
 601 caggccctgg ctgggtagat gctctgctca tgaataaaag atagaggcag ggcaggacag
 661 ggccctccct gatgggcctc cccgccgttc tgtgtggtgg aatctcacag tcaactttga
 721 cctgtgcaca tccactttt tttttgagat aggatcttgc tctgtcaccc agctgggagt
 781 gcagtggtgc catcagagct catttcgagc tcgacctccc aggctcaagc aatcttcctg
 841 cccagcctc ccaagtagct gggactacag gtgcatacca ccacaccgg ctaatgtttt
 901 gatttctgca gagctaaagt cttactatgt tgtccaggct ggtctcaaac tctgggctca
 961 agagatcctc ctgccttggg ctcccaaact gctgggatta caggcatgag ccactgcacc
1021 cggccaacac attcacttt ttgggacatg gcagggactt aatgttttag aaaacattta
1081 gctaccccctt tgacaatgct gcttgacact atttgacagt gtgacttacc acatcctaat
1141 aacttccatg aaaatcatca caaagcaaat tttaaattt tattaaaaat cacagttttt
1201 aaaaatgtcc agtgacacaa tgtagctctt ctgaaatgaa tggaaaacac aacacactgc
1261 taaccagtgg agggagctct ctgcagggct gggagacctg acaatgcagc tgtagcctct
1321 gcaagtgaaa atccaggccg acttgcagtc attggactga tgtccaagtg caatcaccat
1381 acagcagcta caggcagggc tggctgatag ggagtatggg agaaggacac gctcagatga
1441 aaacatgcat gcaacgattt tcaccactga acacactgtt ttctgtgata gaaactgtcg
1501 gccctgctgg gggacaagat attcacggcc tcactagcca gtgtgatgcc accagggcag
1561 cctgccctg atgctcctttt gttactgct aaagaaggac cataaggtaa aaggcacctt
1621 acttatgga gtgagcccag accccaggga aaagcttggg tagaacaatc caagggcag
1681 cctgggtatg agaatccagc ccaagctagc tgctctagaa gcctggaggc ctttcccagc
1741 ttcccaaatg tagcccttt cacatgacca atccttcaat taggttacct ttctctattt
1801 tcccccttg gtgtgctacag gggaaaggat aattattcct gaccacaaga cacattttca
1861 ctagaaaaga cttcctcgtg ctggccacag tgggaattct gcacacaggg gcctgctcca
1921 ccaagcagag aggctcagga gattgtccag ggacaaggag acctggccgg acctctgcag
1981 ggaggtgagg cccctgcccc catcttgtcc catcacattc tggatgtttg gcatcccag
2041 ccctgggga gggagaagt gctgataaaa aggccaaaaa tcacacagaa agaagacaga
2101 aaactccacg cacttcctac ataggtgcta ccgtattcct acgagcacgg ggcctgtgtt
2161 gaagactccc tctggaagtt acagaaggaa gccaccaaga gttcagcctc acagcctctt
2221 tctcagatgc agtcaccact ttaccaaact tggcacatcc aaccactcct ttcataattt
2281 tacacctgtt tgtggcctgg ctgacagata tttttgtcatt gatctttcta atttcaggga
2341 ttctaaatgt gttttgagaa tctgctcagc actcagggat tctgtctta aaaatatgat
2401 taaaccacca gatagtgtga tttcagaaag tgtgcgtggc taccaaaaac ttctaaacac
2461 aagttatatg agtgactcct gtcttctgtg gctgagcttg ggtactgatt gtctttctcc
2521 tgcctaca tccccctgtta gaggagggcc tgctgtccat ggctgtccat gcactttaaa
2581 atgtctcagg tttagctgaa gaccagatgg gtccaagttt attatatct gctggcataa
2641 gaatgatggc taaattacct ctttaagttg tttttttgtt tgtttgtttt gacagagtct
2701 cgctgtgatg cccaagctgg agtgcagtgg catgatcttg gctcactgcg acctccgttt
2761 ctcgggttca agcgattctc ctgcctcagc ctcccgagta gctgggacta cagacacatg
2821 ccaccatgcc cggctaattt ttgtattttt agtagagatg gggtttacc atattggcca
2881 ggctagtctc aaactcctta cctcaagtga tccacccgcc tcggcctcct aaagtgctga
2941 gatgtctctt taactttcaa gaggtacagc aaaactgaaa tcaatgggtg atgacttctt
3001 aaagatcaaa catgaagatg aggattagtt aagaccgaaa aatcattctc cgatcttgta
3061 tcttcaactc aaattcacac tccaaaaggc ctgtttgtgg tgaggctcag ggtcttggc
3121 ttgttctgaa ttaatacttt ctttggaaac tctttagatg gctttgatcc ctgtgctgcc
3181 ccccattgca gacacagaaa gcgacagggg attctggcgg caccctctct gtggaggaga
3241 ggaaggtgtg gaccacgttc agaggaaagc agcctgaagc tgtcctcagt tggctacatg
3301 gggatgggcc tcttgccct gctgtgcagc ctccatgcag ggctttattt accagtcacc
3361 aggtcttcaa gacagtctgc aggagagagg atttcagggg gaaagtaagc caagccaatt
3421 cattctcatg gtcccctttt atcacaaaca tgtaagtctt ccatctcata acagagacag
3481 caaaagcagt atccaggcct ttttttttt tctttcttc tttccttaac tggctacatg
3541 cttagaaact gcactggtca aacttgattt tctttttaaa gcctcaaaac attcttattg
3601 tcaggaaagc ttttcagtgg ccagggatca gtctcatggc cgtagaagca gccaaattcc
3661 tctgcctttg ccttcccttc aggagtcaca tgctaaggca tccttgggca tttggaaaag
3721 gccgcttggg gtgagagtgc tctaggccac tctgcaatgt ccctgggccc gatgagtaac
3781 aaatgcaccc cgggacccag agaagtggaa agacatgaaa gggatttgga aacagatcgt
3841 aaaaataacc tgtatgaaaa tcacacagac aagaaaacaa acaaatccag ctagcccctt
3901 ggatcctgcc atccgtcttt tctcccggga ctgcctttgc tttgtgggagg gtgagtcctg
3961 ggacaggctt tgggtgacaa gttgtgggca tgttccatcc aagcctggct ctcccgactg
4021 gcagagggag gtggctgaca atcaattcct ctggatacat tttcctgtga ttgctcctgt
```

*FIG. 30*

```
4081 gatcaaaggc agccaccgac aggtgcggga gcggttagtt caccacgtca tagtagtaat
4141 tgcgcagccg cagttccact gctgcgaatc cgggcctgtt ttccacactg gaatggaaga
4201 gatgcattct tgtttgtcaa tgtgcttgtg aaaaattgct gatcacaagc agggcctctg
4261 caggctgagt accagtggtg ctgctccctg gtggctaact ctagggcctg cagctcacag
4321 cgtggtccct gtgcccccca ccccagggtg accacaaggc tgtcaaaaat agtgttggcc
4381 tactgtagac ctaaataacc catatctgca ctttaacaag acctcccggt gattcatgtc
4441 caccctaaag taggagactt tttgcattag aactgggagt gttttagccc caggttcaga
4501 tatgcggcac acaatatgct tctgtgccac aggcaacacg aagaggctgt cactctgtga
4561 ttttagcaaa acaggtgtct gaaaatactt ggcaaatgtt ctgcagatat agtcaacatc
4621 tgactcataa tcttgttaag agaagaaata cgaacataac tttaattctc cctttccacg
4681 ctctaatcga tggctctgga ttttctgaaa atgggctgtt gatatgggtt cttaggaaag
4741 ctcaaaacat gtcatggcag gagcaagac ccagggcttg tctatgatcc accttaatat
4801 agccagtcct tactgccact gctggccagg gaggcactaa tgtcagtaaa ctatgggcaa
4861 aagcattaac agttcgcagt ctctaaacaa acacttacag acacttctgt tttgtcttac
4921 acagacatcc tgtacagatc agttgaagt aagtactaaa accctgataa tcgatcctca
4981 cttagaagtt attttttctta ttttgcaaga tttctggata tattgcaagt gggtgaagtt
5041 gaaatacaat aagtgaaaaa gtgaaacaga atgtgaggtt aaattgtagg aaacgtcca
5101 cattcagcca ttttgaccta tatcaatggc aattccatat gattcaatgt cgacacaaga
5161 gaacagccat agaacgcgca tcaggaccaa gactcactca tcattataag agcagagtgg
5221 cttctacaaa tcaaaatggg tagctttgtc aaatggcatc aaaatacatg gtttctctta
5281 tagctttcaa tagtgagcaa aatgataaaa ctgctcgaat tgatcagtgt ggtcagccat
5341 ctgtggtcat gtctggggac acgggcctcc caggggtgtca ctgagagggg ctttgtctct
5401 ggccaccaag tgtgttccga gaggggatat ggtggccaag cctctggtac aggagcatgt
5461 gtccacccag agggacagcc tctgtcttgc tcctaaactt ctacagtcaa agagaacaca
5521 cttcagcatc tttgcaaaac aggggggctct gctccaactg tggggatcca aatggtacaa
5581 agagcacctt tggatcttgc tctgggggtt catctgccca gcagccaagg agcaaacaaa
5641 tgcagggaaa caggaataca gactcgtcct caggaaaaac acctggtcag gtctcctagg
5701 aaatctctcc tgtacatcca tgggagatgc tgcctccagg aagctgggac acagctgtgc
5761 ttcagcagca ggagggtgat gcagtgccct tgcgtgccca gcttcctggc ctgccctggc
5821 ctgccactct gctttcgggc cagagtgcag attctgctct gctccttgta cccagtgacc
5881 ctcctcctct ccctcatcc ctgcactcaa ccttgcttct tagcctgcag gtctcagctg
5941 caatccctaa aggcggccta tctggagccc ctgctggaag tgtgaggctt ccctcccccat
6001 aatttttctgt tctctttttaa agtttccagt gtgtgatttt atataaagag atatatggtc
6061 tttatcctgg gttcctgcca cagagctcct aaaacccttg gaatttcctg attgttgggc
6121 tgaaagcagc atctttgtt actcataata aaccccttc aaccatacct gggtttgtgc
6181 taatgagact atttctctcc ctccctccct ccttctctcc cttcatctac ctccctcccg
6241 ctctctctgt ctgtctctat atatccctt ggagagagtg gctgtttact actgagaaa
6301 aaatgaaaaa acaaagcaaa acaaaacaaa acagagaata tactaggacc acctgtagtc
6361 ccttcattga atccaccaca ttctagaaagc tccaatgtgc ttctgtgctg caggcaactg
6421 tgagaaacta cttcgacacg agagggctta aaaaacccca tatatacacg tgatatcctc
6481 caggccctg tgccctcctt gcttagaatt cccactggag tcatcccttt cctaagacac
6541 atcataggac acacttattt ttagcttatt gtttattgcc tgtctgcccc agccccaact
6601 ataaggtctg atagggacag ggtctgaggc ttctgtgagg cttgcacctg gggtggcagc
6661 ctgcatagca ggagctccgg cagtggccac cgaccctgtg aatgaccag ggctctcaga
6721 ggatgtgccg ctcagaggaa agccttggag ctgaggttgt gcagggagcc aggggacatc
6781 tcaccaaggt cctgggaatt catgtttat cttgggcttg ttgatcttta aacaggaatt
6841 tgagccgcat ctagagcctc cctgactctc agagaacctg gagagcccag gaaatttctc
6901 cattcggcag aggcccccac tggaggggctg ggactattgg gaaaccgttt ttcaggatca
6961 agagcaccaa cttctctcca tttgcaaggg cttttcccccac tggtgtcttt aatcaccccca
7021 agcatgactt ggctctggaa aacactacag tggaaggctt cctgactgat tcctgctttt
7081 cttagggcca gtgtttcctt cctggctttc acgctgcctc cttgagtgac ctgcacaggg
7141 caggactctg atgttgtgtt tcctcttttgg aaagtgagag gggggaaggag tgaagcatgg
7201 gccatcccaa aatatgccag attgggatat tgattatttt gagttgaaaa tattggatac
7261 attgtagttt cggataggac taactgacct gtctcttcat gcctgcagca agccataaag
7321 attcctctgg gaaggagacc cttcctgtag caggatgaga aaatgcccct tatcatcaga
7381 gactgggcat tggagctgca atgggcctga gtaaacatat ttaacacagt atcccttatc
7441 ttccactggt tttacaccct cctcatatct cctagcgcct tctctagaaa atttactcct
7501 tctagccaga ttttatttgt cctgtcattt ctccttaaat gtatggttct ttgtctaaag
7561 attataaaag catgttgttt tggccatttc tttagacttc actgtcttgt gaggatcccc
7621 ataaacatgt aaaactagta aaattggtaa gcttttcttt tgttaatctg gcctggtatc
7681 aatttggttt ctaggtccag ctgaagagtc cattaagact aaaaagggg tggaggtaat
7741 ctctggctgt cttacaaggg tgagggatgc tgtctgcctt ctcagggctt tgtcattgag
7801 gctgggaagt cccttttgaat tccctccagg accacaccct ggaactgatg acaatgcctg
7861 cagtgaggga cccccctgcat cttctggagg gcctcaagca atagcctggg ttaccaggac
7921 cagcccttgg cgcttctgag ttctccttgt ggccctgctc caaggaatct tttcctttt
7981 tttcattcaa ctgcacctca ttgaatttct tatgtttaga caaagtgatt cagagctaga
8041 aagaaattat ttaggcagat agtgagggta acagagtcct ctgtaaggtt tccttgcaat
8101 aaaaagcagc tcctaaatca tgtctcttat aacaaaaagc agcctgaaaa atcaagctgc
8161 aagcatagct aagcaagcta aaagctcaca taggtaaatg ccggcagctg tgtcaataga
8221 aaagggatcc ctggagccag ggatattcaa catggaggtt ccctcttcca cttcccttgt
8281 tgccacgtgt gcagtaaaaa agcaggcaac aaggctgagg cgggcggatc atgaggtcag
8341 gagatcgaga ccatcctgac taacacggtg aaacccgtc tccactaaaa aatacaaaaa
```

FIG. 30 (Continued)

```
8401 aattagctgg gcgtggtggc gggcgcctgt agtcccagct actcgggagg ctgaggcagg
8461 agtatggtgt gaacccggga gacagagctt gcagtgagcc cagatcgcgc cactgcactc
8521 cagcctgggc gacagagtga gactccgtct caaaaaaaaa aaaaaaaaaa aagcaggcaa
8581 catggcgtcg gccaaggaga gacctcatct gcataataaa agattaggbgt ggggcagcca
8641 gtttctttc gtgttatgta aatggcctgg ctgtccaacc gatctttggg ccctatgtaa
8701 tcagactcaa gctcgtctat aaaaccctbg catttccaca cggagccgga agaaccactt
8761 gggagccctt gtctctctgc aggaaagaga gctttctct tttctgttgc ctattaaacc
8821 tctgctctta aactcacttc ttgtgtgtct gcatctttga tttccttggc gtgaggcaac
8881 gagctcaggt attacccccag acaaacacag ctgcttcaaa agtttcagaa catctcccca
8941 cctcccccaa ccctgtttga ggtcactact agaaacactg taaccttcag aaatatagct
9001 ttgttgggaa ataaatcaaa gtctgataaa gagctgtgat ttctaatatg gggcatggc
9061 cattgtcatg atttcctttt gactggggct tgtgccctgg agctgactcc tccaagcctg
9121 cagaactcac tgaaatgcac ccctgcagag cggactgggg tgggaaccaa ggggaaagac
9181 attgcctgcc tgtgaacctc actcaggttc catcttaaat ctccaggcgg gaaaatacgt
9241 ttagaaagaa tactctctta aggagactgt tctactgctc tactttgctg taattctggt
9301 gaacatccag tgaatatcac gtagactgct ttccctcccc ggtctgcccc tggtggacca
9361 ctctggaaat aactgcccac tgttacgtgc gtccatggag gacagaggtc ggcccagcag
9421 cccctatcct gattccttga gtcacaagaa tacaccacga gcccaaaggg tattcagcag
9481 cctcactgca cccacctggg agccaagtgg gaggtggtgc ccctggctgc gcaccctgct
9541 ctcttcccac ccacctttca ctcctcactg ttaaacacac accacaaaga agaatcgaca
9601 gaagtacata gatcagcatc aacgttaaat gcaaaaactc ccccactgcg agttcatttt
9661 taattcaaag tttttgcatt tgtatcacaa tgttttaaac tctaccctcc tcacccttct
9721 acaagaaggg aagccttgca aagggagctg caggctggac caaagaacac tttcagtaaa
9781 gggtcatagg ctgccacgtg cccaagggct gccctcccca gggtccagtg ctgccagtgc
9841 ctacctgcca atggttctta cgattctagt ttaggcactg ggagaattaa gccaagactt
9901 aggaataaac atcctcttag atccatgagt agcacttccc tcttgctgac acttagctct
9961 ccctgttgca ctaacacttg gggttggaga agatgctccg gggcccaggc caggctcctc
10021 tcctgagcca cggcagcagc aggggcaggg aagcatatac ccacagtttg cctgctgcct
10081 ttgtggctgc cccctgggtg gtttctagat acagaatgag attatttccc tgtcactcac
10141 aattgtggta gagtgatact cccagggtgg ggaggggagg tctcggaatc ccaggtggca
10201 tctgcagcat ttggaatagc cctcatcttt cagaggctct ggcaatgtca gctgtatctg
10261 aaggcaaacc tgattccgca aagcatcaaa tccatggcca ggatttgtga tgtcctcctg
10321 atcacaaacc acatcgattc tcagctgtgt gggctctgtg tgcacagttc agtaccaggg
10381 aactggagat ggcggcttgg ggtcaccgtg ctatgcacgc acaagcaggc tgctgagcct
10441 ggcaaaactg tactcctaat tttcagtggc aatgcatttt ccttccttgc tgagctgccc
10501 tgaacatcac ctaagaataa tgccaggtgt actttaaaag cataacagca cctgggatcc
10561 actaagcgag acgtatgacg gcagtcaggg tggactgagg ccaccacttc aaggatgagg
```

*FIG. 30 (Continued)*

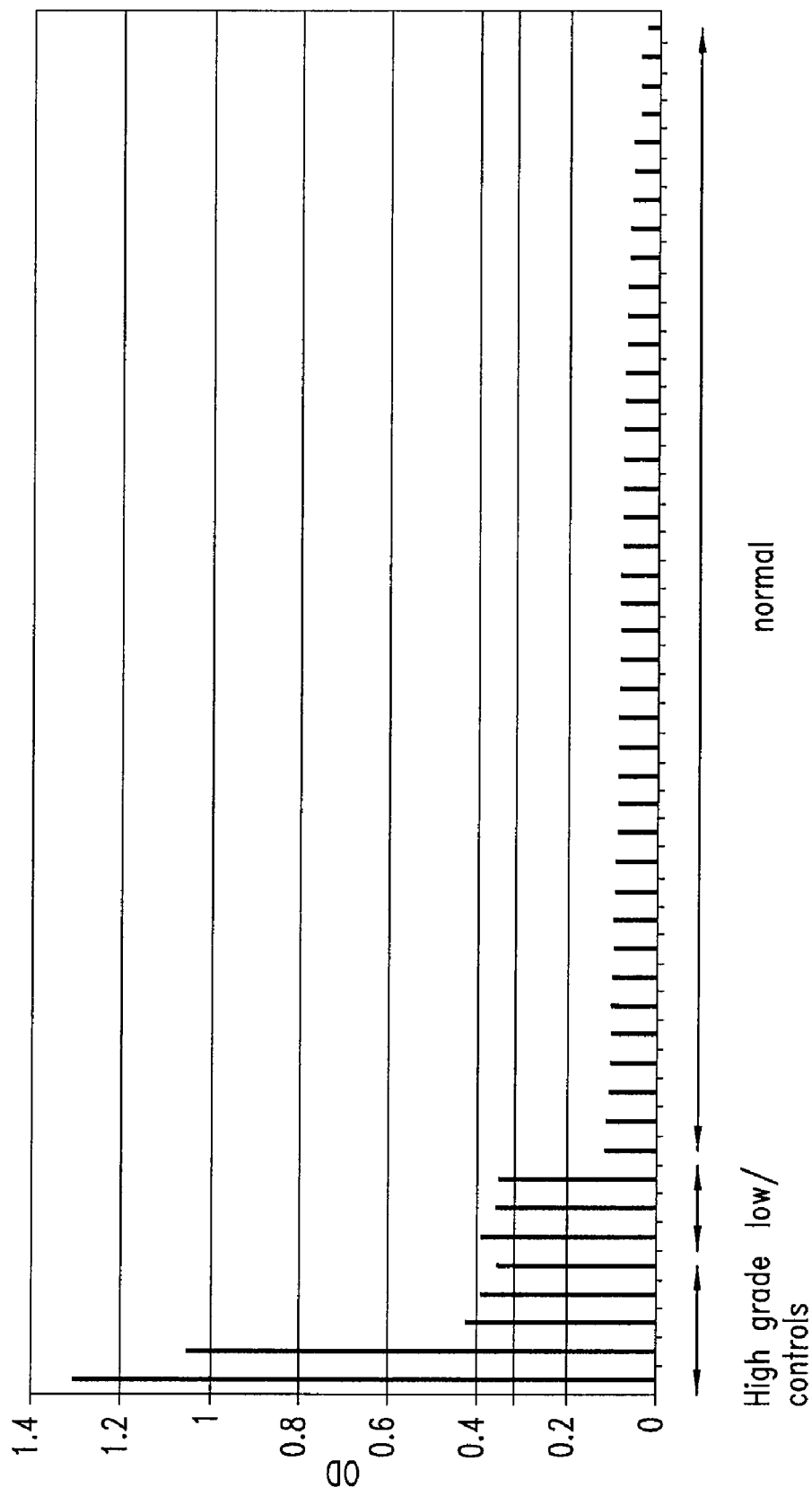

COMPOSITIONS AND METHODS FOR THE DETECTION, DIAGNOSIS AND THERAPY OF HEMATOLOGICAL MALIGNANCIES

CROSS-REFERENCES TO RELATED APPLICATIONS

This application is a continuation of U.S. patent application Ser. No. 10/057,475, filed Jan. 22, 2002, which is a continuation-in-part of U.S. patent application Ser. No. 10/040,862, filed Nov. 6, 2001, which is a continuation-in-part of U.S. patent application Ser. No. 09/796,692, filed Mar. 1, 2001, which application claims the benefit under 37 U.S.C. §119(e) of U.S. Provisional Patent Application No. 60/186,126, filed Mar. 1, 2000; Provisional Patent Application No. 60/190,479, filed Mar. 17, 2000; Provisional Patent Application No. 60/200,545, filed Apr. 27, 2000; Provisional Patent Application No. 60/200,303, filed Apr. 28, 2000; Provisional Patent Application No. 60/200,779, filed Apr. 28, 2000; Provisional Patent Application No. 60/200,999; filed May 1, 2000; Provisional Patent Application No. 60/202,084, filed May 4, 2000; Provisional Patent Application No. 60/206,201, filed May 22, 2000; Provisional Patent Application No. 60/218,950, filed Jul. 14, 2000; Provisional Patent Application No. 60/222,903, filed Aug. 3, 2000; Provisional Patent Application No. 60/223,416, filed Aug. 4, 2000; and Provisional Patent Application No. 60/223,378, filed Aug. 7, 2000. This application also claims the benefit of PCT/US01/07272, filed Mar. 1, 2001. All of the above applications are incorporated herein by reference in their entireties.

STATEMENT REGARDING SEQUENCE LISTING SUBMITTED ON CD-ROM

The Sequence Listing associated with this application is provided on CD-ROM in lieu of a paper copy, and is hereby incorporated by reference into the specification. Three CD-ROMs are provided, containing identical copies of the sequence listing: CD-ROM No. 1 is labeled COPY 1, contains the file 494c5.app.txt which is 6.14 MB and created on Sep. 29, 2006; CD-ROM No. 2 is labeled COPY 2, contains the file 494c5.app.txt which is 6.14 MB and created on Sep. 29, 2006; CD-ROM No. 3 is labeled CRF (Computer Readable Form), contains the file 494c5.app.txt which is 6.14 MB and created on Sep. 29, 2006.

1. BACKGROUND OF THE INVENTION 1.1 Field of the Invention

The present invention relates generally to the fields of cancer diagnosis and therapy. More particularly, it concerns the surprising discovery of compositions and methods for the detection and immunotherapy of hematological malignancies, and particularly, B cell leukemias, and lymphomas and multiple myelomas. The invention provides new, effective methods, compositions and kits for eliciting immune and T-cell response to antigenic polypeptides, and antigenic peptide fragments isolated therefrom, and methods for the use of such compositions for diagnosis, detection, treatment, monitoring, and/or prevention of various types of human hematological malignancies. In particular, the invention provides polypeptide, peptide, antibody, antigen binding fragment, hybridoma, host cell, vector, and polynucleotide compounds and compositions for use in identification and discrimination between various types of hematological malignancies, and methods for the detection, diagnosis, prognosis, monitoring, and therapy of such conditions in an affected animal.

1.2 Description of Related Art 1.2.1 Hematological Malignancies

Hematological malignancies, such as leukemias and lymphomas, are conditions characterized by abnormal growth and maturation of hematopoietic cells. Leukemias are generally neoplastic disorders of hematopoietic stem cells, and include adult and pediatric acute myeloid leukemia (AML), chronic myeloid leukemia (CML), acute lymphocytic leukemia (ALL), chronic lymphocytic leukemia (CLL) and secondary leukemia. Among lymphomas, there are two distinct groups: non-Hodgkin's lymphoma (NHL) and Hodgkin's disease. NHLs are the result of a clonal expansion of B- or T-cells, but the molecular pathogenesis of Hodgkin's disease, including lineage derivation and clonality, remains obscure. Other hematological malignancies include myelodysplastic syndromes (MDS), myeloproliferative syndromes (MPS) and myeloma. Hematological malignancies are generally serious disorders, resulting in a variety of symptoms, including bone marrow failure and organ failure.

NHLs are the sixth most common cause of cancer related deaths in the United States. Only prostate, breast, lung, colorectal and bladder cancer currently exceed lymphoma in annual incidence. In 1995, more than 45,000 new NHLs were diagnosed, and over 21,000 patients died of these diseases. The average age of lymphoma patients is relatively young (42 years), and the resulting number of years of life lost to these diseases renders NHLs fourth in economic impact among cancers in the United States. In the past 15 years, the American Cancer Society reported a 50% increase in the incidence of NHLs, one of the largest increases for any cancer group. Much of this increase has been attributed to the development of lymphomas in younger men who have acquired AIDS. Lymphomas are also the third most common childhood malignancy and account for approximately 10% of cancers in children. The survival rate (all ages) varies from 73% (low risk) to 26% (high risk).

1.3 Deficiencies in the Prior Art

Treatment for many hematological malignancies, including leukemias and lymphomas, remains difficult, and existing therapies are not universally effective. While treatments involving specific immunotherapy appear to have considerable potential, such treatments have been limited by the small number of known malignancy-associated antigens. Moreover the ability to detect such hematological malignancies in their early stages can be quite difficult depending upon the particular malady. The lack of a sufficient number of specific diagnostic and prognostic markers of the diseases, and identification of cells and tissues that can be affected, has significantly limited the field of oncology.

Accordingly, there remains a need in the art for improved methods for detecting, screening, diagnosis and treatment of hematological malignancies such as B cell leukemias and lymphomas and multiple myelomas. The present invention fulfills these and other inherent needs in the field, and provides significant advantages in the detection of cells, and cell types that express one or more polypeptides that have been shown to be over-expressed in one or more of such hematological malignancies.

2. SUMMARY OF THE INVENTION

The present invention addresses the foregoing long-felt need and other deficiencies in the art by identifying new and effective strategies for the identification, detection, screening, diagnosis, prognosis, prophylaxis, therapy, and immunomodulation of one or more hematological malignancies, and in particular, B cell leukemias and lymphomas, and multiple myelomas.

The present invention is based, in part, upon the surprising and unexpected discovery that certain previously unknown or unidentified human polypeptides, peptides, and antigenic fragments derived therefrom have now been identified that are overexpressed in one or more types of hematological malignancies. The genes encoding several of these polypeptides are now identified and obtained in isolated form, and have been characterized using a series of molecular biology methodologies including subtractive library analysis, microarray screening, polynucleotide sequencing, peptide and epitopic identification and characterization, as well as expression profiling, and in vitro whole gene cell priming. A set of these polynucleotides, and the polypeptides, peptides, and antigenic fragments they encode are now identified and implicated in the complex processes of hematological malignancy disease onset, progression, and/or outcome, and in particular, diseases such as leukemias and lymphomas.

The inventors have further demonstrated that a number of these polynucleotides, and their encoded polypeptides, as well as antibodies, antigen presenting cells, T cells, and the antigen binding fragments derived from such antibodies are useful in the development of particularly advantageous compositions and methods for the detection, diagnosis, prognosis, prophylaxis and/or therapy of one or more of these diseases, and particularly those conditions that are characterized by (a) an increased, altered, elevated, or sustained expression of one or more polynucleotides that comprise at least a first sequence region that comprises a nucleic acid sequence as disclosed in any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480 or (b) an increased, altered, elevated, or sustained biological activity of one or more polypeptides that comprise at least a first sequence region that comprises an amino acid sequence as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968.

The present invention also provides methods and uses for one or more of the disclosed peptide, polypeptide, antibody, antigen binding fragment, and polynucleotide compositions of the present invention in generating an immune response or in generating a T-cell response in an animal, and in particular in a mammal such as a human. The invention also provides methods and uses for one or more of these compositions in the identification, detection, and quantitation of hematological malignancy compositions in clinical samples, isolated cells, whole tissues, and even affected individuals. The compositions and methods disclosed herein also may be used in the preparation of one or more diagnostic reagents, assays, medicaments, or therapeutics, for diagnosis and/or therapy of such diseases.

In a first important embodiment, there is provided a composition comprising at least a first isolated peptide or polypeptide that comprises an amino acid sequence that is at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, or about 99% identical to the amino acid sequence encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968. Exemplary preferred sequences are those that comprise at least a first coding region that comprises an amino acid sequence that is at least about 85%, about 86%, about 87%, about 88%, about 89%, about 90%, about 91%, about 92%, about 93%, or about 94% identical to the amino acid sequence as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, with those sequences that comprise at least a first coding region that comprises an amino acid sequence that is at least about 95%, about 96%, about 97%, about 98%, or about 99% identical to the amino acid sequence as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968 being examples of particularly preferred sequences in the practice of the present invention. Likewise, peptide and polypeptide compounds and compositions are also provided that comprise, consist essentially of, or consist of the amino acid sequence as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968.

In a similar fashion, there are also embodiments disclosed herein that provide compositions and methods for the detection, diagnosis, prognosis, prophylaxis, treatment, and therapy of B cell leukemia, lymphoma and multiple myeloma. Exemplary preferred peptide and polypeptide compounds and compositions relating to this aspect of the invention include, but are not limited to, those peptide and polypeptide compounds or compositions that comprise at least a first isolated peptide or polypeptide that comprises an amino acid sequence that is at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, or about 99% identical to the amino acid sequence as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, and those that comprise at least a first coding region that comprises an amino acid sequence that is at least about 85%, about 86%, about 87%, about 88%, about 89%, about 90%, about 91%, about 92%, about 93%, or about 94% identical to the amino acid sequence as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, and even those sequences that comprise at least a first coding region that comprises an amino acid sequence that is at least about 95%, about 96%, about 97%, about 98%, or about 99% identical to the amino acid sequence as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968.

Exemplary peptides of the present invention may be of any suitable length, depending upon the particular application thereof, and encompass those peptides that are about 9, about 10, about 15, about 20, about 25, about 30, about 35, about 40, about 45, about 50, about 55, about 60, about 65, about 70, about 75, about 80, about 85, about 90, about 95, or about 100 or so amino acids in length. Of course, the peptides of the invention may also encompass any intermediate lengths or integers within the stated ranges.

Exemplary polypeptides and proteins of the present invention may be of any suitable length, depending upon the particular application thereof, and encompass those polypeptides and proteins that are about 100, about 150, about 200, about 250, about 300, about 350, or about 400 or so amino acids in length. Of course, the polypeptides and proteins of the invention may also encompass any intermediate lengths or integers within the stated ranges.

The peptides, polypeptides, proteins, antibodies, and antigen binding fragments of the present invention will preferably comprise a sequence of at least about 5, 10, 15, 20, 25, 30, 35, 40, 45, 50, 55, 60, 65, 70, 75, 80, 85, 90, 95 or 100 contiguous amino acids from any one of the peptides as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968.

Furthermore, the polypeptides, proteins, antibodies, and antigen binding fragments of the present invention will even more preferably comprise at least a first isolated coding region that comprises a sequence of at least about 100, 110, 120, 130, 140, 150, 160, 170, 180, 190, or 200 contiguous amino acids from any one of the peptides as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968.

Likewise, the polypeptides, proteins, antibodies, and antigen binding fragments of the present invention may comprise at least a first isolated coding region that comprises a substantially longer sequence, such as for example, one of at least about 200, 220, 240, 260, 280, or 300 or more contiguous amino acids from any one of the peptides as encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968.

In illustrative embodiments, and particularly in those embodiments concerning methods and compositions relating to B cell leukemias, lymphomas and multiple myelomas, the polypeptides of the invention comprise an amino acid sequence that (a) comprises, (b) consists essentially of, or (c) consists of, the amino acid sequence encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968.

The polypeptides and proteins of the invention preferably comprise an amino acid sequence that is encoded by at least a first nucleic acid segment that comprises an at least 21, 22, 23, 24, 25, 26, 27, 28, 29, or 30 contiguous nucleotide sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480.

The polypeptides and proteins of the invention may also preferably comprise an amino acid sequence encoded by at least a first nucleic acid segment that comprises an at least about 31, 32, 33, 34, 35, 36, 37, 38, 39, or 40 contiguous nucleotide sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480. The polypeptides and proteins of the invention may also preferably comprise one or more coding regions that comprise an amino acid sequence encoded by at least a first nucleic acid segment that comprises an at least about 41, 42, 43, 44, 45, 46, 47, 48, 49, or 50 contiguous nucleotide sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480. The polypeptides and proteins of the invention may also preferably comprise one or more coding regions that comprise an amino acid sequence encoded by at least a first nucleic acid segment that comprises an at least about 51, 52, 53, 54, 55, 56, 57, 58, 59, or 60 contiguous nucleotide sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480. The polypeptides and proteins of the invention may also preferably comprise one or more coding regions that comprise an amino acid sequence encoded by at least a first nucleic acid segment that comprises an at least about 70, 80, 90, 100, 110, 120, 130, 140 or 150 contiguous nucleotide sequence of any one of SEQ ID NOs: 10,486-10,536; SEQ ID NOs:10,537-10,580; SEQ ID NOs: 10,581-10,596; SEQ ID NO:10,597; SEQ ID NO:10,845; SEQ ID NO:10,846; SEQ ID NO:10,970; SEQ ID NO:10, 971; SEQ ID NO:10,972; SEQ ID NO:10,973; SEQ ID NO:10,974; SEQ ID NO:10,469, SEQ ID NO:10,470; and SEQ ID NO:10,480. The polypeptides and proteins of the invention may also preferably comprise one or more coding regions that comprise an amino acid sequence encoded by at least a first nucleic acid segment that comprises an at least about 175, 200, 225, 250, 275, 300, 325, 350, 375, or 400 contiguous nucleotide sequence of any one of SEQ ID NOs: 10,486-10,536; SEQ ID NOs:10,537-10,580; SEQ ID NOs: 10,581-10,596; SEQ ID NO:10,597; SEQ ID NO:10,845; SEQ ID NO:10,846; SEQ ID NO:10,970; SEQ ID NO:10, 971; SEQ ID NO:10,972; SEQ ID NO:10,973; SEQ ID NO:10,974; SEQ ID NO:10,469, SEQ ID NO:10,470; and SEQ ID NO:10,480. The polypeptides and proteins of the invention may also preferably comprise one or more coding regions that comprise an amino acid sequence encoded by at least a first nucleic acid segment that comprises an at least about 500, 600, 700, 800, 900, 1000, 1100, 1200, 1300, 1400, or 1500 contiguous nucleotide sequence of any one of SEQ ID NOs:10,486-10,536; SEQ ID NOs:10,537-10,580; SEQ ID NOs:10,581-10,596; SEQ ID NO:10,597; SEQ ID NO:10, 845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480.

In a second important embodiment, there is provided a composition comprising at least a first isolated polynucleotide that comprises a nucleic acid sequence that is at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, or about 99% identical to the nucleic acid sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480. Exemplary preferred sequences are those that comprise a nucleic acid sequence that is at least about 85%, about 86%, about 87%, about 88%, about 89%, about 90%, about 91%, about 92%, about 93%, or about 94% identical to the nucleic acid sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480, with those sequences that comprise at least a nucleic acid sequence that is at least about 95%, about 96%, about 97%, about 98%, or about 99% identical to the nucleic acid sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480 being examples of particularly preferred sequences in the practice of the present invention.

In embodiments that relate particularly to compositions and methods for the detection, diagnosis, prognosis, prophylaxis, treatment, and therapy of B cell leukemias, lymphomas, and multiple myelomas exemplary preferred polynucleotide compositions include those compositions that comprise at least a first isolated nucleic acid segment that comprises a sequence that is at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, or about 99% identical to the nucleic acid sequence of any one of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480. Such polynucleotides will preferably comprise one or more isolated coding region, each of which may (a) comprise, (b) consist essentially of, or (c) consist of, the nucleic acid sequence of SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480.

Exemplary polynucleotides of the present invention may be of any suitable length, depending upon the particular application thereof, and encompass those polynucleotides that (a) are at least about, or (b) comprise at least a first isolated nucleic acid segment that is at least about 27, 30, 40, 50, 60, 70, 80, 90, 100, 110, 120, 120, 140, 150, 160, 170, 180, 190, 200, 210, 220, 230, 240, 250, 260, 270, 280, 290, 300, 320, 340, 360, 380, 400, 420, 440, 460, 480, 500, 520, 540, 560, 580, 600, 625, 650, 675, 700, 750, 800, 850, 900, 950, or 1000 or so nucleic acids in length, as well as longer polynucleotides that (a) are at least about, or (b) comprise at least a first isolated nucleic acid segment that is at least about 1000, 1025, 1050, 1075, 1100, 150, 1200, 1250, 1300, 1350, 1400, 1450, 1500, 1550, 1600, 1650, 1700, 1750, 1800, 1850, 1900, 1950, 2000, 2100, 2200, 2300, 2400, 2500, 2600, 2700, 2800, 2900, or 3000 or so nucleic acids in length, as well as substantially larger polynucleotides. Of course, the polynucleotides and nucleic acid segments of the invention may also encompass any intermediate lengths or integers within the stated ranges.

The compositions of the present invention may comprise a single polypeptide or polynucleotide, or alternatively, may comprise two or more such hematological malignancy compounds, such as for example, two or more polypeptides, two or more polynucleotides, or even combinations of one or more peptides or polypeptides, along with one or more polynucleotides. When two or more polypeptides are contemplated for particular applications, the second and/or third and/or fourth, etc. isolated peptides and/or polypeptides will preferably comprise an amino acid sequence that is at least about 91%, 93%, 95%, 97%, or 99% identical to the amino acid sequence encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968. Alternatively, the polynucleotides of the invention may comprise one or more coding regions that encode a first fusion protein or peptide, such as an adjuvant-coding region fused in correct reading frame to one or more of the disclosed hematological malignancy peptides or polypeptides. Alternatively, the fusion protein may comprise a hematological malignancy polypeptide or peptide fused, in correct reading frame, to a detectable protein or peptide, or to an immunostimulant protein or peptide, or other such construct. Fusion proteins such as these are particularly useful in those embodiments relating to diagnosis, detection, and therapy of one or more of the hematological malignancies as discussed herein.

The invention also provides a composition comprising at least a first hybridoma cell line that produces a monoclonal antibody having immunospecificity for one or more of the peptides or polypeptides as disclosed herein, or at least a first monoclonal antibody, or an antigen-binding fragment thereof, that has immunospecificity for such a peptide or polypeptide. The antigen binding fragments may comprise a light chain variable region, a heavy-chain variable region, a Fab fragment, a F(ab)$_2$ fragment, an Fv fragment, an scFv fragment, or an antigen-binding fragment of such an antibody.

The invention also provides a composition comprising at least a first isolated antigen-presenting cell that expresses a peptide or polypeptide as disclosed herein, or a plurality of isolated T cells that specifically react with such a peptide or polypeptide. Such pluralities of isolated T cells may be stimulated or expanded by contacting the T cells with one or more peptides or polypeptides as described herein. The T cells may be cloned prior to expansion, and may be obtained from bone marrow, a bone marrow fraction, peripheral blood, or a peripheral blood fraction from a healthy mammal, or from a mammal that is afflicted with at least a first hematological malignancy such as leukemia or lymphoma.

As described above, the isolated polypeptides of the invention may be on the order of from 9 to about 1000 amino acids in length, or alternatively, may be on the order of from 50 to about 900 amino acids in length, from 75 to about 800 amino acids in length, from 100 to about 700 amino acids in length, or from 125 to about 600 amino acids in length, or any other such suitable range.

The isolated nucleic acid segments that encode such isolated polypeptides may be on the order of from 27 to about 10,000 nucleotides in length, from 150 to about 8000 nucleotides in length, from 250 to about 6000 nucleotides in length, from 350 to about 4000 nucleotides in length, or from 450 to about 2000 nucleotides in length, or any other such suitable range.

The nucleic acid segment may be operably positioned under the control of at least a first heterologous, recombinant promoter, such as a tissue-specific, cell-specific, inducible, or otherwise regulated promoter. Such promoters may be further controlled or regulated by the presence of one or more additional enhancers or regulatory regions depending upon the particular cell type in which expression of the polynucleotide is desired. The polynucleotides and nucleic acid segments of the invention may also be comprised within a vector, such as a plasmid, or viral vector. The polypeptides and polynucleotides of the invention may also be comprised within a host cell, such as a recombinant host cell, or a human host cell such as a blood or bone marrow cell.

The polynucleotides of the invention may comprise at least a first isolated nucleic acid segment operably attached, in frame, to at least a second isolated nucleic acid segment, such that the polynucleotide encodes a fusion protein in which the first peptide or polypeptide is linked to the second peptide or polypeptide.

The polypeptides of the present invention may comprise a contiguous amino acid of any suitable length, such as for example, those of about 2000, about 1900, about 1850, about 1800, about 1750, about 1700, about 1650, about 1600, about 1550, about 1500, about 1450, about 1400, about 1350, about 1300, about 1250, about 1200, about 1150, about 1100 amino acids, or about 1000 or so amino acids in length. Likewise, the polypeptides and peptides of the present invention may comprise slightly shorter contiguous amino acid coding regions, such as for example, those of about 950, about 900, about 850, about 800, about 750, about 700, about 650, about 600, about 550, about 500, about 450, about 400, about 350, about 300, about 250, about 200, about 150, or even about 100 amino acids or so in length.

In similar fashion, the polypeptides and peptides of the present invention may comprise even smaller contiguous amino acid coding regions, such as for example, those of about 95, about 90, about 85, about 80, about 75, about 70, about 65, about 60, about 55, about 50, about 45, about 40, about 35, about 30, about 25, about 20, about 15, or even about 9 amino acids or so in length.

In all such embodiments, those peptides and polypeptides having intermediate lengths including all integers within the preferred ranges (e.g., those peptides and polypeptides that comprise at least a first coding region of at least about 94, about 93, about 92, about 91, about 89, about 88, about 87, about 86, about 84, about 83, about 82, about 81, about 79, about 78, about 77, about 76, about 74, about 73, about 72, about 71, about 69, about 68, about 67, about 66 or so amino acids in length, etc.) are all contemplated to fall within the scope of the present invention.

In particular embodiments, the peptides and polypeptides of the present invention may comprise a sequence of at least about 9, or about 10, or about 11, or about 12, or about 13, or about 14, or about 15, or about 16, or about 17, or about 18, or about 19, or about 20, or about 21, or about 22, or about 23, or about 24, or about 25, or about 26, or about 27, or about 28, or about 29, or about 30, or about 31, or about 32, or about 33, or about 34, or about 35, or about 36, or about 37, or about 38, or about 39, or about 40, or about 41, or about 42, or about 43, or about 44, or about 45, or about 46, or about 47, or about 48, or about 49, or about 50 contiguous amino acids as disclosed in any one or more of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968 herein.

In other embodiments, the peptides and polypeptides of the present invention may comprise a sequence of at least about 51, or about 52, or about 53, or about 54, or about 55, or about 56, or about 57, or about 58, or about 59, or about 60, or about 61, or about 62, or about 63, or about 64, or about 65, or about 66, or about 67, or about 68, or about 69, or about 70, or about 71, or about 72, or about 73, or about 74, or about 75, or about 76, or about 77, or about 78, or about 79, or about 80, or about 81, or about 82, or about 83, or about 84, or about 85, or about 86, or about 87, or about 88, or about 89, or about 90, about 91, or about 92, or about 93, or about 94, or about 95, or about 96, or about 97, or about 98, or about 99, or 100 contiguous amino acids as disclosed in any one or more of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968 herein.

In still other embodiments, the preferred peptides and polypeptides of the present invention comprise a sequence of at least about 100, 125, 150, 175, 200, 225, 250, 275, 300, 325, 350, 375, or 400 or more contiguous amino acids as disclosed in any one or more of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968 herein.

The polypeptides of the invention typically will comprise at least a first contiguous amino acid sequence according to any one of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, but may also, optionally comprise at least a second, at least a third, or even at least a fourth or greater contiguous amino acid sequence according to any one of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968. A single polypeptide may contain only a single coding region, or alternatively, a single polypeptide may comprise a plurality of identical or distinctly different contiguous amino acid sequences in accordance with any one of the peptides encoded by any one of the above polynucleotides or disclosed in any one of SEQ ID NOs:10,471-10,474; SEQ ID NO: 10,481; SEQ ID NOs:10,599-10,819; SEQ ID NOs:10,820-10,842; SEQ ID NOs:10,849-10,908; and SEQ ID NOs:10, 909-10,968. In fact, the polypeptide may comprise a plurality of the same contiguous amino acid sequences, or they may comprise one or more different contiguous amino acid sequences of any of the peptides encoded by any one of the above polynucleotides or disclosed in any one of SEQ ID NOs:10,471-10,474; SEQ ID NO:10,481; SEQ ID NOs:10, 599-10,819; SEQ ID NOs:10,820-10,842; SEQ ID NOs:10, 849-10,908; and SEQ ID NOs:10,909-10,968. For example, a single polypeptide can comprise a single contiguous amino acid sequence from one or more of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, or alternatively, may comprise two or more distinctly different contiguous amino acid sequences from one or more of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968. In fact, the polypeptide may comprise 2, 3, 4, or even 5 distinct contiguous amino sequences of any one of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968. Alternatively, a single polypeptide may comprise 2, 3, 4, or even 5 distinct coding regions. For example, a polypeptide may comprise at least a first coding region that comprises a first contiguous amino acid sequence of any one of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, and at least a second coding region that comprises a second contiguous amino acid sequence of any one of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968. In contrast, a polypeptide may comprise at least a first coding region that comprises a first contiguous amino acid sequence of any one of the peptides encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, and at least a second coding region that comprises a second distinctly different peptide or polypeptide, such as for example, an adjuvant or an immunostimulant peptide or polypeptide.

In such cases, the two coding regions may be separate on the same polypeptide, or the two coding regions may be operatively attached, each in the correct reading frame, such that a fusion polypeptide is produced, in which the first amino acid sequence of the first coding region is linked to the second amino acid sequence of the second coding region.

Throughout this disclosure, a phrase such as "a sequence as disclosed in SEQ ID NO:1 to SEQ ID NO:4" is intended to encompass any and all contiguous sequences disclosed by any one of these sequence identifiers. That is to say, "a sequence as disclosed in any of SEQ ID NO:1 through SEQ ID NO:4" means any sequence that is disclosed in any one of SEQ ID NO:1, SEQ ID NO:2, SEQ ID NO:3, or SEQ ID NO:4. Likewise, "a sequence as disclosed in any of SEQ ID NOs:25 to 37" means any sequence that is disclosed in any one of SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, or SEQ ID NO:37, and so forth.

Likewise, a phrase such as "at least a first sequence from any one of SEQ ID NO:55 to SEQ ID NO:62" is intended to refer to a first sequence that is disclosed in any one of SEQ ID NO:55, SEQ ID NO:56, SEQ ID NO:57, SEQ ID NO:58, SEQ ID NO:59, SEQ ID NO:60, SEQ ID NO:61, or SEQ ID NO:62.

It will also be understood that the kits, and compositions of the present invention comprise in an overall and general sense at least one or more particular polynucleotides, polypeptides, and peptides that comprise one or more contiguous sequence regions from one or more of the nucleic acid sequences disclosed herein in SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480 or from one or more of the amino acid sequences encoded by any one of the above polynucleotides or disclosed in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968, and that such peptide, polypeptide and polynucleotide compositions may be used in one or more of the particular methods and uses disclosed herein for the diagnosis, detection, prophylaxis, and therapy of one or more hematological cancers, and in particular, lymphomas of a variety of specific types. It will also be understood to the skilled artisan having benefit of the teachings of the present Specification, that the peptide and polypeptide compositions may be used to generate a T cell or an immune response in an animal, and that such compositions may also be administered to an animal from which immuno-specific antibodies and antigen binding fragments may be isolated or identified that specifically bind to such peptides or polypeptides. Such an artisan will also recognize that the polynucleotides identified by the present disclosure may be used to produce such peptides, polypeptides, antibodies, and antigen binding fragments, by recombinant protein production methodologies that are also within the capability of the skilled artisan having benefit of the specific amino acid and nucleic acid sequences provided herein.

Likewise, it will be understood by a skilled artisan in the field, that one or more of the disclosed compositions may used in one or more diagnostic or detection methodologies to identify certain antibodies, peptides, polynucleotides, or polypeptides in a biological sample, in a host cell, or even within the body or tissues of an animal. It will be understood by a skilled artisan in the field, that one or more of the disclosed nucleic acid or amino acid compositions may used in the preparation or manufacture of one or more medicaments for use in the diagnosis, detection, prognosis, prophylaxis, or therapy of one or more hematological malignancies in an animal, and particularly those malignant conditions disclosed and claimed herein.

It will also be readily apparent to those of skill in the art, that the methods, kits, and uses, of the present invention preferably employ one or more of the compounds and/or compositions disclosed herein that comprise one or more contiguous nucleotide sequences as may be presented in SEQ ID NOs:10,486-10,536; SEQ ID NOs:10,537-10,580; SEQ ID NOs:10,581-10,596; SEQ ID NO:10,597; SEQ ID NO:10,845; SEQ ID NO:10,846; SEQ ID NO:10,970; SEQ ID NO:10,971; SEQ ID NO:10,972; SEQ ID NO:10,973; SEQ ID NO:10,974; SEQ ID NO:10,469, SEQ ID NO:10,470; and SEQ ID NO:10,480 of the attached sequence listing.

Likewise, it will also be readily apparent to those of skill in the art, that the methods, kits, and uses, of the present invention may also employ one or more of the compounds and compositions disclosed herein that comprise one or more contiguous amino acid sequences of any of the peptides encoded by any one of the above polynucleotides or presented in any one of SEQ ID NOs:10,471-10,474; SEQ ID NO:10,481; SEQ ID NOs:10,599-10,819; SEQ ID NOs:10,820-10,842; SEQ ID NOs:10,849-10,908; and SEQ ID NOs:10,909-10,968 of the attached sequence listing.

3. BRIEF DESCRIPTION OF THE DRAWINGS AND THE APPENDICES

The invention may be understood by reference to the following description taken in conjunction with the accompanying drawings, in which like reference numerals identify like elements, and in which:

FIG. 4 illustrates the panel of probes used to identify cDNAs that are overexpressed in lymphoma cells;

FIGS. 5A-5F and 6A-6F illustrate the cDNAs that are highly expressed in lymphoma cells;

Figure 1:
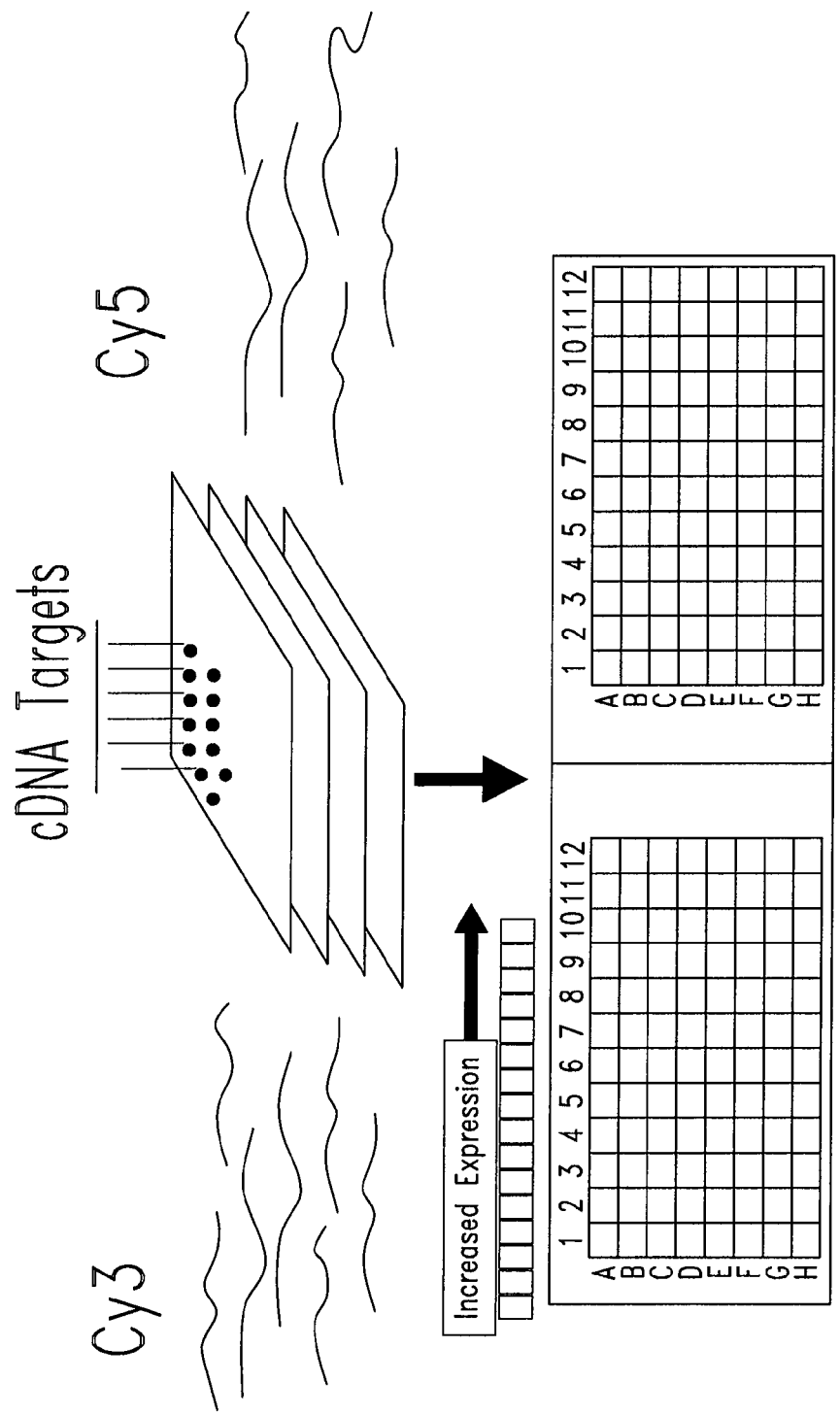
FIG. 1 illustrates a schematic outline of the microarray chip technology approach used to identify the cDNA targets of the present invention as described Section 5.1.
Figure 2:
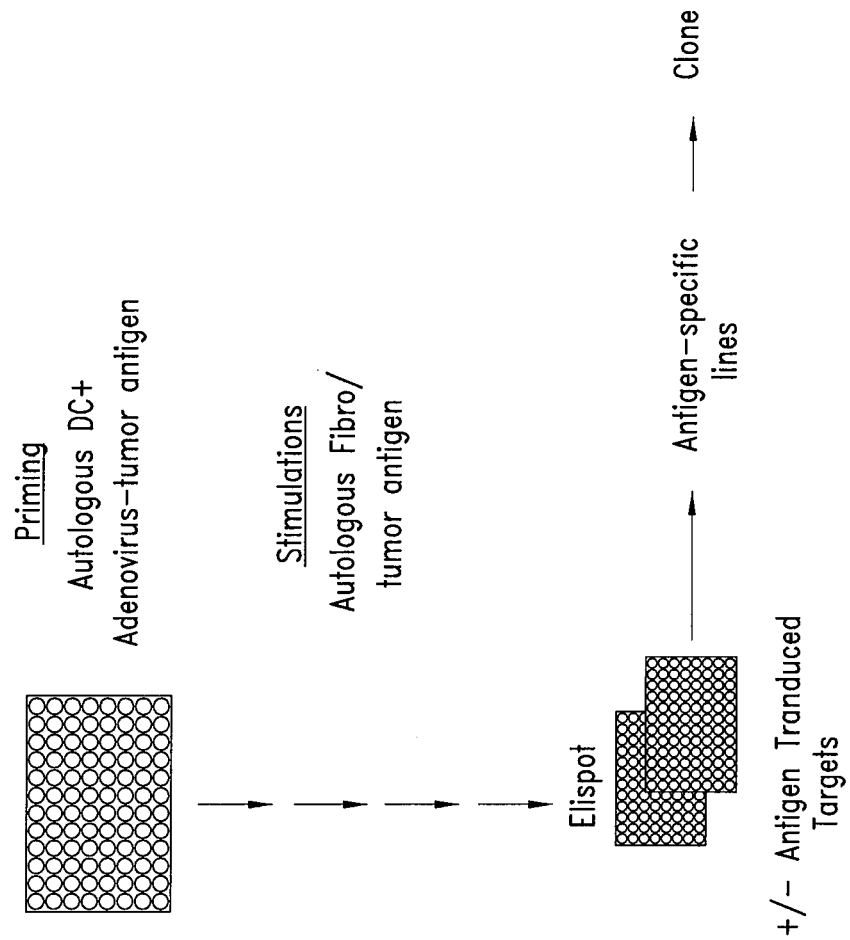
FIG. 2 illustrates a schematic outline of the general protocol for in vitro whole gene CD8$^+$ T cell priming procedure used to generate antigen-specific lines and to identify clones of interest.
Figure 3:
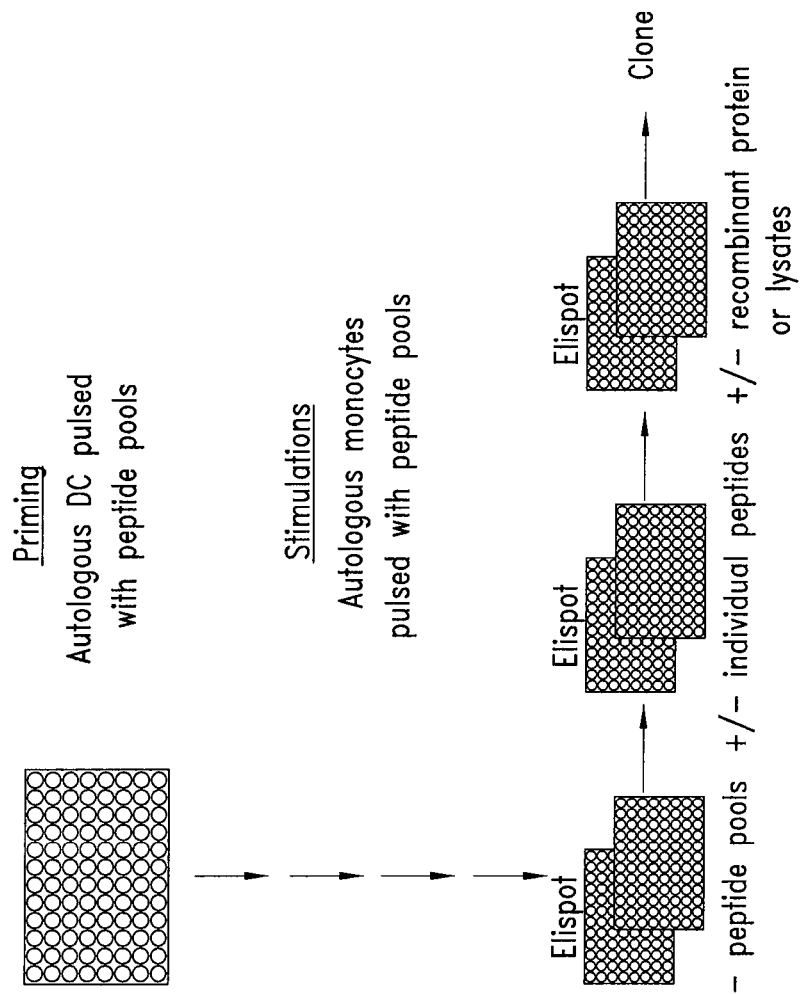
FIG. 3 illustrates a schematic outline of the general protocol for in vitro whole gene CD4$^+$ T cell priming procedure used to generate antigen-specific lines and to identify clones of interest.
Figure 7:
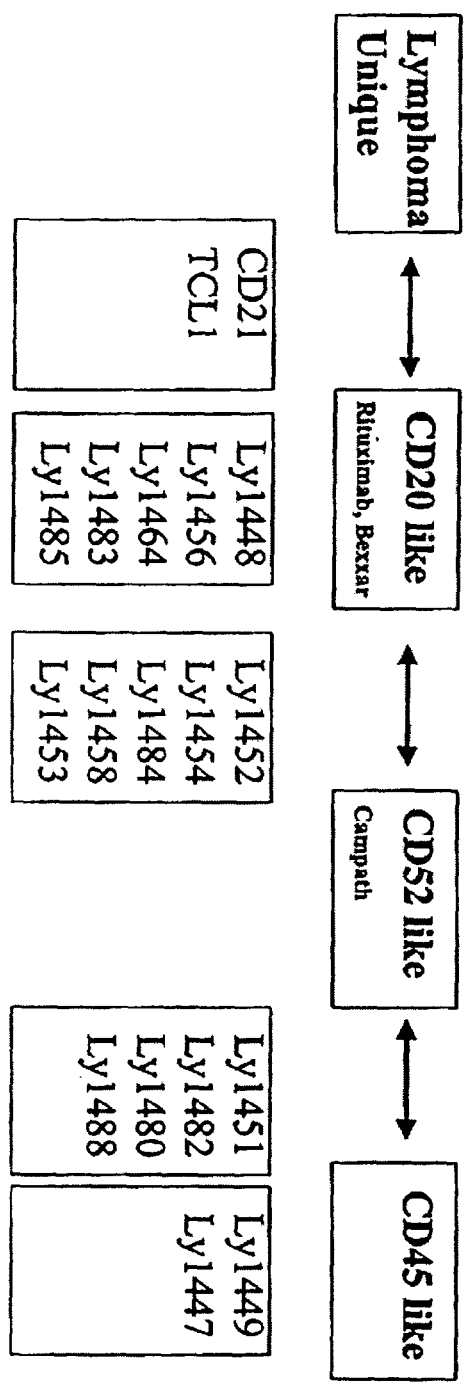

FIG. 7 lists the antigens that have similar tissue expression profiles as the known therapeutics, CD20 and CD52;

FIG. 8 illustrates the expression of the antigens of FIG. 7 in hematopoietic subsets and hematological malignancies as measured by RealTime PCR;

FIG. 9 lists the nucleotide sequences of antigens with similar tissue expression profiles as CD20 and CD52;

FIG. 10 lists the nucleotide and protein sequences of Ly1464;

FIG. 11 illustrates the results of the TMpred report for Ly1464;

FIG. 12 lists the MHC Class binding peptides of Ly1464;

FIG. 13 illustrates the results of analyzing Ly1464 with the TSITES program;

FIG. 14 lists the immunogenic peptides of Ly1464;

FIG. 15 illustrates the laboratory procedure used to synthesize recombinant Ra12-Ly1464;

FIG. 16 lists the Ly1464 nucleotide sequence, the Ra12-Ly1464 nucleotide sequence, the Ra12-Ly1464 amino acid sequence, and the properties of the Ly1464 protein;

FIG. 17 lists Ly1484 nucleotide and amino acid sequences;

FIG. 18 illustrates the results of the TMpred report for Ly1484 long and Ly1484 short;

FIG. 19 lists the MHC class I binding peptides of Ly1484 long;

FIG. 20 lists the MHC class I binding peptides of Ly1484 short;

FIG. 21 illustrates the results of the TSITES analysis of Ly1484 long;

FIG. 22 illustrates the results of the TSITES analysis of Ly1484 short;

FIG. 23 summarizes the attributes of the Lifeseq clone that matches with Ly1456.

Figure 24:
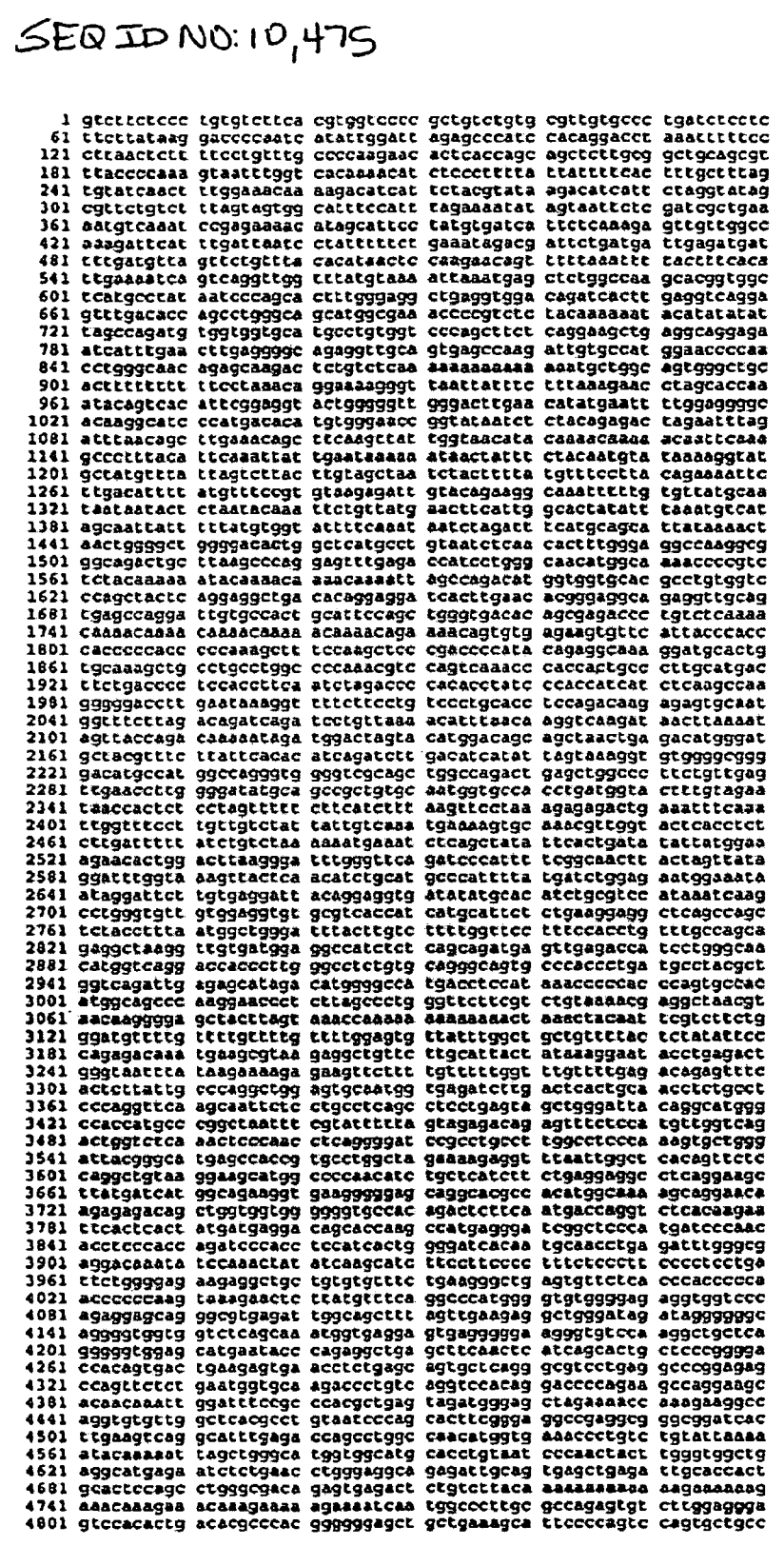

FIG. 24 lists the sequence of GenBank clone on chromosome 15q21 clone b2265b18 (acc. no. AC008131), a clone that matches with Ly1485P.

FIG. 25 lists the sequence of the human secreted protein-encoding gene 9 cDNA clone HTOHB55 SEQ ID NO:1 (acc. no. AAH19210), a clone that matches with Ly1485P.

FIG. 26 lists the sequence of human secreted protein-encoding gene 9 cDNA clone HTOHB55 SEQ ID NO:19 (acc. no. AAH19178) on chromosome 15q21, a clone that matches with Ly1485P.

FIG. 27 lists the nucleotide and amino acid sequences of Ly1488;

FIG. 28 illustrates the results of the TMpred analysis of Ly1488;

FIG. 29 lists the nucleotide sequence for the lung cancer associated polynucleotide sequence SQID 265 (Genseq accession number AAF18246), a clone that matches the Ly1449 and Ly1480 sequences.

FIG. 30 lists the nucleotide sequence for the *homo sapiens* Genbank clone on chromosome 17 clone RP11-956N15 (accession number AC021581), a clone that matches the Ly1449 and Ly1480 sequences.

FIG. 31 illustrates the presence of Ly1448-specific serum antibodies in lymphoma patients.

Figure 32:
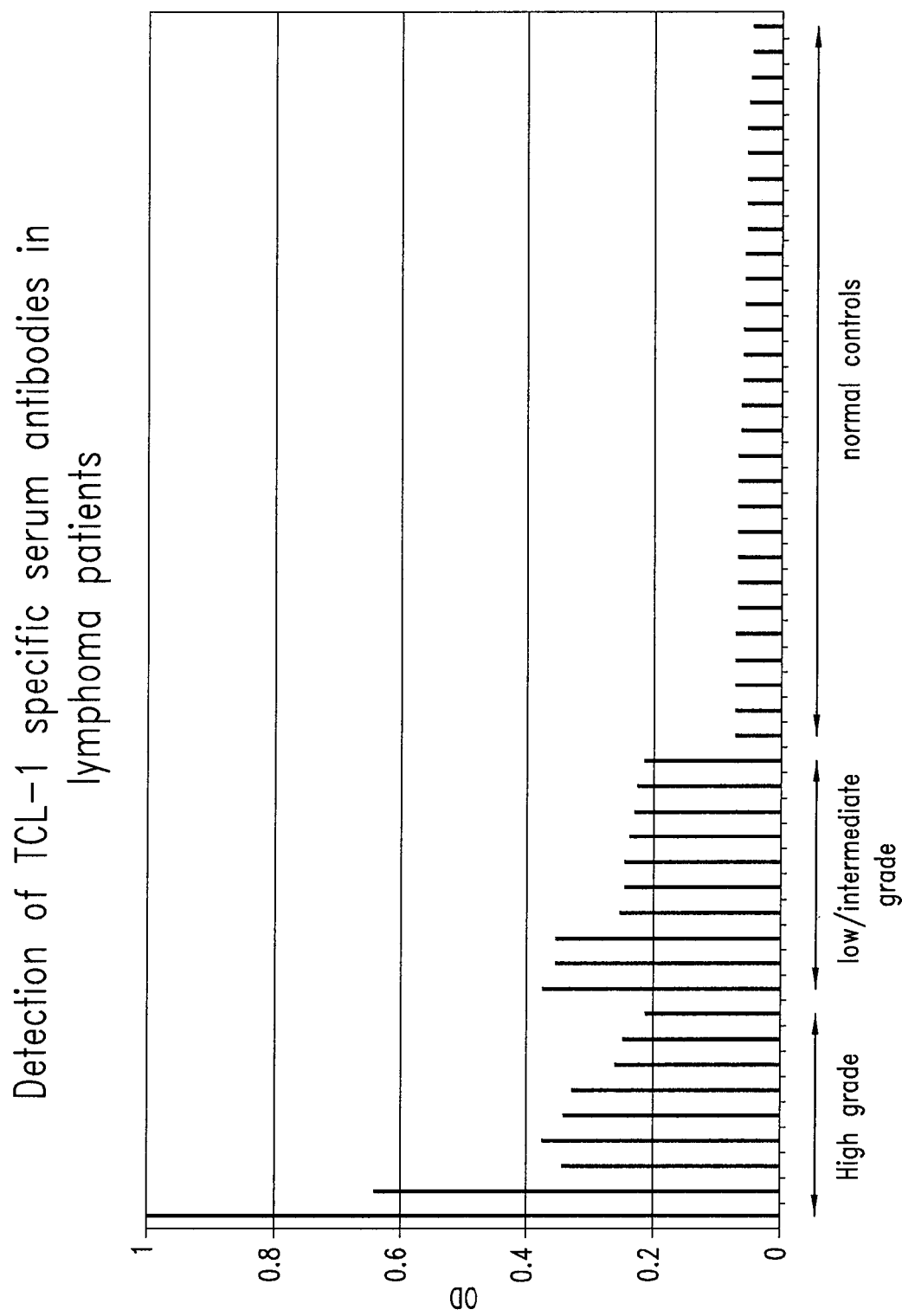

FIG. 32 illustrates the presence of TCL-1-specific serum antibodies in lymphoma patients.

4. DESCRIPTION OF ILLUSTRATIVE EMBODIMENTS

In order that the invention herein described may be more fully understood, the following description of various illustrative embodiments is set forth.

The present invention is generally directed to compositions and methods for the immunotherapy and diagnosis of Hematological malignancies, such as B cell leukemias and lymphomas and multiple myelomas.

4.1 Methods of Nucleic Acid Delivery and DNA Transfection

In certain embodiments, it is contemplated that one or more RNA or DNA and/or substituted polynucleotide compositions disclosed herein will be used to transfect an appropriate host cell. Technology for introduction of RNAs and DNAs, and vectors comprising them into suitable host cells is well known to those of skill in the art. In particular, such polynucleotides may be used to genetically transform one or more host cells, when therapeutic administration of one or more active peptides, compounds or vaccines is achieved through the expression of one or more polynucleotide constructs that encode one or more therapeutic compounds of interest.

A variety of means for introducing polynucleotides and/or polypeptides into suitable target cells is known to those of skill in the art. For example, when polynucleotides are contemplated for delivery to cells, several non-viral methods for the transfer of expression constructs into cultured mammalian cells are available to the skilled artisan for his use. These include, for example, calcium phosphate precipitation (Graham and Van Der Eb, 1973; Chen and Okayama, 1987; Rippe et al., 1990); DEAE-dextran precipitation (Gopal, 1985); electroporation (Wong and Neumann, 1982; Fromm et al., 1985; Tur-Kaspa et al., 1986; Potter et al., 1984; Suzuki et al., 1998; Vanbever et al., 1998), direct microinjection (Capecchi, 1980; Harland and Weintraub, 1985), DNA-loaded liposomes (Nicolau and Sene, 1982; Fraley et al., 1979; Takakura, 1998) and lipofectamine-DNA complexes, cell sonication (Fechheimer et al., 1987), gene bombardment using high velocity microprojectiles (Yang et al., 1990; Klein et al., 1992), and receptor-mediated transfection (Curiel et al., 1991; Wagner et al., 1992; Wu and Wu, 1987; Wu and Wu, 1988). Some of these techniques may be successfully adapted for in vivo or ex vivo use.

A bacterial cell, a yeast cell, or an animal cell transformed with one or more of the disclosed expression vectors represent an important aspect of the present invention. Such transformed host cells are often desirable for use in the expression of the various DNA gene constructs disclosed herein. In some aspects of the invention, it is often desirable to modulate, regulate, or otherwise control the expression of the gene segments disclosed herein. Such methods are routine to those of skill in the molecular genetic arts. Typically, when increased or over-expression of a particular gene is desired, various manipulations may be employed for enhancing the expression of the messenger RNA, particularly by using an active promoter, and in particular, a tissue-specific promoter such as those disclosed herein, as well as by employing sequences, which enhance the stability of the messenger RNA in the particular transformed host cell.

Typically, the initiation and translational termination region will involve stop codon(s), a terminator region, and optionally, a polyadenylation signal. In the direction of transcription, namely in the 5' to 3' direction of the coding or sense sequence, the construct will involve the transcriptional regulatory region, if any, and the promoter, where the regulatory region may be either 5' or 3' of the promoter, the ribosomal binding site, the initiation codon, the structural gene having an open reading frame in phase with the initiation codon, the stop codon(s), the polyadenylation signal sequence, if any, and the terminator region. This sequence as a double strand may be used by itself for transformation of a microorganism or eukaryotic host, but will usually be included with a DNA sequence involving a marker, where the second DNA sequence may be joined to the expression construct during introduction of the DNA into the host.

Where no functional replication system is present, the construct will also preferably include a sequence of at least about 30 or about 40 or about 50 base pairs (bp) or so, preferably at least about 60, about 70, about 80, or about 90 to about 100 or so bp, and usually not more than about 500 to about 1000 or so bp of a sequence homologous with a sequence in the host. In this way, the probability of legitimate recombination is enhanced, so that the gene will be integrated into the host and stably maintained by the host. Desirably, the regulatory regions of the expression construct will be in close proximity to (and also operably positioned relative to) the selected therapeutic gene providing for complementation as well as the gene providing for the competitive advantage. Therefore, in the event that the therapeutic gene is lost, the resulting organism will be likely to also lose the gene providing for the competitive advantage, so that it will be unable to compete in the environment with the gene retaining the intact construct.

The selected therapeutic gene can be introduced between the transcriptional and translational initiation region and the transcriptional and translational termination region, so as to be under the regulatory control of the initiation region. This construct may be included in a plasmid, which will include at least one replication system, but may include more than one, where one replication system is employed for cloning during the development of the plasmid and the second replication system is necessary for functioning in the ultimate host, in this case, a mammalian host cell. In addition, one or more markers may be present, which have been described previously. Where integration is desired, the plasmid will desirably include a sequence homologous with the host genome.

Genes or other nucleic acid segments, as disclosed herein, can be inserted into host cells using a variety of techniques that are well known in the art. Five general methods for delivering a nucleic segment into cells have been described: (1) chemical methods (Graham and Van Der Eb, 1973); (2) physical methods such as microinjection (Capecchi, 1980), electroporation (U.S. Pat. No. 5,472,869; Wong and Neumann, 1982; Fromm et al., 1985), microprojectiles bombardment (U.S. Pat. No. 5,874,265, specifically incorporated herein by reference in its entirety), "gene gun" (Yang et al., 1990); (3) viral vectors (Eglitis and Anderson, 1988); (4) receptor-mediated mechanisms (Curiel et al., 1991; Wagner et al., 1992); and (5) bacterial-mediated transformation.

4.2 Hematological Malignancy Related-Specific Antibodies and Antigen-Binding Fragments Thereof The present invention further provides antibodies and antigen-binding fragments thereof, that specifically bind to (or are immunospecific for) at least a first peptide or peptide variant as disclosed herein. As used herein, an antibody or an antigen-binding fragment is said to "specifically bind" to a peptide if it reacts at a detectable level (within, for example, an ELISA) with the peptide, and does not react detectably with unrelated peptides or proteins under similar conditions. As used herein, "binding" refers to a non-covalent association between two separate molecules such that a "complex" is formed. The ability to bind may be evaluated by, for example, determining a binding constant for the formation of the complex. The binding constant is the value obtained when the concentration of the complex is divided by the product of the component concentrations. In the context of the present invention, in general, two compounds are said to "bind" when the binding constant for complex formation exceeds about $10^3$ L/mol. The binding constant maybe determined using methods well known in the art.

Any agent that satisfies the above requirements may be a binding agent. In illustrative embodiments, a binding agent is an antibody or an antigen-binding fragment thereof. Such antibodies may be prepared by any of a variety of techniques known to those of ordinary skill in the art (Harlow and Lane, 1988). In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the peptide is initially injected into any of a wide variety of mammals (e.g., mice, rats, rabbits, sheep or goats). In this step, the peptides of this invention may serve as the immunogen without modification. Alternatively, particularly for relatively short peptides, a superior immune response may be elicited if the peptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the peptide may then be purified from such antisera by, for example, affinity chromatography using the peptide coupled to a suitable solid support.

Monoclonal antibodies specific for the antigenic peptide of interest may be prepared, for example, using the technique of Kohler and Milstein (1976) and improvements thereto. Briefly, these methods involve the preparation of immortal cell lines capable of producing antibodies having the desired specificity (i.e., reactivity with the peptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the peptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The peptides of this invention may be used in the purification process in, for example, an affinity chromatography step.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, 1988) and digested by papain to yield Fab and Fc fragments. The Fab and Fc fragments may be separated by affinity chromatography on Protein A bead columns.

Monoclonal antibodies and fragments thereof may be coupled to one or more therapeutic agents. Suitable agents in this regard include radioactive tracers and chemotherapeutic agents, which may be used, for example, to purge autologous bone marrow in vitro). Representative therapeutic agents include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, *Pseudomonas exotoxin, Shigella toxin*, and pokeweed antiviral protein. For diagnostic purposes, coupling of radioactive agents may be used to facilitate tracing of metastases or to determine the location of hematological malignancy related-positive tumors.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be affected, for example, through amino groups, carboxyl groups, and sulflydryl groups or oxidized carbohydrate residues. There are numerous references describing such methodology, e.g., U.S. Pat. No. 4,671,958.

Where a therapeutic agent is more potent when free from the antibody portion of the immunoconjugates of the present invention, it may be desirable to use a linker group that is cleavable during or upon internalization into a cell. A number of different cleavable linker groups have been described. The mechanisms for the intracellular release of an agent from these linker groups include cleavage by reduction of a disulfide bond (U.S. Pat. No. 4,489,710), by irradiation of a photolabile bond (U.S. Pat. No. 4,625,014), by hydrolysis of derivatized amino acid side chains (U.S. Pat. No. 4,638,045), by serum complement-mediated hydrolysis (U.S. Pat. No. 4,671,958), and acid-catalyzed hydrolysis (U.S. Pat. No. 4,569,789).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers that provide multiple sites for attachment can be used. Alternatively, a carrier can be used. A carrier may bear the agents in a variety of ways, including covalent bonding either directly or via a linker group. Suitable carriers include proteins such as albumins (U.S. Pat. No. 4,507,234), peptides and polysaccharides such as aminodextran (U.S. Pat. No. 4,699,784). A carrier may also bear an agent by noncovalent bonding or by encapsulation, such as within a liposome vesicle (U.S. Pat. No. 4,429,008 and U.S. Pat. No. 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562 discloses representative chelating compounds and their synthesis.

A variety of routes of administration for the antibodies and immunoconjugates may be used. Typically, administration will be intravenous, intramuscular, subcutaneous or in the bed of a resected tumor. It will be evident that the precise dose of the antibody/immunoconjugate will vary depending upon the antibody used, the antigen density on the tumor, and the rate of clearance of the antibody.

Also provided herein are anti-idiotypic antibodies that mimic an immunogenic portion of hematological malignancy related. Such antibodies may be raised against an antibody, or an antigen-binding fragment thereof, that specifically binds to an immunogenic portion of hematological malignancy related, using well-known techniques. Anti-idiotypic antibodies that mimic an immunogenic portion of hematological malignancy related are those antibodies that bind to an antibody, or antigen-binding fragment thereof, that specifically binds to an immunogenic portion of hematological malignancy related, as described herein.

Irrespective of the source of the original hematological malignancy related peptide-specific antibody, the intact antibody, antibody multimers, or any one of a variety of functional, antigen-binding regions of the antibody may be used in the present invention. Exemplary functional regions include scFv, Fv, Fab', Fab and F(ab')$_2$ fragments of the hematological malignancy related peptide-specific antibodies. Techniques for preparing such constructs are well known to those in the art and are further exemplified herein.

The choice of antibody construct may be influenced by various factors. For example, prolonged half-life can result from the active readsorption of intact antibodies within the kidney, a property of the Fc piece of immunoglobulin. IgG based antibodies, therefore, are expected to exhibit slower blood clearance than their Fab' counterparts. However, Fab' fragment-based compositions will generally exhibit better tissue penetrating capability.

Antibody fragments can be obtained by proteolysis of the whole immunoglobulin by the non-specific thiol protease, papain. Papain digestion yields two identical antigen-binding fragments, termed "Fab fragments," each with a single antigen-binding site, and a residual "Fc fragment."

Papain should first be activated by reducing the sulfhydryl group in the active site with cysteine, 2-mercaptoethanol or dithiothreitol. Heavy metals in the stock enzyme should be removed by chelation with EDTA (2 mM) to ensure maximum enzyme activity. Enzyme and substrate are normally mixed together in the ratio of 1:100 by weight. After incubation, the reaction can be stopped by irreversible alkylation of the thiol group with iodoacetamide or simply by dialysis. The completeness of the digestion should be monitored by SDS-PAGE and the various fractions separated by Protein A-Sepharose or ion exchange chromatography.

The usual procedure for preparation of $F(ab')_2$ fragments from IgG of rabbit and human origin is limited proteolysis by the enzyme pepsin. The conditions, 100× antibody excess wt./wt. in acetate buffer at pH 4.5, 37° C., suggest that antibody is cleaved at the C-terminal side of the inter-heavy-chain disulfide bond. Rates of digestion of mouse IgG may vary with subclass and it may be difficult to obtain high yields of active $F(ab')_2$ fragments without some undigested or completely degraded IgG. In particular, $IgG_{2b}$ is highly susceptible to complete degradation. The other subclasses require different incubation conditions to produce optimal results, all of which is known in the art.

Pepsin treatment of intact antibodies yields an $F(ab')_2$ fragment that has two antigen-combining sites and is still capable of cross-linking antigen. Digestion of rat IgG by pepsin requires conditions including dialysis in 0.1 M acetate buffer, pH 4.5, and then incubation for four hrs with 1% wt/wt. pepsin; $IgG_1$ and $IgG_{2a}$ digestion is improved if first dialyzed against 0.1 M formate buffer, pH 2.8, at 4° C., for 16 hrs followed by acetate buffer. $IgG_{2b}$ gives more consistent results with incubation in staphylococcal V8 protease (3% wt/wt.) in 0.1 M sodium phosphate buffer, pH 7.8, for four hrs at 37° C.

A Fab fragment also contains the constant domain of the light chain and the first constant domain (CH1) of the heavy chain. Fab' fragments differ from Fab fragments by the addition of a few residues at the carboxyl terminus of the heavy chain CH1 domain including one or more cysteine(s) from the antibody hinge region. $F(ab')_2$ antibody fragments were originally produced as pairs of Fab' fragments that have hinge cysteines between them. Other chemical couplings of antibody fragments are also known.

The term "variable," as used herein in reference to antibodies, means that certain portions of the variable domains differ extensively in sequence among antibodies, and are used in the binding and specificity of each particular antibody to its particular antigen. However, the variability is not evenly distributed throughout the variable domains of antibodies. It is concentrated in three segments termed "hypervariable regions," both in the light chain and the heavy chain variable domains.

The more highly conserved portions of variable domains are called the framework region (FR). The variable domains of native heavy and light chains each comprise four FRs (FR1, FR2, FR3 and FR4, respectively), largely adopting a β-sheet configuration, connected by three hypervariable regions, which form loops connecting, and in some cases, forming part of, the β-sheet structure.

The hypervariable regions in each chain are held together in close proximity by the FRs and, with the hypervariable regions from the other chain, contribute to the formation of the antigen-binding site of antibodies (Kabat et al., 1991, specifically incorporated herein by reference). The constant domains are not involved directly in binding an antibody to an antigen, but exhibit various effector functions, such as participation of the antibody in antibody-dependent cellular toxicity.

The term "hypervariable region," as used herein, refers to the amino acid residues of an antibody that are responsible for antigen-binding. The hypervariable region comprises amino acid residues from a "complementarity determining region" or "CDR" (i.e. residues 24-34 (L1), 50-56 (L2) and 89-97 (L3) in the light chain variable domain and 31-35 (H1), 50-56 (H2) and 95-102 (H3) in the heavy chain variable domain (Rabat et al., 1991, specifically incorporated herein by reference) and/or those residues from a "hypervariable loop" (i.e., residues 26-32 (L1), 50-52 (L2) and 91-96 (L3) in the light chain variable domain and 26-32 (H1), 53-55 (H2) and 96-101 (H3) in the heavy chain variable domain). "Framework" or "FR" residues are those variable domain residues other than the hypervariable region residues as herein defined.

An "Fv" fragment is the minimum antibody fragment that contains a complete antigen-recognition and binding site. This region consists of a dimer of one heavy chain and one light chain variable domain in tight, con-covalent association. It is in this configuration that three hypervariable regions of each variable domain interact to define an antigen-binding site on the surface of the $V_H$-$V_L$ dimer. Collectively, six hypervariable regions confer antigen-binding specificity to the antibody. However, even a single variable domain (or half of an Fv comprising only three hypervariable regions specific for an antigen) has the ability to recognize and bind antigen, although at a lower affinity than the entire binding site.

"Single-chain Fv" or "sFv" antibody fragments comprise the $V_H$ and $V_L$ domains of antibody, wherein these domains are present in a single polypeptide chain. Generally, the Fv polypeptide further comprises a polypeptide linker between the $V_H$ and $V_L$ domains that enables the sFv to form the desired structure for antigen binding.

"Diabodies" are small antibody fragments with two antigen-binding sites, which fragments comprise a heavy chain variable domain ($V_H$) connected to a light chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described in European Pat. Appl. No. EP 404,097 and Intl. Pat. Appl. Publ. No. WO 93/11161, each specifically incorporated herein by reference. "Linear antibodies", which can be bispecific or monospecific, comprise a pair of tandem Fd segments ($V_H$-$C_H$1-$V_H$-$C_H$1) that form a pair of antigen binding regions, as described in Zapata et al. (1995), specifically incorporated herein by reference.

Other types of variants are antibodies with improved biological properties relative to the parent antibody from which they are generated. Such variants, or second-generation compounds, are typically substitutional variants involving one or more substituted hypervariable region residues of a parent antibody. A convenient way for generating such substitutional variants is affinity maturation using phage display.

In affinity maturation using phage display, several hypervariable region sites (e.g., 6 to 7 sites) are mutated to generate all possible amino substitutions at each site. The antibody variants thus generated are displayed in a monovalent fashion from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine-scanning mutagenesis can be performed on hypervariable region residues identified as contributing significantly to antigen binding.

Alternatively, or in addition, the crystal structure of the antigen-antibody complex be delineated and analyzed to identify contact points between the antibody and target. Such contact residues and neighboring residues are candidates for substitution. Once such variants are generated, the panel of variants is subjected to screening, and antibodies with analogues but different or even superior properties in one or more relevant assays are selected for further development.

In using a Fab' or antigen binding fragment of an antibody, with the attendant benefits on tissue penetration, one may derive additional advantages from modifying the fragment to increase its half-life. A variety of techniques may be employed, such as manipulation or modification of the antibody molecule itself, and also conjugation to inert carriers. Any conjugation for the sole purpose of increasing half-life, rather than to deliver an agent to a target, should be approached carefully in that Fab' and other fragments are chosen to penetrate tissues. Nonetheless, conjugation to non-protein polymers, such PEG and the like, is contemplated.

Modifications other than conjugation are therefore based upon modifying the structure of the antibody fragment to render it more stable, and/or to reduce the rate of catabolism in the body. One mechanism for such modifications is the use of D-amino acids in place of L-amino acids. Those of ordinary skill in the art will understand that the introduction of such modifications needs to be followed by rigorous testing of the resultant molecule to ensure that it still retains the desired biological properties. Further stabilizing modifications include the use of the addition of stabilizing moieties to either the N-terminal or the C-terminal, or both, which is generally used to prolong the half-life of biological molecules. By way of example only, one may wish to modify the termini by acylation or amination.

Moderate conjugation-type modifications for use with the present invention include incorporating a salvage receptor binding epitope into the antibody fragment. Techniques for achieving this include mutation of the appropriate region of the antibody fragment or incorporating the epitope as a peptide tag that is attached to the antibody fragment. Intl. Pat. Appl. Publ. No. WO 96/32478 is specifically incorporated herein by reference for the purposes of further exemplifying such technology. Salvage receptor binding epitopes are typically regions of three or more amino acids from one or two lops of the Fc domain that are transferred to the analogous position on the antibody fragment. The salvage receptor-binding epitopes disclosed in Intl. Pat. Appl. Publ. No. WO 98/45331 are incorporated herein by reference for use with the present invention.

4.3 T Cell Compositions Specific for Hematological Malignancy-Related Peptides

Immunotherapeutic compositions may also, or alternatively, comprise T cells specific for hematological malignancy related. Such cells may generally be prepared in vitro or ex vivo, using standard procedures. For example, T cells may be present within (or isolated from) bone marrow, peripheral blood or a fraction of bone marrow or peripheral blood of a mammal, such as a patient, using a commercially available cell separation system, such as the Isolex™ System, available from Nexell Therapeutics, Inc. (Irvine, Calif.; see also U.S. Pat. No. 5,240,856; U.S. Pat. No. 5,215,926; Intl. Pat. Appl. Publ. No. WO 89/06280; Intl. Pat. Appl. Publ. No. WO 91/16116 and Intl. Pat. Appl. Publ. No. WO 92/07243). Alternatively, T cells may be derived from related or unrelated humans, non-human mammals, cell lines or cultures.

T cells may be stimulated with hematological malignancy related peptide, polynucleotide encoding a hematological malignancy related peptide and/or an antigen-presenting cell (APC) that expresses a hematological malignancy related peptide. Such stimulation is performed under conditions and for a time sufficient to permit the generation of T cells that are specific for the hematological malignancy related peptide. Preferably, a hematological malignancy related peptide or polynucleotide is present within a delivery vehicle, such as a microsphere, to facilitate the generation of antigen-specific T cells. Briefly, T cells, which may be isolated from a patient or a related or unrelated donor by routine techniques (such as by Ficoll/Hypaque® density gradient centrifugation of peripheral blood lymphocytes), are incubated with hematological malignancy related peptide. For example, T cells may be incubated in vitro for 2-9 days (typically 4 days) at 37° C. with hematological malignancy related peptide (e.g., 5 to 25 μg/ml) or cells synthesizing a comparable amount of hematological malignancy related peptide. It may be desirable to incubate a separate aliquot of a T cell sample in the absence of hematological malignancy related peptide to serve as a control.

T cells are considered to be specific for a hematological malignancy related peptide if the T cells kill target cells coated with a hematological malignancy related peptide or expressing a gene encoding such a peptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity. Such assays may be performed, for example, as described in Chen et al. (1994). Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated-thymidine and measuring the amount of tritiated thymidine incorporated into DNA). Other ways to detect T cell proliferation include measuring increases in interleukin-2 (IL-2) production, $Ca^{2+}$ flux, or dye uptake, such as 3-(4,5-dimethylthiazol-2-yl)-2,5-diphenyl-tetrazolium. Alternatively, synthesis of lymphokines (such as interferon-gamma) can be measured or the relative number of T cells that can respond to a hematological malignancy related peptide may be quantified. Contact with a hematological malignancy related peptide (200 ng/ml-100 μg/ml, preferably 100 ng/ml-25 μg/ml) for 3-7 days should result in at least a two-fold increase in proliferation of the T cells and/or contact as described above for 2-3 hrs should result in activation of the T cells, as measured using standard cytokine assays in which a two-fold increase in the level of cytokine release (e.g., TNF or IFN-γ) is indicative of T cell activation (Coligan et al., 1998). hematological malignancy related specific T cells may be expanded using standard techniques. Within preferred embodiments, the T cells are derived from a patient or a related or unrelated donor and are administered to the patient following stimulation and expansion.

T cells that have been activated in response to a hematological malignancy related peptide, polynucleotide or hematological malignancy related-expressing APC may be $CD4^+$ and/or $CD8^+$. Specific activation of $CD4^+$ or $CD8^+$ T cells may be detected in a variety of ways. Methods for detecting specific T cell activation include detecting the proliferation of T cells, the production of cytokines (e.g., lymphokines), or the generation of cytolytic activity (i.e., generation of cytotoxic T cells specific for hematological malignancy related). For CD4$^+$ T cells, a preferred method for detecting specific T cell activation is the detection of the proliferation of T cells. For CD8$^+$ T cells, a preferred method for detecting specific T cell activation is the detection of the generation of cytolytic activity.

For therapeutic purposes, CD4$^+$ or CD8$^+$ T cells that proliferate in response to the hematological malignancy related peptide, polynucleotide or APC can be expanded in number either in vitro or in vivo. Proliferation of such T cells in vitro may be accomplished in a variety of ways. For example, the T cells can be re-exposed to hematological malignancy related peptide, with or without the addition of T cell growth factors, such as interleukin-2, and/or stimulator cells that synthesize a hematological malignancy related peptide. The addition of stimulator cells is preferred where generating CD8$^+$ T cell responses. T cells can be grown to large numbers in vitro with retention of specificity in response to intermittent restimulation with hematological malignancy related peptide. Briefly, for the primary in vitro stimulation (IVS), large numbers of lymphocytes (e.g., greater than 4×10$^7$) may be placed in flasks with media containing human serum. hematological malignancy related peptide (e.g., peptide at 10 μg/ml) may be added directly, along with tetanus toxoid (e.g., 5 μg/ml). The flasks may then be incubated (e.g., 37° C. for 7 days). For a second IVS, T cells are then harvested and placed in new flasks with 2-3×10$^7$ irradiated peripheral blood mononuclear cells. hematological malignancy related peptide (e.g., 10 μg/ml) is added directly. The flasks are incubated at 37° C. for 7 days. On day 2 and day 4 after the second IVS, 2-5 units of interleukin-2 (IL-2) may be added. For a third IVS, the T cells may be placed in wells and stimulated with the individual's own EBV transformed B cells coated with the peptide. IL-2 may be added on days 2 and 4 of each cycle. As soon as the cells are shown to be specific cytotoxic T cells, they may be expanded using a 10-day stimulation cycle with higher IL-2 (20 units) on days 2, 4 and 6.

Alternatively, one or more T cells that proliferate in the presence of hematological malignancy related peptide can be expanded in number by cloning. Methods for cloning cells are well known in the art, and include limiting dilution. Responder T cells may be purified from the peripheral blood of sensitized patients by density gradient centrifugation and sheep red cell rosetting and established in culture by stimulating with the nominal antigen in the presence of irradiated autologous filler cells. In order to generate CD4$^+$ T cell lines, hematological malignancy related peptide is used as the antigenic stimulus and autologous peripheral blood lymphocytes (PBL) or lymphoblastoid cell lines (LCL) immortalized by infection with Epstein Barr virus are used as antigen-presenting cells. In order to generate CD8$^+$ T cell lines, autologous antigen-presenting cells transfected with an expression vector that produces hematological malignancy related peptide may be used as stimulator cells. Established T cell lines may be cloned 2-4 days following antigen stimulation by plating stimulated T cells at a frequency of 0.5 cells per well in 96-well flat-bottom plates with 1×10$^6$ irradiated PBL or LCL cells and recombinant interleukin-2 (rIL2) (50 U/ml). Wells with established clonal growth may be identified at approximately 2-3 weeks after initial plating and restimulated with appropriate antigen in the presence of autologous antigen-presenting cells, then subsequently expanded by the addition of low doses of rIL2 (10 U/ml) 2-3 days following antigen stimulation. T cell clones may be maintained in 24-well plates by periodic restimulation with antigen and rIL2 approximately every two weeks. Cloned and/or expanded cells may be administered back to the patient as described, for example, by Chang et al., (1996).

Within certain embodiments, allogeneic T-cells may be primed (i.e., sensitized to hematological malignancy related) in vivo and/or in vitro. Such priming may be achieved by contacting T cells with a hematological malignancy related peptide, a polynucleotide encoding such a peptide or a cell producing such a peptide under conditions and for a time sufficient to permit the priming of T cells. In general, T cells are considered to be primed if, for example, contact with a hematological malignancy related peptide results in proliferation and/or activation of the T cells, as measured by standard proliferation, chromium release and/or cytokine release assays as described herein. A stimulation index of more than two fold increase in proliferation or lysis, and more than three fold increase in the level of cytokine, compared to negative controls indicates T-cell specificity. Cells primed in vitro may be employed, for example, within bone marrow transplantation or as donor lymphocyte infusion.

T cells specific for hematological malignancy related can kill cells that express hematological malignancy related protein. Introduction of genes encoding T-cell receptor (TCR) chains for hematological malignancy related are used as a means to quantitatively and qualitatively improve responses to hematological malignancy related bearing leukemia and cancer cells. Vaccines to increase the number of T cells that can react to hematological malignancy related positive cells are one method of targeting hematological malignancy related bearing cells. T cell therapy with T cells specific for hematological malignancy related is another method. An alternative method is to introduce the TCR chains specific for hematological malignancy related into T cells or other cells with lytic potential. In a suitable embodiment, the TCR alpha and beta chains are cloned out from a hematological malignancy related specific T cell line and used for adoptive T cell therapy, such as described in WO 96/30516, incorporated herein by reference.

4.4 Pharmaceutical Compositions and Vaccine Formulations

Within certain aspects, peptides, polynucleotides, antibodies and/or T cells may be incorporated into pharmaceutical compositions or immunogenic compositions (i.e., vaccines). Alternatively, a pharmaceutical composition may comprise an antigen-presenting cell (e.g., a dendritic cell) transfected with a hematological malignancy related polynucleotide such that the antigen-presenting cell expresses a hematological malignancy related peptide. Pharmaceutical compositions comprise one or more such compounds or cells and a physiologically acceptable carrier or excipient. Vaccines may comprise one or more such compounds or cells and an immunostimulant, such as an adjuvant or a liposome (into which the compound is incorporated). An immunostimulant may be any substance that enhances or potentiates an immune response (antibody- and/or cell-mediated) to an exogenous antigen. Examples of immunostimulants include adjuvants, biodegradable microspheres (e.g., polylactic galactide) and liposomes (into which the compound is incorporated) (U.S. Pat. No. 4,235,877). Vaccine preparation is generally described in, for example, Powell and Newman (1995). Pharmaceutical compositions and vaccines within the scope of the present invention may also contain other compounds, which may be biologically active or inactive. For example, one or more immunogenic portions of other tumor antigens may be present, either incorporated into a fusion peptide or as a separate compound, within the composition or vaccine.

Within certain embodiments, pharmaceutical compositions and vaccines are designed to elicit T cell responses specific for a hematological malignancy related peptide in a patient, such as a human. In general, T cell responses may be favored through the use of relatively short peptides (e.g., comprising less than 23 consecutive amino acid residues of a native hematological malignancy related peptide, preferably 4-16 consecutive residues, more preferably 8-16 consecutive residues and still more preferably 8-10 consecutive residues). Alternatively, or in addition, a vaccine may comprise an immunostimulant that preferentially enhances a T cell response. In other words, the immunostimulant may enhance the level of a T cell response to a hematological malignancy related peptide by an amount that is proportionally greater than the amount by which an antibody response is enhanced. For example, when compared to a standard oil based adjuvant, such as CFA, an immunostimulant that preferentially enhances a T cell response may enhance a proliferative T cell response by at least two fold, a lytic response by at least 10%, and/or T cell activation by at least two fold compared to hematological malignancy related-negative control cell lines, while not detectably enhancing an antibody response. The amount by which a T cell or antibody response to a hematological malignancy related peptide is enhanced may generally be determined using any representative technique known in the art, such as the techniques provided herein.

A pharmaceutical composition or vaccine may contain DNA encoding one or more of the peptides as described above, such that the peptide is generated in situ. As noted above, the DNA may be present within any of a variety of delivery systems known to those of ordinary skill in the art, including nucleic acid expression systems, bacterial and viral expression systems and mammalian expression systems. Numerous gene delivery techniques are well known in the art (Rolland, 1998, and references cited therein). Appropriate nucleic acid expression systems contain the necessary DNA, cDNA or RNA sequences for expression in the patient (such as a suitable promoter and terminating signal). Bacterial delivery systems involve the administration of a bacterium (such as Bacillus-Calmette-Guerrin) that expresses an immunogenic portion of the peptide on its cell surface or secretes such an epitope. In a preferred embodiment, the DNA may be introduced using a viral expression system (e.g., vaccinia or other pox virus, retrovirus, or adenovirus), which may involve the use of a non-pathogenic (defective), replication competent virus (Fisher-Hoch et al., 1989; Flexner et al., 1989; Flexner et al., 1990; U.S. Pat. No. 4,603,112, U.S. Pat. No. 4,769,330, U.S. Pat. No. 5,017,487; Intl. Pat. Appl. Publ. No. WO 89/01973; U.S. Pat. No. 4,777,127; Great Britain Patent No. GB 2,200,651; European Patent No. EP 0,345, 242; Intl. Pat. Appl. Publ. No. WO 91/02805; Berkner, 1988; Rosenfeld et al., 1991; Kolls et al., 1994; Kass-Eisler et al., 1993; Guzman et al., 1993a; and Guzman et al., 1993). Techniques for incorporating DNA into such expression systems are well known to those of ordinary skill in the art. The DNA may also be "naked," as described, for example, in Ulmer et al. (1993) and reviewed by Cohen (1993). The uptake of naked DNA may be increased by coating the DNA onto biodegradable beads, which are efficiently transported into the cells. It will be apparent that a vaccine may comprise both a polynucleotide and a peptide component. Such vaccines may provide for an enhanced immune response.

As noted above, a pharmaceutical composition or vaccine may comprise an antigen-presenting cell that expresses a hematological malignancy related peptide. For therapeutic purposes, as described herein, the antigen-presenting cell is preferably an autologous dendritic cell. Such cells may be prepared and transfected using standard techniques (Reeves et al., 1996; Tuting et al., 1998; and Nair et al., 1998). Expression of a hematological malignancy related peptide on the surface of an antigen-presenting cell may be confirmed by in vitro stimulation and standard proliferation as well as chromium release assays, as described herein.

It will be apparent to those of ordinary skill in the art having the benefit of the present teachings that a vaccine may contain pharmaceutically acceptable salts of the polynucleotides and peptides provided herein. Such salts may be prepared from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts). The phrases "pharmaceutically or pharmacologically acceptable" refer to molecular entities and compositions that do not produce an adverse, allergic or other significant untoward reaction when administered to an animal, or a human, as appropriate. As used herein, "pharmaceutically acceptable carrier" includes any and all solvents, dispersion media, coatings, antibacterial and antifungal agents, isotonic and absorption delaying agents and the like. The use of such media and agents for pharmaceutical active substances is well known in the art. Except insofar as any conventional media or agent is incompatible with the active ingredient, its use in the therapeutic compositions is contemplated. For human administration, preparations should meet sterility, pyrogenicity, and general safety and purity standards as required by the Food and Drug Administration Office of Biologics standards. Supplementary active ingredients can also be incorporated into the compositions.

While any suitable carrier known to those of ordinary skill in the art may be employed in the pharmaceutical compositions of this invention, the type of carrier will vary depending on the mode of administration. Compositions of the present invention may be formulated for any appropriate manner of administration, including for example, topical, oral, nasal, intravenous, intracranial, intraperitoneal, subcutaneous or intramuscular administration. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactate polyglycolate) may also be employed as carriers for the pharmaceutical compositions of this invention. Suitable biodegradable microspheres are disclosed, for example, in U.S. Pat. Nos. 4,897,268; 5,075,109; 5,928,647; 5,811,128; 5,820,883; 5,853,763; 5,814,344 and 5,942,252. For certain topical applications, formulation as a cream or lotion, using well-known components, is preferred.

Such compositions may also comprise buffers (e.g., neutral buffered saline or phosphate buffered saline), carbohydrates (e.g., glucose, mannose, sucrose or dextrans), mannitol, proteins, peptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate, or formulated with one or more liposomes, microspheres, nanoparticles, or micronized delivery systems using well-known technology.

Any of a variety of immunostimulants, such as adjuvants, may be employed in the preparation of vaccine compositions of this invention. Most adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Suitable adjuvants are commercially available as, for example, alum-based adjuvants (e.g., Alhydrogel, Rehydragel, aluminum phosphate, Algammulin, aluminum hydroxide); oil based adjuvants (Freund's Incomplete Adjuvant and Complete Adjuvant (Difco Laboratories, Detroit, Mich.), Specol, RIBI, Titer-Max, Montamide ISA50 or Seppic MONTANIDE ISA 720); nonionic block copolymer-based adjuvants, cytokines (e.g., GM-CSF or Flat3-ligand); Merck Adjuvant 65 (Merck and Company, Inc., Rahway, N.J.); AS-2 (SmithKline Beecham, Philadelphia, Pa.); salts of calcium, iron or zinc; an insoluble suspension of acylated tyrosine; acylated sugars; cationically or anionically derivatized polysaccharides; polyphosphazenes; biodegradable microspheres; monophosphoryl lipid A and Quil A. Cytokines, such as GM-CSF or interleukin-2, -7, or -12, may also be used as adjuvants.

Hemocyanins and hemoerythrins may also be used in the invention. The use of hemocyanin from keyhole limpet (KLH) is particularly preferred, although other molluscan and arthropod hemocyanins and hemoerythrins may be employed. Various polysaccharide adjuvants may also be used. Polyamine varieties of polysaccharides are particularly preferred, such as chitin and chitosan, including deacetylated chitin.

A further preferred group of adjuvants are the muramyl dipeptide (MDP, N-acetylmuramyl-L-alanyl-D-isoglutamine) group of bacterial peptidoglycans. Derivatives of muramyl dipeptide, such as the amino acid derivative threonyl-MDP, and the fatty acid derivative MTPPE, are also contemplated.

U.S. Pat. No. 4,950,645 describes a lipophilic disaccharide-tripeptide derivative of muramyl dipeptide that is proposed for use in artificial liposomes formed from phosphatidyl choline and phosphatidyl glycerol. It is said to be effective in activating human monocytes and destroying tumor cells, but is non-toxic in generally high doses. The compounds of U.S. Pat. No. 4,950,645, and Intl. Pat. Appl. Publ. No. WO 91/16347 are also proposed for use in achieving particular aspects of the present invention.

BCG and BCG-cell wall skeleton (CWS) may also be used as adjuvants in the invention, with or without trehalose dimycolate. Trehalose dimycolate may be used itself. Azuma et al (1988) show that trehalose dimycolate administration correlates with augmented resistance to influenza virus infection in mice. Trehalose dimycolate may be prepared as described in U.S. Pat. No. 4,579,945.

Amphipathic and surface-active agents, e.g., saponin and derivatives such as QS21 (Cambridge Biotech), form yet another group of preferred adjuvants for use with the immunogens of the present invention. Nonionic block copolymer surfactants (Rabinovich et al., 1994; Hunter et al., 1991) may also be employed. Oligonucleotides, as described by Yamamoto et al. (1988) are another useful group of adjuvants. Quil A and lentinen are also preferred adjuvants.

Superantigens are also contemplated for use as adjuvants in the present invention. "Superantigens" are generally bacterial products that stimulate a greater proportion of T lymphocytes than peptide antigens without a requirement for antigen processing (Mooney et. al., 1994). Superantigens include *Staphylococcus* exoproteins, such as the α, β, γ and δ enterotoxins from *S. aureus* and *S. epidermidis*, and the α, β, γ and δ *E. coli* exotoxins.

Common *Staphylococcus* enterotoxins are known as staphylococcal enterotoxin A (SEA) and staphylococcal enterotoxin B (SEB), with enterotoxins through E (SEE) being described (Rott et. al., 1992). *Streptococcus pyogenes* B (SEB), *Clostridium perfringens* enterotoxin (Bowness et. al., 1992), cytoplasmic membrane-associated protein (CAP) from *S. pyogenes* (Sato et. al., 1994) and toxic shock syndrome toxin-1 (TSST-1) from *S. aureus* (Schwab et. al., 1993) are further useful superantigens.

One group of adjuvants particularly preferred for use in the invention are the detoxified endotoxins, such as the refined detoxified endotoxin of U.S. Pat. No. 4,866,034. These refined detoxified endotoxins are effective in producing adjuvant responses in mammals.

The detoxified endotoxins may be combined with other adjuvants. Combination of detoxified endotoxins with trehalose dimycolate is contemplated, as described in U.S. Pat. No. 4,435,386. Combinations of detoxified endotoxins with trehalose dimycolate and endotoxic glycolipids is also contemplated (U.S. Pat. No. 4,505,899), as is combination of detoxified endotoxins with cell wall skeleton (CWS) or CWS and trehalose dimycolate, as described in U.S. Pat. Nos. 4,436,727, 4,436,728 and 4,505,900. Combinations of just CWS and trehalose dimycolate, without detoxified endotoxins are also envisioned to be useful, as described in U.S. Pat. No. 4,520,019.

MPL is currently one preferred immunopotentiating agent for use herein. References that concern the uses of MPL include Tomai et al. (1987), Chen et al. (1991) and Garg and Subbarao (1992), that each concern certain roles of MPL in the reactions of aging mice; Elliott et al. (1991), that concerns the D-galactosamine loaded mouse and its enhanced sensitivity to lipopolysaccharide and MPL; Chase et al (1986), that relates to bacterial infections; and Masihi et al. (1988), that describes the effects of MPL and endotoxin on resistance of mice to *Toxoplasma gondii*. Fitzgerald (1991) also reported on the use of MPL to up-regulate the immunogenicity of a syphilis vaccine and to confer significant protection against challenge infection in rabbits.

Thus MPL is known to be safe for use, as shown in the above model systems. Phase-I clinical trials have also shown MPL to be safe for use (Vosika et al., 1984). Indeed, 100 µg/m$^2$ is known to be safe for human use, even on an outpatient basis (Vosika et al., 1984).

MPL generally induces polyclonal B cell activation (Baker et al., 1994), and has been shown to augment antibody production in many systems, for example, in immunologically immature mice (Baker et al., 1988); in aging mice (Tomai and Johnson, 1989); and in nude and Xid mice (Madonna and Vogel, 1986; Myers et al., 1995). Antibody production has been shown against erythrocytes (Hraba et al., 1993); T cell dependent and independent antigens; Pnu-immune vaccine (Garg and Subbarao, 1992); isolated tumor-associated antigens (U.S. Pat. No. 4,877,611); against syngeneic tumor cells (Livingston et al., 1985; Ravindranath et al., 1994a;b); and against tumor-associated gangliosides (Ravindranath et al., 1994a;b).

Another useful attribute of MPL is that is augments IgM responses, as shown by Baker et al. (1988a), who describe the ability of MPL to increase antibody responses in young mice. This is a particularly useful feature of an adjuvant for use in certain embodiments of the present invention. Myers et al. (1995) recently reported on the ability of MPL to induce IgM antibodies, by virtue T cell-independent antibody production.

In the Myers et al. (1995) studies, MPL was conjugated to the hapten, TNP. MPL was proposed for use as a carrier for other haptens, such as peptides.

MPL also activates and recruits macrophages (Verma et al., 1992). Tomai and Johnson (1989) showed that MPL-stimulated T cells enhance IL-1 secretion by macrophages. MPL is also known to activate superoxide production, lysozyme activity, phagocytosis, and killing of *Candida* in murine peritoneal macrophages (Chen et al., 1991).

The effects of MPL on T cells include the endogenous production of cytotoxic factors, such as TNF, in serum of BCG-primed mice by MPL (Bennett et al., 1988). Kovach et al. (1990) and Elliot et al. (1991) also show that MPL induces TNF activity. MPL is known to act with TNF-α to induce release of IFN-γ by NK cells. IFN-γ production by T cells in response to MPL was also documented by Tomai and Johnson (1989), and Odean et al. (1990).

MPL is also known to be a potent T cell adjuvant. For example, MPL stimulates proliferation of melanoma-antigen specific CTLs (Mitchell et al., 1988, 1993). Further, Baker et al. (1988b) showed that nontoxic MPL inactivated suppressor T cell activity. Naturally, in the physiological environment, the inactivation of T suppressor cells allows for increased benefit for the animal, as realized by, e.g., increased antibody production. Johnson and Tomai (1988) have reported on the possible cellular and molecular mediators of the adjuvant action of MPL.

MPL is also known to induce aggregation of platelets and to phosphorylate a platelet protein prior to induction of serotonin secretion (Grabarek et al., 1990). This study shows that MPL is involved in protein kinase C activation and signal transduction.

Many articles concern the structure and function of MPL include. These include Johnson et al. (1990), that describes the structural characterization of MPL homologs obtained from *Salmonella minnesota* Re595 lipopolysaccharide. The work of Johnson et al. (1990), in common with Grabarek et al. (1990), shows that the fatty acid moieties of MPL can vary, even in commercial species. In separating MPL into eight fractions by thin layer chromatography, Johnson et al. (1990) found that three were particularly active, as assessed using human platelet responses. The chemical components of the various MPL species were characterized by Johnson et al. (1990).

Baker et al. (1992) further analyzed the structural features that influence the ability of lipid A and its analogs to abolish expression of suppressor T cell activity. They reported that decreasing the number of phosphate groups in lipid A from two to one (i.e., creating monophosphoryl lipid A, MPL) as well as decreasing the fatty acyl content, primarily by removing the residue at the 3 position, resulted in a progressive reduction in toxicity; however, these structural modifications did not influence its ability to abolish the expression of Ts function (Baker et al., 1992). These types of MPL are ideal for use in the present invention.

Baker et al. (1992) also showed that reducing the fatty acyl content from five to four (lipid A precursor $IV_A$ or $I_a$) eliminated the capacity to influence Ts function but not to induce polyclonal activation of B cells. These studies show that in order to be able to abolish the expression of Ts function, lipid A must be a glucosamine disaccharide; may have either one or two phosphate groups; and must have at least five fatty acyl groups. Also, the chain length of the nonhydroxylated fatty acid, as well as the location of acyloxyacyl groups (2' versus 3' position), may play an important role (Baker et al., 1992).

In examining the relationship between chain length and position of fatty acyl groups on the ability of lipid A to abolish the expression of suppressor T-cell (Ts) activity, Baker et al. (1994) found that fatty acyl chain lengths of $C_{12}$ to $C_{14}$ appeared to be optimal for bioactivity. Therefore, although their use is still possible, lipid A preparations with fatty acyl groups of relatively short chain length ($C_{10}$ to $C_{12}$ from *Pseudomonas aeruginosa* and *Chromobacterium violaceum*) or predominantly long chain length ($C_{18}$ from *Helicobacter pylori*) are less preferred for use in this invention.

Baker et al. (1994) also showed that the lipid A proximal inner core region oligosaccharides of some bacterial lipopolysaccharides increase the expression of Ts activity; due mainly to the capacity of such oligosaccharides, which are relatively conserved in structure among gram-negative bacterial, to enlarge or expand upon the population of $CD8^+$ Ts generated during the course of a normal antibody response to unrelated microbial antigens. The minimal structure required for the expression of the added immunosuppression observed was reported to be a hexasaccharide containing one 2-keto-3-deoxyoctonate residue, two glucose residues, and three heptose residues to which are attached two pyrophosphorylethanolamine groups (Baker et al., 1994). This information may be considered in utilizing or even designing further adjuvants for use in the invention.

In a generally related line of work, Tanamoto et al. (1994a; b; 1995) described the dissociation of endotoxic activities in a chemically synthesized Lipid A precursor after acetylation or succinylation. Thus, compounds such as "acetyl 406" and "succinyl 516" (Tanamoto et al., 1994a;b; 1995) are also contemplated for use in the invention.

Synthetic MPLs form a particularly preferred group of antigens. For example, Brade et al. (1993) described an artificial glycoconjugate containing the bisphosphorylated glucosamine disaccharide backbone of lipid A that binds to anti-Lipid A MAbs. This is one candidate for use in certain aspects of the invention.

The MPL derivatives described in U.S. Pat. No. 4,987,237 are particularly contemplated for use in the present invention. U.S. Pat. No. 4,987,237 describes MPL derivatives that contain one or more free groups, such as amines, on a side chain attached to the primary hydroxyl groups of the monophosphoryl lipid A nucleus through an ester group. The derivatives provide a convenient method for coupling the lipid A through coupling agents to various biologically active materials. The immunostimulant properties of lipid A are maintained. All MPL derivatives in accordance with U.S. Pat. No. 4,987,237 are envisioned for use in the MPL adjuvant-incorporated cells of this invention.

Various adjuvants, even those that are not commonly used in humans, may still be employed in animals, where, for example, one desires to raise antibodies or to subsequently obtain activated T cells. The toxicity or other adverse effects that may result from either the adjuvant or the cells, e.g., as may occur using non-irradiated tumor cells, is irrelevant in such circumstances.

Within the vaccines provided herein, the adjuvant composition is preferably designed to induce an immune response predominantly of the Th1 type. High levels of Th1-type cytokines (e.g., IFN-γ, TNFα, IL-2 and IL-12) tend to favor the induction of cell-mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines see e.g., Mosmann and Coffman (1989).

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Corixa Corporation (Seattle, Wash.; see e.g., U.S. Pat. Nos. 4,436,727; 4,877,611; 4,866,034 and 4,912,094, each of which is specifically incorporated herein by reference in its entirety). CpG-containing oligonucleotides (in which the CpG dinucleotide is unmethylated) also induce a predominantly Th1 response. Such oligonucleotides are well known and are described, for example, in Intl. Pat. Appl. Publ. No. WO 96/02555 and Intl. Pat. Appl. Publ. No. WO 99/33488. Immunostimulatory DNA sequences are also described, for example, by Sato et al. (1996). Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL (see e.g., Intl. Pat. Appl. Publ. No. WO 94/00153), or a less reactogenic composition where the QS21 is quenched with cholesterol (see e.g., Intl. Pat. Appl. Publ. No. WO 96/33739). Other preferred formulations comprise an oil-in-water emulsion and tocopherol. A particularly potent adjuvant formulation involving QS21, 3D-MPL and tocopherol in an oil-in-water emulsion has also been described (see e.g., Intl. Pat. Appl. Publ. No. WO 95/17210).

Other preferred adjuvants include Montamide ISA 720 (Seppic), SAF (Chiron), ISCOMS (CSL), MF-59 (Chiron), the SBAS series of adjuvants (e.g., SBAS-2 or SBAS-4, available from SmithKline Beecham, Rixensart, Belgium), Detox (Corixa Corporation), RC-529 (Corixa Corporation) and aminoalkyl glucosaminide 4-phosphates (AGPs).

Any vaccine provided herein may be prepared using well-known methods that result in a combination of one or more antigens, one or more immunostimulants or adjuvants and one or more suitable carriers, excipients, or pharmaceutically acceptable buffers. The compositions described herein may be administered as part of a sustained release formulation (i.e., a formulation such as a capsule, sponge or gel [composed of polysaccharides, for example] that effects a slow release of compound following administration). Such formulations may generally be prepared using well-known technology (Coombes et al., 1996) and administered by, for example, oral, rectal or subcutaneous implantation, or by implantation at the desired target site. Sustained-release formulations may contain a peptide, polynucleotide or antibody dispersed in a carrier matrix and/or contained within a reservoir surrounded by a rate-controlling membrane.

Carriers for use within such formulations are preferably biocompatible, and may also be biodegradable; preferably the formulation provides a relatively constant level of active component release. Such carriers include microparticles of poly (lactide-co-glycolide), as well as polyacrylate, latex, starch, cellulose and dextran. Other delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (U.S. Pat. No. 5,151,254; Intl. Pat. Appl. Publ. No. WO 94/20078; Intl. Pat. Appl. Publ. No. WO/94/23701; and Intl. Pat. Appl. Publ. No. WO 96/06638). The amount of active compound contained within a sustained release formulation depends upon the site of implantation, the rate and expected duration of release and the nature of the condition to be treated or prevented.

Any of a variety of delivery vehicles may be employed within pharmaceutical compositions and vaccines to facilitate production of an antigen-specific immune response that targets tumor cells. Delivery vehicles include antigen-presenting cells (APCs), such as dendritic cells, macrophages, B cells, monocytes and other cells that may be engineered to be efficient APCs. Such cells may, but need not be, genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, 1998) and have been shown to be effective as a physiological adjuvant for eliciting prophylactic or therapeutic antitumor immunity (Timmerman and Levy, 1999). In general, dendritic cells may be identified based on their typical shape (stellate in situ, with marked cytoplasmic processes (dendrites) visible in vitro), their ability to take up, process and present antigens with high efficiency and their ability to activate naive T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (Zitvogel et al., 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide encoding a hematological malignancy related peptide, such that the peptide, or an immunogenic portion thereof, is expressed on the cell surface. Such transfection may take place ex vivo, and a composition or vaccine comprising such transfected cells may then be used for therapeutic purposes, as described herein. Alternatively, a gene delivery vehicle that targets a dendritic or other antigen-presenting cell may be administered to a patient, resulting in transfection that occurs in vivo. In vivo and ex vivo transfection of dendritic cells, for example, may generally be performed using any methods known in the art, such as those described in Intl. Pat. Appl. Publ. No. WO 97/24447, or the gene gun approach described by Mahvi et al. (1997). Antigen loading of dendritic cells may be achieved by incubating dendritic cells or progenitor cells with the hematological malignancy related peptide, DNA (naked or within a plasmid vector) or RNA; or with antigen-expressing recombinant bacterium or viruses (e.g., vaccinia, fowlpox, adenovirus or lentivirus vectors). Prior to loading, the peptide may be covalently conjugated to an immunological partner that provides T cell help (e.g., a carrier molecule). Alternatively, a dendritic cell may be pulsed with a non-conjugated immunological partner, separately or in the presence of the peptide.

Combined therapeutics is also contemplated, and the same type of underlying pharmaceutical compositions may be employed for both single and combined medicaments. Vaccines and pharmaceutical compositions may be presented in unit-dose or multi-dose containers, such as sealed ampoules or vials. Such containers are preferably hermetically sealed to preserve sterility of the formulation until use. In general, formulations may be stored as suspensions, solutions or emulsions in oily or aqueous vehicles. Alternatively, a vaccine or pharmaceutical composition may be stored in a freeze-dried condition requiring only the addition of a sterile liquid carrier immediately prior to use.

4.5 Diagnostic and Prognostic Methods for Hematological Malignancy Diseases

The present invention further provides methods for detecting a malignant disease associated with one or more of the polypeptide or polynucleotide compositions disclosed herein, and for monitoring the effectiveness of an immunization or therapy for such a disease. To determine the presence or absence of a malignant disease associated with one or more of the polypeptide or polynucleotide compositions disclosed herein, a patient may be tested for the level of T cells specific for one or more of such compositions. Within certain methods, a biological sample comprising $CD4^+$ and/or $CD8^+$ T cells isolated from a patient is incubated with one or more of the polypeptide or polynucleotide compositions disclosed herein, and/or an APC that expresses one or more of such peptides or polypeptides, and the presence or absence of specific activation of the T cells is detected, as described herein. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2-9 days (typically 4 days) at 37° C. with one or more of the disclosed peptide, polypeptide or polynucleotide compositions (e.g., 5-25 μg/ml). It may be desirable to incubate another aliquot of a T cell sample in the absence of the composition to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of a malignant disease associated with expression or one or more of the disclosed polypeptide or polynucleotide compositions. Further correlation may be made, using methods well known in the art, between the level of proliferation and/or cytolytic activity and the predicted response to therapy. In particular, patients that display a higher antibody, proliferative and/or lytic response may be expected to show a greater response to therapy.

Within other methods, a biological sample obtained from a patient is tested for the level of antibody specific for one or more of the hematological malignancy-related peptides or polypeptide s disclosed herein. The biological sample is incubated with hematological malignancy-related peptide or polypeptide, or a polynucleotide encoding such a peptide or polypeptide, and/or an APC that expresses such a peptide or polypeptide under conditions and for a time sufficient to allow immunocomplexes to form. Immunocomplexes formed between the selected peptide or polypeptide and antibodies in the biological sample that specifically bind to the selected peptide or polypeptide are then detected. A biological sample for use within such methods may be any sample obtained from a patient that would be expected to contain antibodies. Suitable biological samples include blood, sera, ascites, bone marrow, pleural effusion, and cerebrospinal fluid.

The biological sample is incubated with the selected peptide or polypeptide in a reaction mixture under conditions and for a time sufficient to permit immunocomplexes to form between the selected peptide or polypeptide and antibodies that are immunospecific for such a peptide or polypeptide. For example, a biological sample and a selected peptide or polypeptide peptide may be incubated at 4° C. for 24-48 hrs.

Following the incubation, the reaction mixture is tested for the presence of immunocomplexes. Detection of immunocomplexes formed between the selected peptide or polypeptide and antibodies present in the biological sample may be accomplished by a variety of known techniques, such as radioimmunoassays (RIA) and enzyme linked immunosorbent assays (ELISA). Suitable assays are well known in the art and are amply described in the scientific and patent literature (Harlow and Lane, 1988). Assays that may be used include, but are not limited to, the double monoclonal antibody sandwich immunoassay technique (U.S. Pat. No. 4,376,110); monoclonal-polyclonal antibody sandwich assays (Wide et al., 1970); the "western blot" method (U.S. Pat. No. 4,452,901); immunoprecipitation of labeled ligand (Brown et al., 1980); enzyme-linked immunosorbent assays (Raines and Ross, 1982); immunocytochemical techniques, including the use of fluorochromes (Brooks et al., 1980); and neutralization of activity (Bowen-Pope et al., 1984). Other immunoassays include, but are not limited to, those described in U.S. Pat. Nos. 3,817,827; 3,850,752; 3,901,654; 3,935,074; 3,984,533; 3,996,345; 4,034,074; and 4,098,876.

For detection purposes, the selected peptide or polypeptide may either be labeled or unlabeled. Unlabeled polypeptide peptide may be used in agglutination assays or in combination with labeled detection reagents that bind to the immunocomplexes (e.g., anti-immunoglobulin, protein G, Protein A or a lectin and secondary antibodies, or antigen-binding fragments thereof, capable of binding to the antibodies that specifically bind to the selected hematological malignancy-related peptide or polypeptide). If the selected peptide or polypeptide is labeled, the reporter group may be any suitable reporter group known in the art, including radioisotopes, fluorescent groups, luminescent groups, enzymes, biotin and dye particles.

Within certain assays, unlabeled peptide or polypeptide is immobilized on a solid support. The solid support may be any material known to those of ordinary skill in the art to which the peptide may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The peptide may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the antigen and functional groups on the support or may be a linkage by way of a cross-linking agent). Immobilization by adsorption to a well in a microtiter plate or to a membrane is preferred. In such cases, adsorption may be achieved by contacting the selected peptide or polypeptide, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of peptide ranging from about 10 ng to about 10 μg, and preferably about 100 ng to about 1 μg, is sufficient to immobilize an adequate amount of peptide.

Following immobilization, the remaining protein binding sites on the support are typically blocked. Any suitable blocking agent known to those of ordinary skill in the art, such as bovine serum albumin, Tween™ 20™ (Sigma Chemical Co., St. Louis, Mo.), heat-inactivated normal goat serum (NGS), or BLOTTO (buffered solution of nonfat dry milk which also contains a preservative, salts, and an antifoaming agent) may be used. The support is then incubated with a biological sample suspected of containing specific antibody. The sample can be applied neat, or, more often, it can be diluted, usually in a buffered solution which contains a small amount (0.1%-5.0% by weight) of protein, such as BSA, NGS, or BLOTTO. In general, an appropriate contact time (i.e., incubation time) is a period of time that is sufficient to detect the presence of antibody or an antigen binding fragment that is immunospecific for the selected peptide or polypeptide within a sample containing such an antibody or binding fragment thereof. Preferably, the contact time is sufficient to achieve a level of binding that is at least about 95% of that achieved at equilibrium between bound and unbound antibody or antibody fragment. Those of ordinary skill in the art will recognize that the time necessary to achieve equilibrium may be readily determined by assaying the level of binding that occurs over a period of time. At room temperature, an incubation time of about 30 min is generally sufficient.

Unbound sample may then be removed by washing the solid support with an appropriate buffer, such as PBS containing 0.1% Tween™ 20. A detection reagent that binds to the immunocomplexes and that comprises at least a first detectable label or "reporter" molecule may then be added. The detection reagent is incubated with the immunocomplex for an amount of time sufficient to detect the bound antibody or antigen binding fragment thereof. An appropriate amount of time may generally be determined by assaying the level of binding that occurs over a period of time. Unbound label or detection reagent is then removed and bound label or detection reagent is detected using a suitable assay or analytical instrument. The method employed for detecting the reporter group depends upon the nature of the reporter group. For radioactive labels, scintillation counting or autoradiographic methods are generally appropriate. Spectroscopic methods may be used to detect dyes, luminescent or chemiluminescent moieties and various chromogens, fluorescent labels and such like. Biotin may be detected using avidin, coupled to a different reporter group (commonly a radioactive or fluorescent group or an enzyme). Enzyme reporter groups (e.g., horseradish peroxidase, β-galactosidase, alkaline phosphatase and glucose oxidase) may generally be detected by the addition of substrate (generally for a specific period of time), followed by spectroscopic or other analysis of the reaction products. Regardless of the specific method employed, a level of bound detection reagent that is at least two fold greater than background (i.e., the level observed for a biological sample obtained from a disease-free individual) indicates the presence of a malignant disease associated with expression of the selected peptide or polypeptide.

In general, methods for monitoring the effectiveness of an immunization or therapy involve monitoring changes in the level of antibodies or T cells specific for the selected peptide or polypeptide in a sample, or in an animal such as a human patient. Methods in which antibody levels are monitored may comprise the steps of: (a) incubating a first biological sample, obtained from a patient prior to a therapy or immunization, with a selected peptide or polypeptide, wherein the incubation is performed under conditions and for a time sufficient to allow immunocomplexes to form; (b) detecting immunocomplexes formed between the selected peptide or polypeptide and antibodies or antigen binding fragments in the biological sample that specifically bind to the selected peptide or polypeptide; (c) repeating steps (a) and (b) using a second biological sample taken from the patient at later time, such as for example, following a given therapy or immunization; and (d) comparing the number of immunocomplexes detected in the first and second biological samples. Alternatively, a polynucleotide encoding the selected peptide or polypeptide, or an APC expressing the selected peptide or polypeptide may be employed in place of the selected peptide or polypeptide itself. Within such methods, immunocomplexes between the selected peptide or polypeptide encoded by a polynucleotide, or expressed by the APC, and antibodies and/or antigen binding fragments in the biological sample are detected.

Methods in which T cell activation and/or the number of hematological malignancy polypeptide-specific precursors are monitored may comprise the steps of: (a) incubating a first biological sample comprising $CD4^+$ and/or $CD8^+$ cells (e.g., bone marrow, peripheral blood or a fraction thereof), obtained from a patient prior to a therapy or immunization, with a hematological malignancy peptide or polypeptide, wherein the incubation is performed under conditions and for a time sufficient to allow specific activation, proliferation and/or lysis of T cells; (b) detecting an amount of activation, proliferation and/or lysis of the T cells; (c) repeating steps (a) and (b) using a second biological sample comprising $CD4^+$ and/or $CD8^+$ T cells, and taken from the same patient following therapy or immunization; and (d) comparing the amount of activation, proliferation and/or lysis of T cells in the first and second biological samples. Alternatively, a polynucleotide encoding a hematological malignancy related peptide, or an APC expressing such a peptide may be employed in place of the hematological malignancy peptide itself.

A biological sample for use within such methods may be any sample obtained from a patient that would be expected to contain antibodies, $CD4^+$ T cells and/or $CD8^+$ T cells. Suitable biological samples include blood, sera, ascites, bone marrow, pleural effusion and cerebrospinal fluid. A first biological sample may be obtained prior to initiation of therapy or immunization or part way through a therapy or vaccination regime. The second biological sample should be obtained in a similar manner, but at a time following additional therapy or immunization. The second biological sample may be obtained at the completion of, or part way through, therapy or immunization, provided that at least a portion of therapy or immunization takes place between the isolation of the first and second biological samples.

Incubation and detection steps for both samples may generally be performed as described above. A statistically significant increase in the number of immunocomplexes in the second sample relative to the first sample reflects successful therapy or immunization.

4.6 Administration of Pharmaceutical Compositions and Formulations

In certain embodiments, the present invention concerns formulation of one or more of the polynucleotide, polypeptide, peptide, antibody, or antigen binding fragment compositions disclosed herein in pharmaceutically acceptable solutions for administration to a cell or an animal, either alone, or in combination with one or more other modalities of anticancer therapy, or in combination with one or more diagnostic or therapeutic agents.

It will also be understood that, if desired, the nucleic acid segment, RNA, or DNA compositions disclosed herein may be administered in combination with other agents as well, such as, e.g., proteins or peptides or various pharmaceutically-active agents. As long as the composition comprises at least one of the genetic expression constructs disclosed herein, there is virtually no limit to other components that may also be included, given that the additional agents do not cause a significant adverse effect upon contact with the target cells or host tissues. The RNA- or DNA-derived compositions may thus be delivered along with various other agents as required in the particular instance. Such RNA or DNA compositions may be purified from host cells or other biological sources, or alternatively may be chemically synthesized as described herein. Likewise, such compositions may comprise substituted or derivatized RNA or DNA compositions. Such compositions may include one or more therapeutic gene constructs, either alone, or in combination with one or more modified peptide or nucleic acid substituent derivatives, and/or other anticancer therapeutics.

The formulation of pharmaceutically-acceptable excipients and carrier solutions are well-known to those of skill in the art, as is the development of suitable dosing and treatment regimens for using the particular compositions described herein in a variety of treatment regimens, including e.g., oral, intravenous, intranasal, transdermal, intraprostatic, intratumoral, and/or intramuscular administration and formulation.

4.6.1 Injectable Delivery

For example, the pharmaceutical compositions disclosed herein may be administered parenterally, intravenously, intramuscularly, or even intraperitoneally as described in U.S. Pat. No. 5,543,158, U.S. Pat. No. 5,641,515 and U.S. Pat. No. 5,399,363 (each specifically incorporated herein by reference in its entirety). Solutions of the active compounds as free-base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations contain a preservative to prevent the growth of microorganisms.

The pharmaceutical forms suitable for injectable use include sterile aqueous solutions or dispersions and sterile powders for the extemporaneous preparation of sterile injectable solutions or dispersions (U.S. Pat. No. 5,466,468, specifically incorporated herein by reference in its entirety). In all cases the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For parenteral administration in an aqueous solution, for example, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, sterile aqueous media that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion, (see for example, Hoover, 1975). Some variation in dosage will necessarily occur depending on the condition of the subject being treated. The person responsible for administration will, in any event, determine the appropriate dose for the individual subject. Moreover, for human administration, preparations should meet sterility, pyrogenicity, and general safety and purity standards as required by FDA Office of Biologics standards.

Sterile injectable solutions may be prepared by incorporating the gene therapy constructs in the required amount in the appropriate solvent with several of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

The compositions disclosed herein may be formulated in a neutral or salt form. Pharmaceutically-acceptable salts, include the acid addition salts and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug release capsules and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions.

4.6.2 Intranasal Delivery

One may use nasal solutions or sprays, aerosols or even inhalants for the treatment of hematological malignancies with one of more of the disclosed peptides and polynucleotides. Nasal solutions are usually aqueous solutions designed for administration to the nasal passages in drops or sprays. Nasal solutions are prepared so that they are similar in many respects to nasal secretions, so that normal ciliary action is maintained. Thus, the aqueous nasal solutions usually are isotonic and slightly buffered to maintain a pH of from about 5.5 to about 6.5. In addition, antimicrobial preservatives, similar to those used in ophthalmic preparations, and appropriate drug stabilizers, if required, may be included in the formulation. Various commercial nasal preparations are known.

Inhalations and inhalants are pharmaceutical preparations designed for delivering a drug or compound into the respiratory tree of a patient. A vapor or mist is administered and reaches the affected area, often to give relief from symptoms of bronchial and nasal congestion. However, this route can also be employed to deliver agents into the systemic circulation. Inhalations may be administered by the nasal or oral respiratory routes. The administration of inhalation solutions is only effective if the droplets are sufficiently fine and uniform in size so that the mist reaches the bronchioles.

Another group of products, also known as inhalations, and sometimes called insulations, consists of finely powdered or liquid drugs that are carried into the respiratory passages by the use of special delivery systems, such as pharmaceutical aerosols, that hold a solution or suspension of the drug in a liquefied gas propellant. When released through a suitable valve and oral adapter, a metered does of the inhalation is propelled into the respiratory tract of the patient.

Particle size is of importance in the administration of this type of preparation. It has been reported that the optimum particle size for penetration into the pulmonary cavity is of the order of about 0.5 to about 7 μm. Fine mists are produced by pressurized aerosols and hence their use in considered advantageous.

4.6.3 Liposome-, Nanocapsule-, and Microparticle-Mediated Delivery

In certain embodiments, the inventors contemplate the use of liposomes, nanocapsules, microparticles, microspheres, lipid particles, vesicles, and the like, for the introduction of the polynucleotide compositions of the present invention into suitable host cells. In particular, the polynucleotide compositions of the present invention may be formulated for delivery either encapsulated in a lipid particle, a liposome, a vesicle, a nanosphere, or a nanoparticle or the like.

Such formulations may be preferred for the introduction of pharmaceutically acceptable formulations of the nucleic acids disclosed herein. The formation and use of liposomes is generally known to those of skill in the art (see for example, Couvreur et al., 1977; Couvreur, 1988; Lasic, 1998; which describes the use of liposomes and nanocapsules in the targeted antibiotic therapy for intracellular bacterial infections and diseases). Recently, liposomes were developed with improved serum stability and circulation half-lives (Gabizon and Papahadjopoulos, 1988; Allen and Choun, 1987; U.S. Pat. No. 5,741,516, specifically incorporated herein by reference in its entirety). Further, various methods of liposome and liposome like preparations as potential drug carriers have been reviewed (Takakura, 1998; Chandran et al., 1997; Margalit, 1995; U.S. Pat. No. 5,567,434; U.S. Pat. No. 5,552,157; U.S. Pat. No. 5,565,213; U.S. Pat. No. 5,738,868 and U.S. Pat. No. 5,795,587, each specifically incorporated herein by reference in its entirety).

Liposomes have been used successfully with a number of cell types that are normally resistant to transfection by other procedures including T cell suspensions, primary hepatocyte cultures and PC12 cells (Renneisen et al., 1990; Muller et al., 1990). In addition, liposomes are free of the DNA length constraints that are typical of viral-based delivery systems. Liposomes have been used effectively to introduce genes, drugs (Heath and Martin, 1986; Heath et al., 1986; Balazsovits et al., 1989; Fresta and Puglisi, 1996), radiotherapeutic agents (Pikul et al., 1987), enzymes (Imaizumi et al., 1990a; Imaizumi et al., 1990b), viruses (Faller and Baltimore, 1984), transcription factors and allosteric effectors (Nicolau and Gersonde, 1979) into a variety of cultured cell lines and animals. In addition, several successful clinical trails examining the effectiveness of liposome-mediated drug delivery have been completed (Lopez-Berestein et al., 1985a; 1985b; Coune, 1988; Sculier et al., 1988). Furthermore, several studies suggest that the use of liposomes is not associated with autoimmune responses, toxicity or gonadal localization after systemic delivery (Mori and Fukatsu, 1992).

Liposomes are formed from phospholipids that are dispersed in an aqueous medium and spontaneously form multilamellar concentric bilayer vesicles (also termed multilamellar vesicles (MLVs). MLVs generally have diameters of from 25 nm to 4 μm. Sonication of MLVs results in the formation of small unilamellar vesicles (SUVs) with diameters in the range of 200 to 500 Å, containing an aqueous solution in the core.

Liposomes bear resemblance to cellular membranes and are contemplated for use in connection with the present invention as carriers for the peptide compositions. They are widely suitable as both water- and lipid-soluble substances can be entrapped, i.e. in the aqueous spaces and within the bilayer itself, respectively. It is possible that the drug-bearing liposomes may even be employed for site-specific delivery of active agents by selectively modifying the liposomal formulation.

In addition to the teachings of Couvreur et al. (1977; 1988), the following information may be utilized in generating liposomal formulations. Phospholipids can form a variety of structures other than liposomes when dispersed in water, depending on the molar ratio of lipid to water. At low ratios the liposome is the preferred structure. The physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars, and drugs.

Alternatively, the invention provides for pharmaceutically acceptable nanocapsule formulations of the polynucleotide compositions of the present invention. Nanocapsules can generally entrap compounds in a stable and reproducible way (Henry-Michelland et al., 1987; Quintanar-Guerrero et al., 1998; Douglas et al., 1987). To avoid side effects due to intracellular polymeric overloading, such ultrafine particles (sized around 0.1 μm) should be designed using polymers able to be degraded in vivo. Biodegradable polyalkyl-cyanoacrylate nanoparticles that meet these requirements are contemplated for use in the present invention, and such particles may be are easily made, as described (Couvreur et al., 1980; 1988; zur Muhlen et al., 1998; Zambaux et al. 1998; Pinto-Alphandry et al., 1995 and U.S. Pat. No. 5,145,684, specifically incorporated herein by reference in its entirety). In particular, methods of polynucleotide delivery to a target cell using either nanoparticles or nanospheres (Schwab et al., 1994; Truong-Le et al., 1998) are also particularly contemplated to be useful in formulating the disclosed compositions for administration to an animal, and to a human in particular.

4.7 Therapeutic Agents and Kits

The invention also provides one or more of the hematological malignancy-related compositions formulated with one or more pharmaceutically acceptable excipients, carriers, diluents, adjuvants, and/or other components for use in the preparation of medicaments, or diagnostic reagents, as well as various kits comprising one or more of such compositions, medicaments, or formulations intended for administration to an animal in need thereof, or for use in one or more diagnostic assays for identifying polynucleotides, polypeptides, and/or antibodies that are specific for one or more hematological malignancy-related compounds as described herein. In addition to the disclosed epitopes, antibodies and antigen binding fragments, antibody- or antigen binding fragment-encoding polynucleotides or additional anticancer agents, polynucleotides, peptides, antigens, or other therapeutic compounds as may be employed in the formulation of particular compositions and formulations disclosed herein, and particularly in the preparation of anticancer agents or anti-hematological malignancies therapies for administration to the affected mammal.

As such, preferred animals for administration of the pharmaceutical compositions disclosed herein include mammals, and particularly humans. Other preferred animals include primates, sheep, goats, bovines, equines, porcines, lupines, canines, and felines, as well as any other mammalian species commonly considered pets, livestock, or commercially relevant animal species. The compositions and formulations may include partially or significantly purified polypeptide, polynucleotide, or antibody or antigen binding fragment compositions, either alone, or in combination with one or more additional active ingredients, anticancer agents, vaccines, adjuvants, or other therapeutics which may be obtained from natural or recombinant sources, or which may be obtainable naturally or either chemically synthesized, or alternatively produced in vitro from recombinant host cells expressing one or more nucleic acid segments that encode one or more such additional active ingredients, carriers, adjuvants, cofactors, or other therapeutic compound.

4.8 Diagnostic Reagents and Kits

The invention further provides diagnostic reagents and kits comprising one or more such reagents for use in a variety of diagnostic assays, including for example, immunoassays such as ELISA and "sandwich"-type immunoassays. Such kits may preferably include at least a first peptide, or a first antibody or antigen binding fragment of the invention, a functional fragment thereof, or a cocktail thereof, and means for signal generation. The kit's components may be pre-attached to a solid support, or may be applied to the surface of a solid support when the kit is used. The signal generating means may come pre-associated with an antibody of the invention or may require combination with one or more components, e.g. buffers, antibody-enzyme conjugates, enzyme substrates, or the like, prior to use. Kits may also include additional reagents, e.g., blocking reagents for reducing non-specific binding to the solid phase surface, washing reagents, enzyme substrates, and the like. The solid phase surface may be in the form of microtiter plates, microspheres, or other materials suitable for immobilizing proteins, peptides, or polypeptides. Preferably, an enzyme that catalyzes the formation of a chemiluminescent or chromogenic product or the reduction of a chemiluminescent or chromogenic substrate is a component of the signal generating means. Such enzymes are well known in the art.

Such kits are useful in the detection, monitoring and diagnosis of conditions characterized by over-expression or inappropriate expression of hematological malignancy-related peptides, polypeptides, antibodies, and/or polynucleotides, as well as hybridomas, host cells, and vectors comprising one or more such compositions as disclosed herein.

The therapeutic and diagnostic kits of the present invention may also be prepared that comprise at least one of the antibody, peptide, antigen binding fragment, hybridoma, vector, vaccine, polynucleotide, or cellular compositions disclosed herein and instructions for using the composition as a diagnostic reagent or therapeutic agent. Containers for use in such kits may typically comprise at least one vial, test tube, flask, bottle, syringe or other suitable container, into which one or more of the diagnostic and/or therapeutic composition(s) may be placed, and preferably suitably aliquoted. Where a second therapeutic agent is also provided, the kit may also contain a second distinct container into which this second diagnostic and/or therapeutic composition may be placed. Alternatively, a plurality of compounds may be prepared in a single pharmaceutical composition, and may be packaged in a single container means, such as a vial, flask, syringe, bottle, or other suitable single container. The kits of the present invention will also typically include a means for containing the vial(s) in close confinement for commercial sale, such as, e.g., injection or blow-molded plastic containers into which the desired vial(s) are retained. Where a radiolabel, chromogenic, fluorigenic, or other type of detectable label or detecting means is included within the kit, the labeling agent may be provided either in the same container as the diagnostic or therapeutic composition itself, or may alternatively be placed in a second distinct container means into which this second composition may be placed and suitably aliquoted. Alternatively, the detection reagent and the label may be prepared in a single container means, and in most cases, the kit will also typically include a means for containing the vial(s) in close confinement for commercial sale and/or convenient packaging and delivery.

4.9 Polynucleotide Compositions

As used herein, the terms "DNA segment" and "polynucleotide" refer to a DNA molecule that has been isolated free of total genomic DNA of a particular species. Therefore, a DNA segment encoding a polypeptide refers to a DNA segment that contains one or more coding sequences yet is substantially isolated away from, or purified free from, total genomic DNA of the species from which the DNA segment is obtained. Included within the terms "DNA segment" and "polynucleotide" are DNA segments and smaller fragments of such segments, and also recombinant vectors, including, for example, plasmids, cosmids, phagemids, phage, viruses, and the like.

As will be understood by those skilled in the art, the DNA segments of this invention can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

"Isolated," as used herein, means that a polynucleotide is substantially away from other coding sequences, and that the DNA segment does not contain large portions of unrelated coding DNA, such as large chromosomal fragments or other functional genes or polypeptide coding regions. Of course, this refers to the DNA segment as originally isolated, and does not exclude genes or coding regions later added to the segment by the hand of man.

As will be recognized by the skilled artisan, polynucleotides may be single-stranded (coding or antisense) or double-stranded, and may be DNA (genomic, cDNA or synthetic) or RNA molecules. RNA molecules include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes a hematological malignancy-related tumor protein or a portion thereof) or may comprise a variant, or a biological or antigenic functional equivalent of such a sequence. Polynucleotide variants may contain one or more substitutions, additions, deletions and/or insertions, as further described below, preferably such that the immunogenicity of the encoded polypeptide is not diminished, relative to a native tumor protein. The effect on the immunogenicity of the encoded polypeptide may generally be assessed as described herein. The term "variants" also encompasses homologous genes of xenogenic origin.

When comparing polynucleotide or polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E. W. and Muller W. (1988) *CABIOS* 4:11-17; Robinson, E. D. (1971) *Comb. Theor* 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information. In one illustrative example, cumulative scores can be calculated using, for nucleotide sequences, the parameters M (reward score for a pair of matching residues; always >0) and N (penalty score for mismatching residues; always <0). For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) Proc. Natl. Acad. Sci. USA 89:10915) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e., the window size) and multiplying the results by 100 to yield the percentage of sequence identity.

Therefore, the present invention encompasses polynucleotide and polypeptide sequences having substantial identity to the sequences disclosed herein, for example those comprising at least 50% sequence identity, preferably at least 55%, 60%, 65%, 70%, 75%, 80%, 85%, 90%, 95%, 96%, 97%, 98%, or 99% or higher, sequence identity compared to a polynucleotide or polypeptide sequence of this invention using the methods described herein, (e.g., BLAST analysis using standard parameters, as described below). One skilled in this art will recognize that these values can be appropriately adjusted to determine corresponding identity of proteins encoded by two nucleotide sequences by taking into account codon degeneracy, amino acid similarity, reading frame positioning and the like.

In additional embodiments, the present invention provides isolated polynucleotides and polypeptides comprising various lengths of contiguous stretches of sequence identical to or complementary to one or more of the sequences disclosed herein. For example, polynucleotides are provided by this invention that comprise at least about 15, 20, 30, 40, 50, 75, 100, 150, 200, 300, 400, 500 or 1000 or more contiguous nucleotides of one or more of the sequences disclosed herein as well as all intermediate lengths there between. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200-500; 500-1,000, and the like.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative DNA segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

In other embodiments, the present invention is directed to polynucleotides that are capable of hybridizing under moderately stringent conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.-65° C., 5×SSC, overnight; followed by washing twice at 65° C. for 20 minutes with each of 2×, 0.5× and 0.2×SSC containing 0.1% SDS.

Moreover, it will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

4.10 Probes and Primers

In other embodiments of the present invention, the polynucleotide sequences provided herein can be advantageously used as probes or primers for nucleic acid hybridization. As such, it is contemplated that nucleic acid segments that comprise a sequence region of at least about 15, 20, 25, 30, 35, 40, 45, 50, 55, 60, 65, 70, 75, 80, 85, 90, or 95 nucleotide long contiguous sequence that has the same sequence as, or is complementary to, at least a 15, 20, 25, 30, 35, 40, 45, 50, 55, 60, 65, 70, 75, 80, 85, 90, or 95 nucleotide long contiguous sequence the disclosed polynucleotides will find particular utility in a variety of hybridization embodiments. Longer contiguous identical or complementary sequences, e.g., those of about 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 525, 550, 575, 600, 650, 700, 750, 800, 850, 900, 950, or even 1000 or so nucleotides (including all intermediate lengths) and all full-length sequences as the disclosed polynucleotides will also be of use in certain embodiments as probes, primers, or amplification targets and such like.

The ability of such nucleic acid probes to specifically hybridize to a sequence of interest will enable them to be of use in detecting the presence of complementary sequences in a given sample. However, other uses are also envisioned, such as the use of the sequence information for the preparation of mutant species primers, or primers, for use in preparing other genetic constructions, and for identifying and characterizing full-length polynucleotides and full, or substantially full-length cDNAs, mRNAs, and such like.

Polynucleotide molecules having sequence regions consisting of contiguous nucleotide stretches identical or complementary to one or more polynucleotide sequences as disclosed herein, are particularly contemplated as hybridization probes for use in, e.g., Southern hybridization analyses and Northern blotting. This would allow a gene product, or fragment thereof, to be analyzed, both in diverse cell types and also in various bacterial cells. The total size of fragment, as well as the size of the complementary stretch(es), will ultimately depend on the intended use or application of the particular nucleic acid segment. Smaller fragments will generally find use in hybridization embodiments, wherein the length of the contiguous complementary region may be varied, such as between about 15, 20, 25, 30, 35, 40, 45, 50, 55, 60 or so and up to and including larger contiguous complementary sequences, including those of about 70, 80, 90, 100, 120, 140, 160, 180, or 200 or so nucleotides in length may also be used, according to the given desired goal, and the particular length of the complementary sequences one wishes to detect by hybridization analysis.

The use of a hybridization probe of about between about 20 and about 500 nucleotides in length allows the formation of a duplex molecule that is both stable and selective. Molecules having contiguous complementary sequences over stretches greater than about 20 or so bases in length are generally preferred, though, in order to increase stability and selectivity of the hybrid, and thereby improve the quality and degree of specific hybrid molecules obtained. One will generally prefer to design nucleic acid molecules having gene-complementary stretches of between about 25 and 300 or so contiguous nucleotides, or even longer where desired.

Hybridization probes may be selected from any portion of any of the sequences disclosed herein. All that is required is to review the disclosed sequences, or to any contiguous portion of such a sequence, from about 15 to 30 nucleotides in length up to and including the full length sequence, that one wishes to utilize as a probe or primer. The choice of probe and primer sequences may be governed by various factors. For example, one may wish to employ primers from towards the termini of the total sequence.

Small polynucleotide segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U.S. Pat. No. 4,683,202 (incorporated herein by reference), by introducing selected sequences into recombinant vectors for recombinant production, and by other recombinant DNA techniques generally known to those of skill in the art of molecular biology.

The nucleotide sequences of the invention may be used for their ability to selectively form duplex molecules with complementary stretches of the entire gene or gene fragments of interest. Depending on the application envisioned, one will typically desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by a salt concentration of from about 0.02 M to about 0.15 M salt at temperatures of from about 50° C. to about 70° C. Such selective conditions tolerate little, if any, mismatch between the probe and the template or target strand, and would be particularly suitable for isolating related sequences.

Of course, for some applications, for example, where one desires to prepare mutants employing a mutant primer strand hybridized to an underlying template, less stringent (reduced stringency) hybridization conditions will typically be needed in order to allow formation of the heteroduplex. In these circumstances, one may desire to employ salt conditions such as those of from about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions can be readily manipulated, and thus will generally be a method of choice depending on the desired results.

4.11 Polynucleotide Identification and Characterization

Polynucleotides may be identified, prepared and/or manipulated using any of a variety of well established techniques. For example, a polynucleotide may be identified, as described in more detail below, by screening a microarray of cDNAs for tumor-associated expression (i.e., expression that is at least two fold greater in a tumor than in normal tissue, as determined using a representative assay provided herein). Such screens may be performed, for example, using a Synteni microarray (Palo Alto, Calif.) according to the manufacturer's instructions (and essentially as described by Schena et al., *Proc. Natl. Acad. Sci. USA* 93:10614-10619, 1996 and Heller et al., *Proc. Natl. Acad. Sci. USA* 94:2150-2155, 1997). Alternatively, polynucleotides may be amplified from cDNA prepared from cells expressing the proteins described herein, such as hematological malignancy-related tumor cells. Such polynucleotides may be amplified via polymerase chain reaction (PCR). For this approach, sequence-specific primers may be designed based on the sequences provided herein, and may be purchased or synthesized.

An amplified portion of a polynucleotide of the present invention may be used to isolate a full length gene from a suitable library (e.g., a hematological malignancy-related tumor cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}P$) using well known techniques. A bacterial or bacteriophage library is then generally screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences can then assembled into a single contiguous sequence. A full length cDNA molecule can be generated by ligating suitable fragments, using well known techniques.

Alternatively, there are numerous amplification techniques for obtaining a full length coding sequence from a partial cDNA sequence. Within such techniques, amplification is generally performed via PCR. Any of a variety of commercially available kits may be used to perform the amplification step. Primers may be designed using, for example, software or algorithms or formulas well known in the art.

One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., *PCR Methods Applic.* 1:111-19, 1991) and walking PCR (Parker et al., *Nucl. Acids. Res.* 19:3055-60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length DNA sequences may also be obtained by analysis of genomic fragments.

4.12 Polynucleotide Expression in Host Cells

In other embodiments of the invention, polynucleotide sequences or fragments thereof which encode polypeptides of the invention, or fusion proteins or functional equivalents thereof, may be used in recombinant DNA molecules to direct expression of a polypeptide in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

Moreover, the polynucleotide sequences of the present invention can be engineered using methods generally known in the art in order to alter polypeptide encoding sequences for a variety of reasons, including but not limited to, alterations which modify the cloning, processing, and/or expression of the gene product. For example, DNA shuffling by random fragmentation and PCR reassembly of gene fragments and synthetic oligonucleotides may be used to engineer the nucleotide sequences. In addition, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences may be ligated to a heterologous sequence to encode a fusion protein. For example, to screen peptide libraries for inhibitors of polypeptide activity, it may be useful to encode a chimeric protein that can be recognized by a commercially available antibody. A fusion protein may also be engineered to contain a cleavage site located between the polypeptide-encoding sequence and the heterologous protein sequence, so that the polypeptide may be cleaved and purified away from the heterologous moiety.

Sequences encoding a desired polypeptide may be synthesized, in whole or in part, using chemical methods well known in the art (see Caruthers, M. H. et al. (1980) *Nucl. Acids Res. Symp. Ser.* 215-223, Horn, T. et al. (1980) *Nucl. Acids Res. Symp. Ser.* 225-232). Alternatively, the protein itself may be produced using chemical methods to synthesize the amino acid sequence of a polypeptide, or a portion thereof. For example, peptide synthesis can be performed using various solid-phase techniques (Roberge, J. Y. et al. (1995) *Science* 269:202-204) and automated synthesis may be achieved, for example, using the ABI 431A Peptide Synthesizer (Perkin Elmer, Palo Alto, Calif.).

A newly synthesized peptide may be substantially purified by preparative high performance liquid chromatography (e.g., Creighton, T. (1983) Proteins, Structures and Molecular Principles, WH Freeman and Co., New York, N.Y.) or other comparable techniques available in the art. The composition of the synthetic peptides may be confirmed by amino acid analysis or sequencing (e.g., the Edman degradation procedure). Additionally, the amino acid sequence of a polypeptide, or any part thereof, may be altered during direct synthesis and/or combined using chemical methods with sequences from other proteins, or any part thereof, to produce a variant polypeptide.

In order to express a desired polypeptide, the nucleotide sequences encoding the polypeptide, or functional equivalents, may be inserted into appropriate expression vector, i.e., a vector which contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems may be utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

The "control elements" or "regulatory sequences" present in an expression vector are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. In mammalian cell systems, promoters from mammalian genes or from mammalian viruses are generally preferred. If it is necessary to generate a cell line that contains multiple copies of the sequence encoding a polypeptide, vectors based on SV40 or EBV may be advantageously used with an appropriate selectable marker.

In bacterial systems, a number of expression vectors may be selected depending upon the use intended for the expressed polypeptide. For example, when large quantities are needed, for example for the induction of antibodies, vectors which direct high level expression of fusion proteins that are readily purified may be used. Such vectors include, but are not limited to, the multifunctional *E. coli* cloning and expression vectors such as BLUESCRIPT (Stratagene), in which the sequence encoding the polypeptide of interest may be ligated into the vector in frame with sequences for the amino-terminal Met and the subsequent 7 residues of .beta.-galactosidase so that a hybrid protein is produced; pIN vectors (Van Heeke, G. and S. M. Schuster (1989) *J. Biol. Chem.* 264:5503-5509); and the like. pGEX Vectors (Promega, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast, *Saccharomyces cerevisiae*, a number of vectors containing constitutive or inducible promoters such as alpha factor, alcohol oxidase, and PGH may be used. For reviews, see Ausubel et al. (supra) and Grant et al. (1987) *Methods Enzymol.* 153:516-544.

In cases where plant expression vectors are used, the expression of sequences encoding polypeptides may be driven by any of a number of promoters. For example, viral promoters such as the 35S and 19S promoters of CaMV may be used alone or in combination with the omega leader sequence from TMV (Takamatsu, N. (1987) *EMBO J.* 6:307-311. Alternatively, plant promoters such as the small subunit of RUBISCO or heat shock promoters may be used (Coruzzi, G. et al. (1984) *EMBO J.* 3:1671-1680; Broglie, R. et al. (1984) *Science* 224:838-843; and Winter, J. et al. (1991) *Results Probl. Cell Differ.* 17:85-105). These constructs can be introduced into plant cells by direct DNA transformation or pathogen-mediated transfection. Such techniques are described in a number of generally available reviews (see, for example, Hobbs, S. or Murry, L. E. in McGraw Hill Yearbook of Science and Technology (1992) McGraw Hill, New York, N.Y.; pp. 191-196).

An insect system may also be used to express a polypeptide of interest. For example, in one such system, *Autographa californica* nuclear polyhedrosis virus (AcNPV) is used as a vector to express foreign genes in *Spodoptera frugiperda* cells or in *Trichoplusia larvae*. The sequences encoding the polypeptide may be cloned into a non-essential region of the virus, such as the polyhedrin gene, and placed under control of the polyhedrin promoter. Successful insertion of the polypeptide-encoding sequence will render the polyhedrin gene inactive and produce recombinant virus lacking coat protein. The recombinant viruses may then be used to infect, for example, *S. frugiperda* cells or *Trichoplusia larvae* in which the polypeptide of interest may be expressed (Engelhard, E. K. et al. (1994) *Proc. Natl. Acad. Sci.* 91:3224-3227).

In mammalian host cells, a number of viral-based expression systems are generally available. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan, J. and Shenk, T. (1984) *Proc. Natl. Acad. Sci.* 81:3655-3659). In addition, transcription enhancers, such as the Rous sarcoma virus (RSV) enhancer, may be used to increase expression in mammalian host cells.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) *Results Probl. Cell Differ.* 20:125-162).

In addition, a host cell strain may be chosen for its ability to modulate the expression of the inserted sequences or to process the expressed protein in the desired fashion. Such modifications of the polypeptide include, but are not limited to, acetylation, carboxylation. glycosylation, phosphorylation, lipidation, and acylation. Post-translational processing which cleaves a "prepro" form of the protein may also be used to facilitate correct insertion, folding and/or function. Different host cells such as CHO, HeLa, MDCK, HEK293, and WI38, which have specific cellular machinery and characteristic mechanisms for such post-translational activities, may be chosen to ensure the correct modification and processing of the foreign protein.

For long-term, high-yield production of recombinant proteins, stable expression is generally preferred. For example, cell lines which stably express a polynucleotide of interest may be transformed using expression vectors which may contain viral origins of replication and/or endogenous expression elements and a selectable marker gene on the same or on a separate vector. Following the introduction of the vector, cells may be allowed to grow for 1-2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler, M. et al. (1977) *Cell* 11:223-32) and adenine phosphoribosyltransferase (Lowy, I. et al. (1990) *Cell* 22:817-23) genes which can be employed in tk.sup.- or aprt.sup.-cells, respectively. Also, antimetabolite, antibiotic or herbicide resistance can be used as the basis for selection; for example, dhfr which confers resistance to methotrexate (Wigler, M. et al. (1980) *Proc. Natl. Acad. Sci.* 77:3567-70); npt, which confers resistance to the aminoglycosides, neomycin and G-418 (Colbere-Garapin, F. et al (1981) *J. Mol. Biol.* 150:1-14); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman, S. C. and R. C. Mulligan (1988) *Proc. Natl. Acad. Sci.* 85:8047-51). Recently, the use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) *Methods Mol. Biol.* 55:121-131).

Although the presence/absence of marker gene expression suggests that the gene of interest is also present, its presence and expression may need to be confirmed. For example, if the sequence encoding a polypeptide is inserted within a marker gene sequence, recombinant cells containing sequences can be identified by the absence of marker gene function. Alternatively, a marker gene can be placed in tandem with a polypeptide-encoding sequence under the control of a single promoter. Expression of the marker gene in response to induction or selection usually indicates expression of the tandem gene as well.

Alternatively, host cells which contain and express a desired polynucleotide sequence may be identified by a variety of procedures known to those of skill in the art. These procedures include, but are not limited to, DNA-DNA or DNA-RNA hybridizations and protein bioassay or immunoassay techniques which include membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide may be preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; *J. Exp. Med.* 158:1211-1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the invention may be designed to contain signal sequences which direct secretion of the encoded polypeptide through a prokaryotic or eukaryotic cell membrane. Other recombinant constructions may be used to join sequences encoding a polypeptide of interest to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (Invitrogen. San Diego, Calif.) between the purification domain and the encoded polypeptide may be used to facilitate purification. One such expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, *Prot. Exp. Purif.* 3:263-281) while the enterokinase cleavage site provides a means for purifying the desired polypeptide from the fusion protein. A discussion of vectors which contain fusion proteins is provided in Kroll, D. J. et al. (1993; *DNA Cell Biol.* 12:441-453).

In addition to recombinant production methods, polypeptides of the invention, and fragments thereof, may be produced by direct peptide synthesis using solid-phase techniques (Merrifield J. (1963) *J. Am. Chem. Soc.* 85:2149-2154). Protein synthesis may be performed using manual techniques or by automation. Automated synthesis may be achieved, for example, using Applied Biosystems 431A Peptide Synthesizer (Perkin Elmer). Alternatively, various fragments may be chemically synthesized separately and combined using chemical methods to produce the full length molecule.

4.13 Site-Specific Mutagenesis

Site-specific mutagenesis is a technique useful in the preparation of individual peptides, or biologically functional equivalent polypeptides, through specific mutagenesis of the underlying polynucleotides that encode them. The technique, well-known to those of skill in the art, further provides a ready ability to prepare and test sequence variants, for example, incorporating one or more of the foregoing considerations, by introducing one or more nucleotide sequence changes into the DNA. Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments of the present invention, the inventors contemplate the mutagenesis of the disclosed polynucleotide sequences to alter one or more properties of the encoded polypeptide, such as the antigenicity of a polypeptide vaccine. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phage are readily commercially-available and their use is generally well-known to those skilled in the art. Double-stranded plasmids are also routinely employed in site directed mutagenesis that eliminates the step of transferring the gene of interest from a plasmid to a phage.

In general, site-directed mutagenesis in accordance herewith is performed by first obtaining a single-stranded vector or melting apart of two strands of a double-stranded vector that includes within its sequence a DNA sequence that encodes the desired peptide. An oligonucleotide primer bearing the desired mutated sequence is prepared, generally synthetically. This primer is then annealed with the single-stranded vector, and subjected to DNA polymerizing enzymes such as *E. coli* polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells, such as *E. coli* cells, and clones are selected which include recombinant vectors bearing the mutated sequence arrangement.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" is intended to refer to a process that involves the template-dependent extension of a primer molecule. The term template dependent process refers to nucleic acid synthesis of an RNA or a DNA molecule wherein the sequence of the newly synthesized strand of nucleic acid is dictated by the well-known rules of complementary base pairing (see, for example, Watson, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224, specifically incorporated herein by reference in its entirety.

4.14 Polynucleotide Amplification Techniques

A number of template dependent processes are available to amplify the target sequences of interest present in a sample. One of the best known amplification methods is the polymerase chain reaction (PCR™) which is described in detail in U.S. Pat. Nos. 4,683,195, 4,683,202 and 4,800,159, each of which is incorporated herein by reference in its entirety. Briefly, in PCR™, two primer sequences are prepared which are complementary to regions on opposite complementary strands of the target sequence. An excess of deoxynucleoside triphosphates is added to a reaction mixture along with a DNA polymerase (e.g., Taq polymerase). If the target sequence is present in a sample, the primers will bind to the target and the polymerase will cause the primers to be extended along the target sequence by adding on nucleotides. By raising and lowering the temperature of the reaction mixture, the extended primers will dissociate from the target to form reaction products, excess primers will bind to the target and to the reaction product and the process is repeated. Preferably reverse transcription and PCR™ amplification procedure may be performed in order to quantify the amount of mRNA amplified. Polymerase chain reaction methodologies are well known in the art.

Another method for amplification is the ligase chain reaction (referred to as LCR), disclosed in Eur. Pat. Appl. Publ. No. 320,308 (specifically incorporated herein by reference in its entirety). In LCR, two complementary probe pairs are prepared, and in the presence of the target sequence, each pair will bind to opposite complementary strands of the target such that they abut. In the presence of a ligase, the two probe pairs will link to form a single unit. By temperature cycling, as in PCR™, bound ligated units dissociate from the target and then serve as "target sequences" for ligation of excess probe pairs. U.S. Pat. No. 4,883,750, incorporated herein by reference in its entirety, describes an alternative method of amplification similar to LCR for binding probe pairs to a target sequence.

Qbeta Replicase, described in PCT Intl. Pat. Appl. Publ. No. PCT/US87/00880, incorporated herein by reference in its entirety, may also be used as still another amplification method in the present invention. In this method, a replicative sequence of RNA that has a region complementary to that of a target is added to a sample in the presence of an RNA polymerase. The polymerase will copy the replicative sequence that can then be detected.

An isothermal amplification method, in which restriction endonucleases and ligases are used to achieve the amplification of target molecules that contain nucleotide 5'-[α-thio] triphosphates in one strand of a restriction site (Walker et al., 1992, incorporated herein by reference in its entirety), may also be useful in the amplification of nucleic acids in the present invention.

Strand Displacement Amplification (SDA) is another method of carrying out isothermal amplification of nucleic acids which involves multiple rounds of strand displacement and synthesis, i.e. nick translation. A similar method, called Repair Chain Reaction (RCR) is another method of amplification which may be useful in the present invention and is involves annealing several probes throughout a region targeted for amplification, followed by a repair reaction in which only two of the four bases are present. The other two bases can be added as biotinylated derivatives for easy detection. A similar approach is used in SDA.

Sequences can also be detected using a cyclic probe reaction (CPR). In CPR, a probe having a 3' and 5' sequences of non-target DNA and an internal or "middle" sequence of the target protein specific RNA is hybridized to DNA which is present in a sample. Upon hybridization, the reaction is treated with RNaseH, and the products of the probe are identified as distinctive products by generating a signal that is released after digestion. The original template is annealed to another cycling probe and the reaction is repeated. Thus, CPR involves amplifying a signal generated by hybridization of a probe to a target gene specific expressed nucleic acid.

Still other amplification methods described in Great Britain Pat. Appl. No. 2 202 328, and in PCT Intl. Pat. Appl. Publ. No. PCT/US89/01025, each of which is incorporated herein by reference in its entirety, may be used in accordance with the present invention. In the former application, "modified" primers are used in a PCR-like, template and enzyme dependent synthesis. The primers may be modified by labeling with a capture moiety (e.g., biotin) and/or a detector moiety (e.g., enzyme). In the latter application, an excess of labeled probes is added to a sample. In the presence of the target sequence, the probe binds and is cleaved catalytically. After cleavage, the target sequence is released intact to be bound by excess probe. Cleavage of the labeled probe signals the presence of the target sequence.

Other nucleic acid amplification procedures include transcription-based amplification systems (TAS) (Kwoh et al., 1989; PCT Intl. Pat. Appl. Publ. No. WO 88/10315, incorporated herein by reference in its entirety), including nucleic acid sequence based amplification (NASBA) and 3SR. In NASBA, the nucleic acids can be prepared for amplification by standard phenol/chloroform extraction, heat denaturation of a sample, treatment with lysis buffer and minispin columns for isolation of DNA and RNA or guanidinium chloride extraction of RNA. These amplification techniques involve annealing a primer that has sequences specific to the target sequence. Following polymerization, DNA/RNA hybrids are digested with RNase H while double stranded DNA molecules are heat-denatured again. In either case the single stranded DNA is made fully double stranded by addition of second target-specific primer, followed by polymerization. The double stranded DNA molecules are then multiply transcribed by a polymerase such as T7 or SP6. In an isothermal cyclic reaction, the RNAs are reverse transcribed into DNA, and transcribed once again with a polymerase such as T7 or SP6. The resulting products, whether truncated or complete, indicate target-specific sequences.

Eur. Pat. Appl. Publ. No. 329,822, incorporated herein by reference in its entirety, disclose a nucleic acid amplification process involving cyclically synthesizing single-stranded RNA ("ssRNA"), ssDNA, and double-stranded DNA (dsDNA), which may be used in accordance with the present invention. The ssRNA is a first template for a first primer oligonucleotide, which is elongated by reverse transcriptase (RNA-dependent DNA polymerase). The RNA is then removed from resulting DNA:RNA duplex by the action of ribonuclease H (RNase H, an RNase specific for RNA in a duplex with either DNA or RNA). The resultant ssDNA is a second template for a second primer, which also includes the sequences of an RNA polymerase promoter (exemplified by T7 RNA polymerase) 5' to its homology to its template. This primer is then extended by DNA polymerase (exemplified by the large "Klenow" fragment of E. coli DNA polymerase I), resulting as a double-stranded DNA ("dsDNA") molecule, having a sequence identical to that of the original RNA between the primers and having additionally, at one end, a promoter sequence. This promoter sequence can be used by the appropriate RNA polymerase to make many RNA copies of the DNA. These copies can then re-enter the cycle leading to very swift amplification. With proper choice of enzymes, this amplification can be done isothermally without addition of enzymes at each cycle. Because of the cyclical nature of this process, the starting sequence can be chosen to be in the form of either DNA or RNA.

PCT Intl. Pat. Appl. Publ. No. WO 89/06700, incorporated herein by reference in its entirety, disclose a nucleic acid sequence amplification scheme based on the hybridization of a promoter/primer sequence to a target single-stranded DNA ("ssDNA") followed by transcription of many RNA copies of the sequence. This scheme is not cyclic; i.e. new templates are not produced from the resultant RNA transcripts. Other amplification methods include "RACE" (Frohman, 1990), and "one-sided PCR" (Ohara, 1989) which are well-known to those of skill in the art.

Methods based on ligation of two (or more) oligonucleotides in the presence of nucleic acid having the sequence of the resulting "di-oligonucleotide", thereby amplifying the di-oligonucleotide (Wu and Dean, 1996, incorporated herein by reference in its entirety), may also be used in the amplification of DNA sequences of the present invention.

4.15 In Vivo Polynucleotide Delivery Techniques

In additional embodiments, genetic constructs comprising one or more of the polynucleotides of the invention are introduced into cells in vivo. This may be achieved using any of a variety or well known approaches, several of which are outlined below for the purpose of illustration.

4.15.1 Adenovirus

One of the preferred methods for in vivo delivery of one or more nucleic acid sequences involves the use of an adenovirus expression vector. "Adenovirus expression vector" is meant to include those constructs containing adenovirus sequences sufficient to (a) support packaging of the construct and (b) to express a polynucleotide that has been cloned therein in a sense or antisense orientation. Of course, in the context of an antisense construct, expression does not require that the gene product be synthesized.

The expression vector comprises a genetically engineered form of an adenovirus. Knowledge of the genetic organization of adenovirus, a 36 kb, linear, double-stranded DNA virus, allows substitution of large pieces of adenoviral DNA with foreign sequences up to 7 kb (Grunhaus and Horwitz, 1992). In contrast to retrovirus, the adenoviral infection of host cells does not result in chromosomal integration because adenoviral DNA can replicate in an episomal manner without potential genotoxicity. Also, adenoviruses are structurally stable, and no genome rearrangement has been detected after extensive amplification. Adenovirus can infect virtually all epithelial cells regardless of their cell cycle stage. So far, adenoviral infection appears to be linked only to mild disease such as acute respiratory disease in humans.

Adenovirus is particularly suitable for use as a gene transfer vector because of its mid-sized genome, ease of manipulation, high titer, wide target-cell range and high infectivity. Both ends of the viral genome contain 100-200 base pair inverted repeats (ITRs), which are cis elements necessary for viral DNA replication and packaging. The early (E) and late (L) regions of the genome contain different transcription units that are divided by the onset of viral DNA replication. The E1 region (E1A and E1B) encodes proteins responsible for the regulation of transcription of the viral genome and a few cellular genes. The expression of the E2 region (E2A and E2B) results in the synthesis of the proteins for viral DNA replication. These proteins are involved in DNA replication, late gene expression and host cell shut-off (Renan, 1990). The products of the late genes, including the majority of the viral capsid proteins, are expressed only after significant processing of a single primary transcript issued by the major late promoter (MLP). The MLP, (located at 16.8 m.u.) is particularly efficient during the late phase of infection, and all the mRNA's issued from this promoter possess a 5'-tripartite leader (TPL) sequence which makes them preferred mRNA's for translation.

In a current system, recombinant adenovirus is generated from homologous recombination between shuttle vector and provirus vector. Due to the possible recombination between two proviral vectors, wild-type adenovirus may be generated from this process. Therefore, it is critical to isolate a single clone of virus from an individual plaque and examine its genomic structure.

Generation and propagation of the current adenovirus vectors, which are replication deficient, depend on a unique helper cell line, designated 293, which was transformed from human embryonic kidney cells by Ad5 DNA fragments and constitutively expresses E1 proteins (Graham et al., 1977). Since the E3 region is dispensable from the adenovirus genome (Jones and Shenk, 1978), the current adenovirus vectors, with the help of 293 cells, carry foreign DNA in either the E1, the D3 or both regions (Graham and Prevec, 1991). In nature, adenovirus can package approximately 105% of the wild-type genome (Ghosh-Choudhury et al., 1987), providing capacity for about 2 extra kB of DNA. Combined with the approximately 5.5 kB of DNA that is replaceable in the E1 and E3 regions, the maximum capacity of the current adenovirus vector is under 7.5 kB, or about 15% of the total length of the vector. More than 80% of the adenovirus viral genome remains in the vector backbone and is the source of vector-borne cytotoxicity. Also, the replication deficiency of the E1-deleted virus is incomplete. For example, leakage of viral gene expression has been observed with the currently available vectors at high multiplicities of infection (MOI) (Mulligan, 1993).

Helper cell lines may be derived from human cells such as human embryonic kidney cells, muscle cells, hematopoietic cells or other human embryonic mesenchymal or epithelial cells. Alternatively, the helper cells may be derived from the cells of other mammalian species that are permissive for human adenovirus. Such cells include, e.g., Vero cells or other monkey embryonic mesenchymal or epithelial cells. As stated above, the currently preferred helper cell line is 293.

Recently, Racher et al. (1995) disclosed improved methods for culturing 293 cells and propagating adenovirus. In one format, natural cell aggregates are grown by inoculating individual cells into 1 liter siliconized spinner flasks (Techne, Cambridge, UK) containing 100-200 ml of medium. Following stirring at 40 rpm, the cell viability is estimated with trypan blue. In another format, Fibra-Cel microcarriers (Bibby Sterlin, Stone, UK) (5 g/l) is employed as follows. A cell inoculum, resuspended in 5 ml of medium, is added to the carrier (50 ml) in a 250 ml Erlenmeyer flask and left stationary, with occasional agitation, for 1 to 4 h. The medium is then replaced with 50 ml of fresh medium and shaking initiated. For virus production, cells are allowed to grow to about 80% confluence, after which time the medium is replaced (to 25% of the final volume) and adenovirus added at an MOI of 0.05. Cultures are left stationary overnight, following which the volume is increased to 100% and shaking commenced for another 72 h.

Other than the requirement that the adenovirus vector be replication defective, or at least conditionally defective, the nature of the adenovirus vector is not believed to be crucial to the successful practice of the invention. The adenovirus may be of any of the 42 different known serotypes or subgroups A-F. Adenovirus type 5 of subgroup C is the preferred starting material in order to obtain a conditional replication-defective adenovirus vector for use in the present invention, since Adenovirus type 5 is a human adenovirus about which a great deal of biochemical and genetic information is known, and it has historically been used for most constructions employing adenovirus as a vector.

As stated above, the typical vector according to the present invention is replication defective and will not have an adenovirus E1 region. Thus, it will be most convenient to introduce the polynucleotide encoding the gene of interest at the position from which the E1-coding sequences have been removed. However, the position of insertion of the construct within the adenovirus sequences is not critical to the invention. The polynucleotide encoding the gene of interest may also be inserted in lieu of the deleted E3 region in E3 replacement vectors as described by Karlsson et al. (1986) or in the E4 region where a helper cell line or helper virus complements the E4 defect.

Adenovirus is easy to grow and manipulate and exhibits broad host range in vitro and in vivo. This group of viruses can be obtained in high titers, e.g., $10^9$-$10^{11}$ plaque-forming units per ml, and they are highly infective. The life cycle of adenovirus does not require integration into the host cell genome. The foreign genes delivered by adenovirus vectors are episomal and, therefore, have low genotoxicity to host cells. No side effects have been reported in studies of vaccination with wild-type adenovirus (Couch et al., 1963; Top et al., 1971), demonstrating their safety and therapeutic potential as in vivo gene transfer vectors.

Adenovirus vectors have been used in eukaryotic gene expression (Levrero et al., 1991; Gomez-Foix et al., 1992) and vaccine development (Grunhaus and Horwitz, 1992; Graham and Prevec, 1992). Recently, animal studies suggested that recombinant adenovirus could be used for gene therapy (Stratford-Perricaudet and Perricaudet, 1991; Stratford-Perricaudet et al., 1990; Rich et al., 1993). Studies in administering recombinant adenovirus to different tissues include trachea instillation (Rosenfeld et al., 1991; Rosenfeld et al., 1992), muscle injection (Ragot et al., 1993), peripheral intravenous injections (Herz and Gerard, 1993) and stereotactic inoculation into the brain (Le Gal La Salle et al., 1993).

4.15.2 Retroviruses

The retroviruses are a group of single-stranded RNA viruses characterized by an ability to convert their RNA to double-stranded DNA in infected cells by a process of reverse-transcription (Coffin, 1990). The resulting DNA then stably integrates into cellular chromosomes as a provirus and directs synthesis of viral proteins. The integration results in the retention of the viral gene sequences in the recipient cell and its descendants. The retroviral genome contains three genes, gag, pol, and env that code for capsid proteins, polymerase enzyme, and envelope components, respectively. A sequence found upstream from the gag gene contains a signal for packaging of the genome into virions. Two long terminal repeat (LTR) sequences are present at the 5' and 3' ends of the viral genome. These contain strong promoter and enhancer sequences and are also required for integration in the host cell genome (Coffin, 1990).

In order to construct a retroviral vector, a nucleic acid encoding one or more oligonucleotide or polynucleotide sequences of interest is inserted into the viral genome in the place of certain viral sequences to produce a virus that is replication-defective. In order to produce virions, a packaging cell line containing the gag, pol, and env genes but without the LTR and packaging components is constructed (Mann et al., 1983). When a recombinant plasmid containing a cDNA, together with the retroviral LTR and packaging sequences is introduced into this cell line (by calcium phosphate precipitation for example), the packaging sequence allows the RNA transcript of the recombinant plasmid to be packaged into viral particles, which are then secreted into the culture media (Nicolas and Rubenstein, 1988; Temin, 1986; Mann et al., 1983). The media containing the recombinant retroviruses is then collected, optionally concentrated, and used for gene transfer. Retroviral vectors are able to infect a broad variety of cell types. However, integration and stable expression require the division of host cells (Paskind et al., 1975).

A novel approach designed to allow specific targeting of retrovirus vectors was recently developed based on the chemical modification of a retrovirus by the chemical addition of lactose residues to the viral envelope. This modification could permit the specific infection of hepatocytes via sialoglycoprotein receptors.

A different approach to targeting of recombinant retroviruses was designed in which biotinylated antibodies against a retroviral envelope protein and against a specific cell receptor were used. The antibodies were coupled via the biotin components by using streptavidin (Roux et al., 1989). Using antibodies against major histocompatibility complex class I and class II antigens, they demonstrated the infection of a variety of human cells that bore those surface antigens with an ecotropic virus in vitro Roux et al., 1989).

4.15.3 Adeno-Associated Viruses

AAV (Ridgeway, 1988; Hermonat and Muzycska, 1984) is a parovirus, discovered as a contamination of adenoviral stocks. It is a ubiquitous virus (antibodies are present in 85% of the US human population) that has not been linked to any disease. It is also classified as a dependovirus, because its replications is dependent on the presence of a helper virus, such as adenovirus. Five serotypes have been isolated, of which AAV-2 is the best characterized. AAV has a single-stranded linear DNA that is encapsidated into capsid proteins VP1, VP2 and VP3 to form an icosahedral virion of 20 to 24 nm in diameter (Muzyczka and McLaughlin, 1988).

The AAV DNA is approximately 4.7 kilobases long. It contains two open reading frames and is flanked by two ITRs. There are two major genes in the AAV genome: rep and cap. The rep gene codes for proteins responsible for viral replications, whereas cap codes for capsid protein VP1-3. Each ITR forms a T-shaped hairpin structure. These terminal repeats are the only essential cis components of the AAV for chromosomal integration. Therefore, the AAV can be used as a vector with all viral coding sequences removed and replaced by the cassette of genes for delivery. Three viral promoters have been identified and named p5, p19, and p40, according to their map position. Transcription from p5 and p19 results in production of rep proteins, and transcription from p40 produces the capsid proteins (Hermonat and Muzyczka, 1984).

There are several factors that prompted researchers to study the possibility of using rAAV as an expression vector. One is that the requirements for delivering a gene to integrate into the host chromosome are surprisingly few. It is necessary to have the 145-bp ITRs, which are only 6% of the AAV genome. This leaves room in the vector to assemble a 4,5-kb DNA insertion. While this carrying capacity may prevent the AAV from delivering large genes, it is amply suited for delivering the antisense constructs of the present invention.

AAV is also a good choice of delivery vehicles due to its safety. There is a relatively complicated rescue mechanism: not only wild type adenovirus but also AAV genes are required to mobilize rAAV. Likewise, AAV is not pathogenic and not associated with any disease. The removal of viral coding sequences minimizes immune reactions to viral gene expression, and therefore, rAAV does not evoke an inflammatory response.

4.15.4 Other Viral Vectors as Expression Constructs

Other viral vectors may be employed as expression constructs in the present invention for the delivery of oligonucleotide or polynucleotide sequences to a host cell. Vectors derived from viruses such as vaccinia virus (Ridgeway, 1988; Coupar et al., 1988), lentiviruses, polio viruses and herpes viruses may be employed. They offer several attractive features for various mammalian cells (Friedmann, 1989; Ridgeway, 1988; Coupar et al., 1988; Horwich et al., 1990).

With the recent recognition of defective hepatitis B viruses, new insight was gained into the structure-function relationship of different viral sequences. In vitro studies showed that the virus could retain the ability for helper-dependent packaging and reverse transcription despite the deletion of up to 80% of its genome (Horwich et al., 1990). This suggested that large portions of the genome could be replaced with foreign genetic material. The hepatotropism and persistence (integration) were particularly attractive properties for liver-directed gene transfer. Chang et al. (1991) introduced the chloramphenicol acetyltransferase (CAT) gene into duck hepatitis B virus genome in the place of the polymerase, surface, and pre-surface coding sequences. It was cotransfected with wild-type virus into an avian hepatoma cell line. Culture media containing high titers of the recombinant virus were used to infect primary duckling hepatocytes. Stable CAT gene expression was detected for at least 24 days after transfection (Chang et al., 1991).

4.15.5 Non-Viral Vectors

In order to effect expression of the oligonucleotide or polynucleotide sequences of the present invention, the expression construct must be delivered into a cell. This delivery may be accomplished in vitro, as in laboratory procedures for transforming cells lines, or in vivo or ex vivo, as in the treatment of certain disease states. As described above, one preferred mechanism for delivery is via viral infection where the expression construct is encapsulated in an infectious viral particle.

Once the expression construct has been delivered into the cell the nucleic acid encoding the desired oligonucleotide or polynucleotide sequences may be positioned and expressed at different sites. In certain embodiments, the nucleic acid encoding the construct may be stably integrated into the genome of the cell. This integration may be in the specific location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle. How the expression construct is delivered to a cell and where in the cell the nucleic acid remains is dependent on the type of expression construct employed.

In certain embodiments of the invention, the expression construct comprising one or more oligonucleotide or polynucleotide sequences may simply consist of naked recombinant DNA or plasmids. Transfer of the construct may be performed by any of the methods mentioned above which physically or chemically permeabilize the cell membrane. This is particularly applicable for transfer in vitro but it may be applied to in vivo use as well. Dubensky et al. (1984) successfully injected polyomavirus DNA in the form of calcium phosphate precipitates into liver and spleen of adult and newborn mice demonstrating active viral replication and acute infection. Benvenisty and Reshef (1986) also demonstrated that direct intraperitoneal injection of calcium phosphate-precipitated plasmids results in expression of the transfected genes. It is envisioned that DNA encoding a gene of interest may also be transferred in a similar manner in vivo and express the gene product.

Another embodiment of the invention for transferring a naked DNA expression construct into cells may involve particle bombardment. This method depends on the ability to accelerate DNA-coated microprojectiles to a high velocity allowing them to pierce cell membranes and enter cells without killing them (Klein et al., 1987). Several devices for accelerating small particles have been developed. One such device relies on a high voltage discharge to generate an electrical current, which in turn provides the motive force (Yang et al., 1990). The microprojectiles used have consisted of biologically inert substances such as tungsten or gold beads.

Selected organs including the liver, skin, and muscle tissue of rats and mice have been bombarded in vivo (Yang et al., 1990; Zelenin et al., 1991). This may require surgical exposure of the tissue or cells, to eliminate any intervening tissue between the gun and the target organ, i.e. ex vivo treatment. Again, DNA encoding a particular gene may be delivered via this method and still be incorporated by the present invention.

4.16 Antisense Oligonucleotides

The end result of the flow of genetic information is the synthesis of protein. DNA is transcribed by polymerases into messenger RNA and translated on the ribosome to yield a folded, functional protein. Thus there are several steps along the route where protein synthesis can be inhibited. The native DNA segment coding for a polypeptide described herein, as all such mammalian DNA strands, has two strands: a sense strand and an antisense strand held together by hydrogen bonding. The messenger RNA coding for polypeptide has the same nucleotide sequence as the sense DNA strand except that the DNA thymidine is replaced by uridine. Thus, synthetic antisense nucleotide sequences will bind to a mRNA and inhibit expression of the protein encoded by that mRNA.

The targeting of antisense oligonucleotides to mRNA is thus one mechanism to shut down protein synthesis, and, consequently, represents a powerful and targeted therapeutic approach. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829, each specifically incorporated herein by reference in its entirety). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., 1988; Vasanthakumar and Ahmed, 1989; Peris et al., 1998; U.S. Pat. No. 5,801,154; U.S. Pat. No. 5,789,573; U.S. Pat. No. 5,718,709 and U.S. Pat. No. 5,610,288, each specifically incorporated herein by reference in its entirety). Antisense constructs have also been described that inhibit and can be used to treat a variety of abnormal cellular proliferations, e.g. cancer (U.S. Pat. No. 5,747,470; U.S. Pat. No. 5,591,317 and U.S. Pat. No. 5,783,683, each specifically incorporated herein by reference in its entirety).

Therefore, in exemplary embodiments, the invention provides oligonucleotide sequences that comprise all, or a portion of, any sequence that is capable of specifically binding to polynucleotide sequence described herein, or a complement thereof. In one embodiment, the antisense oligonucleotides comprise DNA or derivatives thereof. In another embodiment, the oligonucleotides comprise RNA or derivatives thereof. In a third embodiment, the oligonucleotides are modified DNAs comprising a phosphorothioated modified backbone. In a fourth embodiment, the oligonucleotide sequences comprise peptide nucleic acids or derivatives thereof. In each case, preferred compositions comprise a sequence region that is complementary, and more preferably substantially-complementary, and even more preferably, completely complementary to one or more portions of polynucleotides disclosed herein.

Selection of antisense compositions specific for a given gene sequence is based upon analysis of the chosen target sequence (i.e. in these illustrative examples the rat and human sequences) and determination of secondary structure, $T_m$, binding energy, relative stability, and antisense compositions were selected based upon their relative inability to form dimers, hairpins, or other secondary structures that would reduce or prohibit specific binding to the target mRNA in a host cell.

Highly preferred target regions of the mRNA, are those which are at or near the AUG translation initiation codon, and those sequences which were substantially complementary to 5' regions of the mRNA. These secondary structure analyses and target site selection considerations were performed using v.4 of the OLIGO primer analysis software (Rychlik, 1997) and the BLASTN 2.0.5 algorithm software (Altschul et al., 1997).

The use of an antisense delivery method employing a short peptide vector, termed MPG (27 residues), is also contemplated. The MPG peptide contains a hydrophobic domain derived from the fusion sequence of HIV gp41 and a hydrophilic domain from the nuclear localization sequence of SV40 T-antigen (Morris et al., 1997). It has been demonstrated that several molecules of the MPG peptide coat the antisense oligonucleotides and can be delivered into cultured mammalian cells in less than 1 hour with relatively high efficiency (90%). Further, the interaction with MPG strongly increases both the stability of the oligonucleotide to nuclease and the ability to cross the plasma membrane (Morris et al., 1997).

4.17 Ribozymes

Although proteins traditionally have been used for catalysis of nucleic acids, another class of macromolecules has emerged as useful in this endeavor. Ribozymes are RNA-protein complexes that cleave nucleic acids in a site-specific fashion. Ribozymes have specific catalytic domains that possess endonuclease activity (Kim and Cech, 1987; Gerlach et al., 1987; Forster and Symons, 1987). For example, a large number of ribozymes accelerate phosphoester transfer reactions with a high degree of specificity, often cleaving only one of several phosphoesters in an oligonucleotide substrate (Cech et al., 1981; Michel and Westhof, 1990; Reinhold-Hurek and Shub, 1992). This specificity has been attributed to the requirement that the substrate bind via specific base-pairing interactions to the internal guide sequence ("IGS") of the ribozyme prior to chemical reaction.

Ribozyme catalysis has primarily been observed as part of sequence-specific cleavage/ligation reactions involving nucleic acids (Joyce, 1989; Cech et al., 1981). For example, U.S. Pat. No. 5,354,855 (specifically incorporated herein by reference) reports that certain ribozymes can act as endonucleases with a sequence specificity greater than that of known ribonucleases and approaching that of the DNA restriction enzymes. Thus, sequence-specific ribozyme-mediated inhibition of gene expression may be particularly suited to therapeutic applications (Scanlon et al., 1991; Sarver et al., 1990). Recently, it was reported that ribozymes elicited genetic changes in some cells lines to which they were applied; the altered genes included the oncogenes H-ras, c-fos and genes of HIV. Most of this work involved the modification of a target mRNA, based on a specific mutant codon that is cleaved by a specific ribozyme.

Six basic varieties of naturally-occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over many technologies, such as antisense technology (where a nucleic acid molecule simply binds to a nucleic acid target to block its translation) since the concentration of ribozyme necessary to affect a therapeutic treatment is lower than that of an antisense oligonucleotide. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base pairing mechanism of binding to the target RNA, but also on the mechanism of target RNA cleavage. Single mismatches, or base-substitutions, near the site of cleavage can completely eliminate catalytic activity of a ribozyme. Similar mismatches in antisense molecules do not prevent their action (Woolf et al., 1992). Thus, the specificity of action of a ribozyme is greater than that of an antisense oligonucleotide binding the same RNA site.

The enzymatic nucleic acid molecule may be formed in a hammerhead, hairpin, a hepatitis δ virus, group I intron or RNaseP RNA (in association with an RNA guide sequence) or *Neurospora* VS RNA motif. Examples of hammerhead motifs are described by Rossi et al. (1992). Examples of hairpin motifs are described by Hampel et al. (Eur. Pat. Appl. Publ. No. EP 0360257), Hampel and Tritz (1989), Hampel et al. (1990) and U.S. Pat. No. 5,631,359 (specifically incorporated herein by reference). An example of the hepatitis δ virus motif is described by Perrotta and Been (1992); an example of the RNaseP motif is described by Guerrier-Takada et al. (1983); *Neurospora* VS RNA ribozyme motif is described by Collins (Saville and Collins, 1990; Saville and Collins, 1991; Collins and Olive, 1993); and an example of the Group I intron is described in (U.S. Pat. No. 4,987,071, specifically incorporated herein by reference). All that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule. Thus the ribozyme constructs need not be limited to specific motifs mentioned herein.

In certain embodiments, it may be important to produce enzymatic cleaving agents which exhibit a high degree of specificity for the RNA of a desired target, such as one of the sequences disclosed herein. The enzymatic nucleic acid molecule is preferably targeted to a highly conserved sequence region of a target mRNA. Such enzymatic nucleic acid molecules can be delivered exogenously to specific cells as required. Alternatively, the ribozymes can be expressed from DNA or RNA vectors that are delivered to specific cells.

Small enzymatic nucleic acid motifs (e.g., of the hammerhead or the hairpin structure) may also be used for exogenous delivery. The simple structure of these molecules increases the ability of the enzymatic nucleic acid to invade targeted regions of the mRNA structure. Alternatively, catalytic RNA molecules can be expressed within cells from eukaryotic promoters (e.g., Scanlon et al., 1991; Kashani-Sabet et al., 1992; Dropulic et al., 1992; Weerasinghe et al., 1991; Ojwang et al., 1992; Chen et al., 1992; Sarver et al., 1990). Those skilled in the art realize that any ribozyme can be expressed in eukaryotic cells from the appropriate DNA vector. The activity of such ribozymes can be augmented by their release from the primary transcript by a second ribozyme (Int. Pat. Appl. Publ. No. WO 93/23569, and Int. Pat. Appl. Publ. No. WO 94/02595, both hereby incorporated by reference; Ohkawa et al., 1992; Taira et al., 1991; and Ventura et al., 1993).

Ribozymes may be added directly, or can be complexed with cationic lipids, lipid complexes, packaged within liposomes, or otherwise delivered to target cells. The RNA or RNA complexes can be locally administered to relevant tissues ex vivo, or in vivo through injection, aerosol inhalation, infusion pump or stent, with or without their incorporation in biopolymers.

Ribozymes may be designed as described in Int. Pat. Appl. Publ. No. WO 93/23569 and Int. Pat. Appl. Publ. No. WO 94/02595, each specifically incorporated herein by reference) and synthesized to be tested in vitro and in vivo, as described. Such ribozymes can also be optimized for delivery. While specific examples are provided, those in the art will recognize that equivalent RNA targets in other species can be utilized when necessary.

Hammerhead or hairpin ribozymes may be individually analyzed by computer folding (Jaeger et al., 1989) to assess whether the ribozyme sequences fold into the appropriate secondary structure. Those ribozymes with unfavorable intramolecular interactions between the binding arms and the catalytic core are eliminated from consideration. Varying binding arm lengths can be chosen to optimize activity. Generally, at least 5 or so bases on each arm are able to bind to, or otherwise interact with, the target RNA.

Ribozymes of the hammerhead or hairpin motif may be designed to anneal to various sites in the mRNA message, and can be chemically synthesized. The method of synthesis used follows the procedure for normal RNA synthesis as described in Usman et al. (1987) and in Scaringe et al. (1990) and makes use of common nucleic acid protecting and coupling groups, such as dimethoxytrityl at the 5'-end, and phosphoramidites at the 3'-end. Average stepwise coupling yields are typically >98%. Hairpin ribozymes may be synthesized in two parts and annealed to reconstruct an active ribozyme (Chowrira and Burke, 1992). Ribozymes may be modified extensively to enhance stability by modification with nuclease resistant groups, for example, 2'-amino, 2'-C-allyl, 2'-fluoro, 2'-o-methyl, 2'-H (for a review see e.g. Usman and Cedergren, 1992). Ribozymes may be purified by gel electrophoresis using general methods or by high pressure liquid chromatography and resuspended in water.

Ribozyme activity can be optimized by altering the length of the ribozyme binding arms, or chemically synthesizing ribozymes with modifications that prevent their degradation by serum ribonucleases (see e.g., Int. Pat. Appl. Publ. No. WO 92/07065; Perrault et al, 1990; Pieken et al., 1991; Usman and Cedergren, 1992; Int. Pat. Appl. Publ. No. WO 93/15187; Int. Pat. Appl. Publ. No. WO 91/03162; Eur. Pat. Appl. Publ. No. 92110298.4; U.S. Pat. No. 5,334,711; and Int. Pat. Appl. Publ. No. WO 94/13688, which describe various chemical modifications that can be made to the sugar moieties of enzymatic RNA molecules), modifications which enhance their efficacy in cells, and removal of stem II bases to shorten RNA synthesis times and reduce chemical requirements.

Sullivan et al. (Int. Pat. Appl. Publ. No. WO 94/02595) describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination may be locally delivered by direct inhalation, by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Int. Pat. Appl. Publ. No. WO 94/02595 and Int. Pat. Appl. Publ. No. WO 93/23569, each specifically incorporated herein by reference.

Another means of accumulating high concentrations of a ribozyme(s) within cells is to incorporate the ribozyme-encoding sequences into a DNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters may also be used, providing that the prokaryotic RNA polymerase enzyme is expressed in the appropriate cells (Elroy-Stein and Moss, 1990; Gao and Huang, 1993; Lieber et al., 1993; Zhou et al., 1990). Ribozymes expressed from such promoters can function in mammalian cells (e.g. Kashani-Saber et al., 1992; Ojwang et al., 1992; Chen et al., 1992; Yu et al., 1993; L'Huillier et al., 1992; Lisziewicz et al., 1993). Such transcription units can be incorporated into a variety of vectors for introduction into mammalian cells, including but not restricted to, plasmid DNA vectors, viral DNA vectors (such as adenovirus or adeno-associated vectors), or viral RNA vectors (such as retroviral, semliki forest virus, sindbis virus vectors).

Ribozymes may be used as diagnostic tools to examine genetic drift and mutations within diseased cells. They can also be used to assess levels of the target RNA molecule. The close relationship between ribozyme activity and the structure of the target RNA allows the detection of mutations in any region of the molecule which alters the base-pairing and three-dimensional structure of the target RNA. By using multiple ribozymes, one may map nucleotide changes which are important to RNA structure and function in vitro, as well as in cells and tissues. Cleavage of target RNAs with ribozymes may be used to inhibit gene expression and define the role (essentially) of specified gene products in the progression of disease. In this manner, other genetic targets may be defined as important mediators of the disease. These studies will lead to better treatment of the disease progression by affording the possibility of combinational therapies (e.g., multiple ribozymes targeted to different genes, ribozymes coupled with known small molecule inhibitors, or intermittent treatment with combinations of ribozymes and/or other chemical or biological molecules). Other in vitro uses of ribozymes are well known in the art, and include detection of the presence of mRNA associated with an IL-5 related condition. Such RNA is detected by determining the presence of a cleavage product after treatment with a ribozyme using standard methodology.

4.18 Peptide Nucleic Acids

In certain embodiments, the inventors contemplate the use of peptide nucleic acids (PNAs) in the practice of the methods of the invention. PNA is a DNA mimic in which the nucleobases are attached to a pseudopeptide backbone (Good and Nielsen, 1997). PNA is able to be utilized in a number methods that traditionally have used RNA or DNA. Often PNA sequences perform better in techniques than the corresponding RNA or DNA sequences and have utilities that are not inherent to RNA or DNA. A review of PNA including methods of making, characteristics of, and methods of using, is provided by Corey (1997) and is incorporated herein by reference. As such, in certain embodiments, one may prepare PNA sequences that are complementary to one or more portions of the ACE mRNA sequence, and such PNA compositions may be used to regulate, alter, decrease, or reduce the translation of ACE-specific mRNA, and thereby alter the level of ACE activity in a host cell to which such PNA compositions have been administered.

PNAs have 2-aminoethyl-glycine linkages replacing the normal phosphodiester backbone of DNA (Nielsen et al., 1991; Hanvey et al., 1992; Hyrup and Nielsen, 1996; Neilsen, 1996). This chemistry has three important consequences: firstly, in contrast to DNA or phosphorothioate oligonucleotides, PNAs are neutral molecules; secondly, PNAs are achiral, which avoids the need to develop a stereoselective synthesis; and thirdly, PNA synthesis uses standard Boc (Dueholm et al., 1994) or Fmoc (Thomson et al., 1995) protocols for solid-phase peptide synthesis, although other methods, including a modified Merrifield method, have been used (Christensen et al., 1995).

PNA monomers or ready-made oligomers are commercially available from PerSeptive Biosystems (Framingham, Mass.). PNA syntheses by either Boc or Fmoc protocols are straightforward using manual or automated protocols (Norton et al., 1995). The manual protocol lends itself to the production of chemically modified PNAs or the simultaneous synthesis of families of closely related PNAs.

As with peptide synthesis, the success of a particular PNA synthesis will depend on the properties of the chosen sequence. For example, while in theory PNAs can incorporate any combination of nucleotide bases, the presence of adjacent purines can lead to deletions of one or more residues in the product. In expectation of this difficulty, it is suggested that, in producing PNAs with adjacent purines, one should repeat the coupling of residues likely to be added inefficiently. This should be followed by the purification of PNAs by reverse-phase high-pressure liquid chromatography (Norton et al., 1995) providing yields and purity of product similar to those observed during the synthesis of peptides.

Modifications of PNAs for a given application may be accomplished by coupling amino acids during solid-phase synthesis or by attaching compounds that contain a carboxylic acid group to the exposed N-terminal amine. Alternatively, PNAs can be modified after synthesis by coupling to an introduced lysine or cysteine. The ease with which PNAs can be modified facilitates optimization for better solubility or for specific functional requirements. Once synthesized, the identity of PNAs and their derivatives can be confirmed by mass spectrometry. Several studies have made and utilized modifications of PNAs (Norton et al., 1995; Haaima et al., 1996; Stetsenko et al., 1996; Petersen et al., 1995; Ulmann et al., 1996; Koch et al., 1995; Orum et al., 1995; Footer et al., 1996; Griffith et al., 1995; Kremsky et al., 1996; Pardridge et al., 1995; Boffa et al., 1995; Landsdorp et al., 1996; Gambacorti-Passerini et al., 1996; Armitage et al., 1997; Seeger et al., 1997; Ruskowski et al., 1997). U.S. Pat. No. 5,700,922 discusses PNA-DNA-PNA chimeric molecules and their uses in diagnostics, modulating protein in organisms, and treatment of conditions susceptible to therapeutics.

In contrast to DNA and RNA, which contain negatively charged linkages, the PNA backbone is neutral. In spite of this dramatic alteration, PNAs recognize complementary DNA and RNA by Watson-Crick pairing (Egholm et al., 1993), validating the initial modeling by Nielsen et al. (1991). PNAs lack 3' to 5' polarity and can bind in either parallel or anti-parallel fashion, with the anti-parallel mode being preferred (Egholm et al., 1993).

Hybridization of DNA oligonucleotides to DNA and RNA is destabilized by electrostatic repulsion between the negatively charged phosphate backbones of the complementary strands. By contrast, the absence of charge repulsion in PNA-DNA or PNA-RNA duplexes increases the melting temperature ($T_m$) and reduces the dependence of $T_m$ on the concentration of mono- or divalent cations (Nielsen et al., 1991). The enhanced rate and affinity of hybridization are significant because they are responsible for the surprising ability of PNAs to perform strand invasion of complementary sequences within relaxed double-stranded DNA. In addition, the efficient hybridization at inverted repeats suggests that PNAs can recognize secondary structure effectively within double-stranded DNA. Enhanced recognition also occurs with PNAs immobilized on surfaces, and Wang et al. have shown that support-bound PNAs can be used to detect hybridization events (Wang et al., 1996).

One might expect that tight binding of PNAs to complementary sequences would also increase binding to similar (but not identical) sequences, reducing the sequence specificity of PNA recognition. As with DNA hybridization, however, selective recognition can be achieved by balancing oligomer length and incubation temperature. Moreover, selective hybridization of PNAs is encouraged by PNA-DNA hybridization being less tolerant of base mismatches than DNA-DNA hybridization. For example, a single mismatch within a 16 bp PNA-DNA duplex can reduce the $T_m$ by up to 15° C. (Egholm et al., 1993). This high level of discrimination has allowed the development of several PNA-based strategies for the analysis of point mutations (Wang et al., 1996; Carlsson et al., 1996; Thiede et al., 1996; Webb and Hurskainen, 1996; Perry-O'Keefe et al., 1996).

High-affinity binding provides clear advantages for molecular recognition and the development of new applications for PNAs. For example, 11-13 nucleotide PNAs inhibit the activity of telomerase, a ribonucleo-protein that extends telomere ends using an essential RNA template, while the analogous DNA oligomers do not (Norton et al., 1996).

Neutral PNAs are more hydrophobic than analogous DNA oligomers, and this can lead to difficulty solubilizing them at neutral pH, especially if the PNAs have a high purine content or if they have the potential to form secondary structures. Their solubility can be enhanced by attaching one or more positive charges to the PNA termini (Nielsen et al., 1991).

Findings by Allfrey and colleagues suggest that strand invasion will occur spontaneously at sequences within chromosomal DNA (Boffa et al., 1995; Boffa et al., 1996). These studies targeted PNAs to triplet repeats of the nucleotides CAG and used this recognition to purify transcriptionally active DNA (Boffa et al., 1995) and to inhibit transcription (Boffa et al., 1996). This result suggests that if PNAs can be delivered within cells then they will have the potential to be general sequence-specific regulators of gene expression. Studies and reviews concerning the use of PNAs as antisense and anti-gene agents include Nielsen et al. (1993b), Hanvey et al. (1992), and Good and Nielsen (1997). Koppelhus et al. (1997) have used PNAs to inhibit HIV-1 inverse transcription, showing that PNAs may be used for antiviral therapies.

Methods of characterizing the antisense binding properties of PNAs are discussed in Rose (1993) and Jensen et al. (1997). Rose uses capillary gel electrophoresis to determine binding of PNAs to their complementary oligonucleotide, measuring the relative binding kinetics and stoichiometry. Similar types of measurements were made by Jensen et al. using BIAcore™ technology.

Other applications of PNAs include use in DNA strand invasion (Nielsen et al., 1991), antisense inhibition (Hanvey et al., 1992), mutational analysis (Orum et al., 1993), enhancers of transcription (Mollegaard et al., 1994), nucleic acid purification (Orum et al., 1995), isolation of transcriptionally active genes (Boffa et al., 1995), blocking of transcription factor binding (Vickers et al., 1995), genome cleavage (Veselkov et al., 1996), biosensors (Wang et al., 1996), in situ hybridization (Thisted et al., 1996), and in a alternative to Southern blotting (Perry-O'Keefe, 1996).

4.19 Polypeptide, Peptides and Peptide Variants

The present invention, in other aspects, provides polypeptide compositions. Generally, a polypeptide of the invention will be an isolated polypeptide (or an epitope, variant, or active fragment thereof) derived from a mammalian species. Preferably, the polypeptide is encoded by a polynucleotide sequence disclosed herein or a sequence which hybridizes under moderately stringent conditions to a polynucleotide sequence disclosed herein. Alternatively, the polypeptide may be defined as a polypeptide which comprises a contiguous amino acid sequence from an amino acid sequence disclosed herein, or which polypeptide comprises an entire amino acid sequence disclosed herein.

In the present invention, a polypeptide composition is also understood to comprise one or more polypeptides that are immunologically reactive with antibodies generated against a polypeptide of the invention, particularly a polypeptide having the amino acid sequence encoded by the disclosed polynucleotides, or to active fragments, or to variants or biological functional equivalents thereof.

Likewise, a polypeptide composition of the present invention is understood to comprise one or more polypeptides that are capable of eliciting antibodies that are immunologically reactive with one or more polypeptides encoded by one or more contiguous nucleic acid sequences disclosed in this application, or to active fragments, or to variants thereof, or to one or more nucleic acid sequences which hybridize to one or more of these sequences under conditions of moderate to high stringency.

As used herein, an active fragment of a polypeptide includes a whole or a portion of a polypeptide which is modified by conventional techniques, e.g., mutagenesis, or by addition, deletion, or substitution, but which active fragment exhibits substantially the same structure function, antigenicity, etc., as a polypeptide as described herein.

In certain illustrative embodiments, the polypeptides of the invention will comprise at least an immunogenic portion of a hematological malignancy-related tumor protein or a variant thereof, as described herein. As noted above, a "hematological malignancy-related tumor protein" is a protein that is expressed by hematological malignancy-related tumor cells. Proteins that are hematological malignancy-related tumor proteins also react detectably within an immunoassay (such as an ELISA) with antisera from a patient with hematological malignancy. Polypeptides as described herein may be of any length. Additional sequences derived from the native protein and/or heterologous sequences may be present, and such sequences may (but need not) possess further immunogenic or antigenic properties.

An "immunogenic portion," as used herein is a portion of a protein that is recognized (i.e., specifically bound) by a B-cell and/or T-cell surface antigen receptor. Such immunogenic portions generally comprise at least 5 amino acid residues, more preferably at least 10, and still more preferably at least 20 amino acid residues of a hematological malignancy-related tumor protein or a variant thereof. Certain preferred immunogenic portions include peptides in which an N-terminal leader sequence and/or transmembrane domain have been deleted. Other preferred immunogenic portions may contain a small N- and/or C-terminal deletion (e.g., 1-30 amino acids, preferably 5-15 amino acids), relative to the mature protein.

Immunogenic portions may generally be identified using well known techniques, such as those summarized in Paul, *Fundamental Immunology*, 3rd ed., 243-247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well known techniques. An immunogenic portion of a native hematological malignancy-related tumor protein is a portion that reacts with such antisera and/or T-cells at a level that is not substantially less than the reactivity of the full length polypeptide (e.g., in an ELISA and/or T-cell reactivity assay). Such immunogenic portions may react within such assays at a level that is similar to or greater than the reactivity of the full length polypeptide. Such screens may generally be performed using methods well known to those of ordinary skill in the art, such as those described in Harlow and Lane, *Antibodies: A Laboratory Manual*, Cold Spring Harbor Laboratory, 1988. For example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As noted above, a composition may comprise a variant of a native hematological malignancy-related tumor protein. A polypeptide "variant," as used herein, is a polypeptide that differs from a native hematological malignancy-related tumor protein in one or more substitutions, deletions, additions and/or insertions, such that the immunogenicity of the polypeptide is not substantially diminished. In other words, the ability of a variant to react with antigen-specific antisera may be enhanced or unchanged, relative to the native protein, or may be diminished by less than 50%, and preferably less than 20%, relative to the native protein. Such variants may generally be identified by modifying one of the above polypeptide sequences and evaluating the reactivity of the modified polypeptide with antigen-specific antibodies or antisera as described herein. Preferred variants include those in which one or more portions, such as an N-terminal leader sequence or transmembrane domain, have been removed. Other preferred variants include variants in which a small portion (e.g., 1-30 amino acids, preferably 5-15 amino acids) has been removed from the N- and/or C-terminal of the mature protein.

Polypeptide variants encompassed by the present invention include those exhibiting at least about 70%, 75%, 80%, 85%, 90%, 91%, 92%, 93%, 94%, 95%, 96%, 97%, 98%, or 99% or more identity (determined as described above) to the polypeptides disclosed herein.

Preferably, a variant contains conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr, (2) cys, ser, tyr, thr; (3) vat, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

Polypeptides may be prepared using any of a variety of well known techniques. Recombinant polypeptides encoded by DNA sequences as described above may be readily prepared from the DNA sequences using any of a variety of expression vectors known to those of ordinary skill in the art. Expression may be achieved in any appropriate host cell that has been transformed or transfected with an expression vector containing a DNA molecule that encodes a recombinant polypeptide. Suitable host cells include prokaryotes, yeast, and higher eukaryotic cells, such as mammalian cells and plant cells. Preferably, the host cells employed are *E. coli*, yeast or a mammalian cell line such as COS or CHO. Supernatants from suitable host/vector systems which secrete recombinant protein or polypeptide into culture media may be first concentrated using a commercially available filter. Following concentration, the concentrate may be applied to a suitable purification matrix such as an affinity matrix or an ion exchange resin. Finally, one or more reverse phase HPLC steps can be employed to further purify a recombinant polypeptide.

Portions and other variants having less than about 100 amino acids, and generally less than about 50 amino acids, may also be generated by synthetic means, using techniques well known to those of ordinary skill in the art. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149-2146, 1963. Equipment for automated synthesis of polypeptides is commercially available from suppliers such as Perkin Elmer/Applied Bio-Systems Division (Foster City, Calif.), and may be operated according to the manufacturer's instructions.

Within certain specific embodiments, a polypeptide may be a fusion protein that comprises multiple polypeptides as described herein, or that comprises at least one polypeptide as described herein and an unrelated sequence, such as a known tumor protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the protein or to enable the protein to be targeted to desired intracellular compartments. Still further fusion partners include affinity tags, which facilitate purification of the protein.

Fusion proteins may generally be prepared using standard techniques, including chemical conjugation. Preferably, a fusion protein is expressed as a recombinant protein, allowing the production of increased levels, relative to a non-fused protein, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion protein that retains the biological activity of both component polypeptides.

A peptide linker sequence may be employed to separate the first and second polypeptide components by a distance sufficient to ensure that each polypeptide folds into its secondary and tertiary structures. Such a peptide linker sequence is incorporated into the fusion protein using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:3946, 1985; Murphy et al., *Proc. Natl. Acad. Sci. USA* 83:8258-8262, 1986; U.S. Pat. No. 4,935,233 and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

Fusion proteins are also provided. Such proteins comprise a polypeptide as described herein together with an unrelated immunogenic protein. Preferably the immunogenic protein is capable of eliciting a recall response. Examples of such proteins include tetanus, tuberculosis and hepatitis proteins (see, for example, Stoute et al. *New Engl. J. Med.*, 336:86-91, 1997).

Within preferred embodiments, an immunological fusion partner is derived from protein D, a surface protein of the gram-negative bacterium *Haemophilus influenza* B (WO 91/18926). Preferably, a protein D derivative comprises approximately the first third of the protein (e.g., the first N-terminal 100-110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in *E. coli* (thus functioning as an expression enhancer). The lipid tail ensures optimal presentation of the antigen to antigen presenting cells. Other fusion partners include the non-structural protein from influenzae virus, NS1 (hemagglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from *Streptococcus pneumoniae*, which synthesizes an N-acetyl-L-alanine amidase known as amidase LYTA (encoded by the LytA gene; *Gene* 43:265-292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of *E. coli* C-LYTA expressing plasmids useful for expression of fusion proteins. Purification of hybrid proteins containing the C-LYTA fragment at the amino terminus has been described (see *Biotechnology* 10:795-798, 1992). Within a preferred embodiment, a repeat portion of LYTA may be incorporated into a fusion protein. A repeat portion is found in the C-terminal region starting at residue 178. A particularly preferred repeat portion incorporates residues 188-305.

In general, polypeptides (including fusion proteins) and polynucleotides as described herein are isolated. An "isolated" polypeptide or polynucleotide is one that is removed from its original environment. For example, a naturally-occurring protein is isolated if it is separated from some or all of the coexisting materials in the natural system. Preferably, such polypeptides are at least about 90% pure, more preferably at least about 95% pure and most preferably at least about 99% pure. A polynucleotide is considered to be isolated if, for example, it is cloned into a vector that is not a part of the natural environment.

4.20 Binding Agents

The present invention further employs agents, such as antibodies and antigen-binding fragments thereof, that specifically bind to a hematological malignancy-related antigen. As used herein, an antibody, or antigen-binding fragment thereof, is said to "specifically bind" to a hematological malignancy-related antigen if it reacts at a detectable level (within, for example, an ELISA) with, and does not react detectably with unrelated proteins under similar conditions. As used herein, "binding" refers to a noncovalent association between two separate molecules such that a complex is formed. The ability to bind may be evaluated by, for example, determining a binding constant for the formation of the complex. The binding constant is the value obtained when the concentration of the complex is divided by the product of the component concentrations. In general, two compounds are said to "bind," in the context of the present invention, when the binding constant for complex formation exceeds about $10^3$ L/mol. The binding constant maybe determined using methods well known in the art.

Binding agents may be further capable of differentiating between patients with and without a hematological malignancy. Such binding agents generate a signal indicating the presence of a hematological malignancy in at least about 20% of patients with the disease, and will generate a negative signal indicating the absence of the disease in at least about 90% of individuals without the disease. To determine whether a binding agent satisfies this requirement, biological samples (e.g., blood, sera, urine and/or tumor biopsies) from patients with and without a hematological malignancy (as determined using standard clinical tests) may be assayed as described herein for the presence of polypeptides that bind to the binding agent. It will be apparent that a statistically significant number of samples with and without the disease should be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511-519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, *Antibodies: A Laboratory Manual*, Cold Spring Harbor Laboratory, 1988) and digested by papain to yield Fab and Fc fragments. The Fab and Fc fragments may be separated by affinity chromatography on protein A bead columns.

Monoclonal antibodies, and fragments thereof, of the present invention may be coupled to one or more therapeutic agents, such as radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, Pseudomonas exotoxin, Shigella toxin, and pokeweed antiviral protein. For certain in vivo and ex vivo therapies, an antibody or fragment thereof is preferably coupled to a cytotoxic agent, such as a radioactive or chemotherapeutic moiety.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710), by irradiation of a photolabile bond (e.g., U.S. Pat. No. 4,625,014), by hydrolysis of derivatized amino acid side chains (e.g., U.S. Pat. No. 4,638,045), by serum complement-mediated hydrolysis (e.g., U.S. Pat. No. 4,671,958), and acid-catalyzed hydrolysis (e.g., U.S. Pat. No. 4,569,789).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers which provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234), peptides and polysaccharides such as aminodextran (e.g., U.S. Pat. No. 4,699,784). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562 discloses representative chelating compounds and their synthesis.

A variety of routes of administration for the antibodies and immunoconjugates may be used. Typically, administration will be intravenous, intramuscular, subcutaneous or in the bed of a resected tumor. It will be evident that the precise dose of the antibody/immunoconjugate will vary depending upon the antibody used, the antigen density on the tumor, and the rate of clearance of the antibody.

4.21 Vaccines

In certain preferred embodiments of the present invention, vaccines are provided. The vaccines will generally comprise one or more pharmaceutical compositions, such as those discussed above, in combination with an immunostimulant. An immunostimulant may be any substance that enhances or potentiates an immune response (antibody and/or cell-mediated) to an exogenous antigen. Examples of immunostimulants include adjuvants, biodegradable microspheres (e.g., polylactic galactide) and liposomes (into which the compound is incorporated; see e.g., Fullerton, U.S. Pat. No. 4,235,877). Vaccine preparation is generally described in, for example, M. F. Powell and M. J. Newman, eds., "Vaccine Design (the subunit and adjuvant approach)," Plenum Press (NY, 1995). Pharmaceutical compositions and vaccines within the scope of the present invention may also contain other compounds, which may be biologically active or inactive. For example, one or more immunogenic portions of other tumor antigens may be present, either incorporated into a fusion polypeptide or as a separate compound, within the composition or vaccine.

Illustrative vaccines may contain DNA encoding one or more of the polypeptides as described above, such that the polypeptide is generated in situ. As noted above, the DNA may be present within any of a variety of delivery systems known to those of ordinary skill in the art, including nucleic acid expression systems, bacteria and viral expression systems. Numerous gene delivery techniques are well known in the art, such as those described by Rolland, *Crit. Rev. Therap. Drug Carrier Systems* 15:143-198, 1998, and references cited therein. Appropriate nucleic acid expression systems contain the necessary DNA sequences for expression in the patient (such as a suitable promoter and terminating signal). Bacterial delivery systems involve the administration of a bacterium (such as Bacillus-Calmette-Guerin) that expresses an immunogenic portion of the polypeptide on its cell surface or secretes such an epitope. In a preferred embodiment, the DNA may be introduced using a viral expression system (e.g., vaccinia or other pox virus, retrovirus, or adenovirus), which may involve the use of a non-pathogenic (defective), replication competent virus. Suitable systems are disclosed, for example, in Fisher-Hoch et al., *Proc. Natl. Acad. Sci. USA* 86:317-321, 1989; Flexner et al., *Ann. N.Y. Acad. Sci.* 569:86-103, 1989; Flexner et al., *Vaccine* 8:17-21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616-627, 1988; Rosenfeld et al., *Science* 252:431-434, 1991; Kolls et al., *Proc. Natl. Acad. Sci. USA* 91:215-219, 1994; Kass-Eisler et al., *Proc. Natl. Acad. Sci. USA* 90:11498-11502, 1993; Guzman et al., *Circulation* 88:2838-2848, 1993; and Guzman et al., *Cir. Res.* 73:1202-1207, 1993. Techniques for incorporating DNA into such expression systems are well known to those of ordinary skill in the art. The DNA may also be "naked," as described, for example, in Ulmer et al., *Science* 259:1745-1749, 1993 and reviewed by Cohen, *Science* 259:1691-1692, 1993. The uptake of naked DNA may be increased by coating the DNA onto biodegradable beads, which are efficiently transported into the cells. It will be apparent that a vaccine may comprise both a polynucleotide and a polypeptide component. Such vaccines may provide for an enhanced immune response.

It will be apparent that a vaccine may contain pharmaceutically acceptable salts of the polynucleotides and polypeptides provided herein. Such salts may be prepared from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts).

While any suitable carrier known to those of ordinary skill in the art may be employed in the vaccine compositions of this invention, the type of carrier will vary depending on the mode of administration. Compositions of the present invention may be formulated for any appropriate manner of administration, including for example, topical, oral, nasal, intravenous, intracranial, intraperitoneal, subcutaneous or intramuscular administration. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactate polyglycolate) may also be employed as carriers for the pharmaceutical compositions of this invention. Suitable biodegradable microspheres are disclosed, for example, in U.S. Pat. Nos. 4,897,268; 5,075,109; 5,928,647; 5,811,128; 5,820,883; 5,853,763; 5,814,344 and 5,942,252. One may also employ a carrier comprising the particulate-protein complexes described in U.S. Pat. No. 5,928,647, which are capable of inducing a class I-restricted cytotoxic T lymphocyte responses in a host.

Such compositions may also comprise buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate. Compounds may also be encapsulated within liposomes using well known technology.

Any of a variety of immunostimulants may be employed in the vaccines of this invention. For example, an adjuvant may be included. Most adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Suitable adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars;

cationically or anionically derivatized polysaccharides; polyphosphazenes; biodegradable microspheres; monophosphoryl lipid A and quil A. Cytokines, such as GM-CSF or interleukin-2, -7, or -12, may also be used as adjuvants.

Within the vaccines provided herein, the adjuvant composition is preferably designed to induce an immune response predominantly of the Th1 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffman, *Ann. Rev. Immunol.* 7:145-173, 1989.

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Corixa Corporation (Seattle, Wash.; see U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., *Science* 273:352, 1996. Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other preferred formulations comprise an oil-in-water emulsion and tocopherol. A particularly potent adjuvant formulation involving QS21, 3D-MPL and tocopherol in an oil-in-water emulsion is described in WO 95/17210.

Other preferred adjuvants include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720, the disclosures of which are incorporated herein by reference in their entireties.

Any vaccine provided herein may be prepared using well known methods that result in a combination of antigen, immune response enhancer and a suitable carrier or excipient. The compositions described herein may be administered as part of a sustained release formulation (i.e., a formulation such as a capsule, sponge or gel (composed of polysaccharides, for example) that effects a slow release of compound following administration). Such formulations may generally be prepared using well known technology (see, e.g., Coombes et al., *Vaccine* 14:1429-1438, 1996) and administered by, for example, oral, rectal or subcutaneous implantation, or by implantation at the desired target site. Sustained-release formulations may contain a polypeptide, polynucleotide or antibody dispersed in a carrier matrix and/or contained within a reservoir surrounded by a rate controlling membrane.

Carriers for use within such formulations are biocompatible, and may also be biodegradable; preferably the formulation provides a relatively constant level of active component release. Such carriers include microparticles of poly(lactide-co-glycolide), polyacrylate, latex, starch, cellulose, dextran and the like. Other delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

Any of a variety of delivery vehicles may be employed within pharmaceutical compositions and vaccines to facilitate production of an antigen-specific immune response that targets tumor cells. Delivery vehicles include antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, *Nature* 392:245-251, 1998) and have been shown to be effective as a physiological adjuvant for eliciting prophylactic or therapeutic antitumor immunity (see Timmerman and Levy, *Ann. Rev. Med.* 50:507-529, 1999). In general, dendritic cells may be identified based on their typical shape (stellate in situ, with marked cytoplasmic processes (dendrites) visible in vitro), their ability to take up, process and present antigens with high efficiency and their ability to activate naïve T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., *Nature Med.* 4:594-600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for L antigen uptake and processing, which correlates with the high expression of Fcγ receptor and mannose receptor. The mature phenotype is typically characterized by a lower expression of these markers, but a high expression of cell surface molecules responsible for T cell activation such as class I and class II SMC, adhesion molecules (e.g., CD54 and CD11) and costimulatory molecules (e.g., CD40, CD80, CD86 and 4-1BB).

APCs may generally be transfected with a polynucleotide encoding a hematological malignancy-related tumor protein (or portion or other variant thereof) such that the hematological malignancy-related tumor polypeptide, or an immunogenic portion thereof, is expressed on the cell surface. Such transfection may take place ex vivo, and a composition or vaccine comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., *Immunology and cell Biology* 75:456-460, 1997. Antigen loading of dendritic cells may be achieved by incubating dendritic cells or progenitor cells with the hematological malignancy-related tumor polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g. a carrier molecule). Alternatively, a dendritic cell may be pulsed with a non-conjugated immunological partner, separately or in the presence of the polypeptide.

Vaccines and pharmaceutical compositions may be presented in unit-dose or multi-dose containers, such as sealed ampoules or vials. Such containers are preferably hermetically sealed to preserve sterility of the formulation until use. In general, formulations may be stored as suspensions, solutions or emulsions in oily or aqueous vehicles. Alternatively, a vaccine or pharmaceutical composition may be stored in a freeze-dried condition requiring only the addition of a sterile liquid carrier immediately prior to use.

4.22 Cancer Therapy

In further aspects of the present invention, the compositions described herein may be used for immunotherapy of cancer, such as hematological malignancy. Within such methods, pharmaceutical compositions and vaccines are typically administered to a patient. As used herein, a "patient" refers to any warm-blooded animal, preferably a human. A patient may or may not be afflicted with cancer. Accordingly, the above pharmaceutical compositions and vaccines may be used to prevent the development of a cancer or to treat a patient afflicted with a cancer. A cancer may be diagnosed using criteria generally accepted in the art, including the presence of a malignant tumor. Pharmaceutical compositions and vaccines may be administered either prior to or following surgical removal of primary tumors and/or treatment such as administration of radiotherapy or conventional chemotherapeutic drugs. Administration may be by any suitable method, including administration by intravenous, intraperitoneal, intramuscular, subcutaneous, intranasal, intradermal, anal, vaginal, topical and oral routes.

Within certain embodiments, immunotherapy may be active immunotherapy, in which treatment relies on the in vivo stimulation of the endogenous host immune system to react against tumors with the administration of immune response-modifying agents (such as polypeptides and polynucleotides as provided herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as $CD8^+$ cytotoxic T lymphocytes and $CD4^+$ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage, monocyte, fibroblast and/or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

Routes and frequency of administration of the therapeutic compositions described herein, as well as dosage, will vary from individual to individual, and may be readily established using standard techniques. In general, the pharmaceutical compositions and vaccines may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10-50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 25 µg to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g. more frequent remissions, complete or partial, or longer disease-free survival) in treated patients as compared to non-treated patients. Increases in preexisting immune responses to a hematological malignancy-related tumor protein generally correlate with an improved clinical outcome. Such immune responses may generally be evaluated using standard proliferation, cytotoxicity or cytokine assays, which may be performed using samples obtained from a patient before and after treatment.

4.23 Cancer Detection and Diagnosis

In general, a cancer may be detected in a patient based on the presence of one or more hematological malignancy-related tumor proteins and/or polynucleotides encoding such proteins in a biological sample (for example, blood, sera, sputum urine and/or tumor biopsies) obtained from the patient. In other words, such proteins may be used as markers to indicate the presence or absence of a cancer such as hematological malignancy. In addition, such proteins may be useful for the detection of other cancers. The binding agents provided herein generally permit detection of the level of antigen that binds to the agent in the biological sample. Polynucleotide primers and probes may be used to detect the level of mRNA encoding a tumor protein, which is also indicative of the presence or absence of a cancer. In general, a hematological malignancy-related tumor sequence should be present at a level that is at least three fold higher in tumor tissue than in normal tissue There are a variety of assay formats known to those of ordinary skill in the art for using a binding agent to detect polypeptide markers in a sample. See, e.g. Harlow and Lane, *Antibodies: A Laboratory Manual*, Cold Spring Harbor Laboratory, 1988. In general, the presence or absence of a cancer in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length hematological malignancy-related tumor proteins and portions thereof to which the binding agent binds, as described above.

The solid support may be any material known to those of ordinary skill in the art to which the tumor protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 µg, and preferably about 100 ng to about 1 µg, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12-A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with hematological malignancy. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a cancer, such as hematological malignancy, the signal detected from the reporter group that remains bound to the solid support is generally compared to a signal that corresponds to a predetermined cut-off value. In one preferred embodiment, the cut-off value for the detection of a cancer is the average mean signal obtained when the immobilized antibody is incubated with samples from patients without the cancer. In general, a sample generating a signal that is three standard deviations above the predetermined cut-off value is considered positive for the cancer. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, p. 106-7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a cancer.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a cancer. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 µg, and more preferably from about 50 ng to about 500 ng. Such tests can typically be performed with a very small amount of biological sample.

Of course, numerous other assay protocols exist that are suitable for use with the tumor proteins or binding agents of the present invention. The above descriptions are intended to be exemplary only. For example, it will be apparent to those of ordinary skill in the art that the above protocols may be readily modified to use hematological malignancy-related tumor polypeptides to detect antibodies that bind to such polypeptides in a biological sample. The detection of such hematological malignancy-related tumor protein specific antibodies may correlate with the presence of a cancer.

A cancer may also, or alternatively, be detected based on the presence of T cells that specifically react with a hematological malignancy-related tumor protein in a biological sample. Within certain methods, a biological sample comprising $CD4^+$ and/or $CD8^+$ T cells isolated from a patient is incubated with a hematological malignancy-related tumor polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2-9 days (typically 4 days) at 37° C. with polypeptide (e.g., 5-25 µg/ml). It may be desirable to incubate another aliquot of a T cell sample in the absence of hematological malignancy-related tumor polypeptide to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of a cancer in the patient.

As noted above, a cancer may also, or alternatively, be detected based on the level of mRNA encoding a hematological malignancy-related tumor protein in a biological sample. For example, at least two oligonucleotide primers may be employed in a polymerase chain reaction (PCR) based assay to amplify a portion of a hematological malignancy-related tumor cDNA derived from a biological sample, wherein at least one of the oligonucleotide primers is specific for (i.e., hybridizes to) a polynucleotide encoding the hematological malignancy-related tumor protein. The amplified cDNA is then separated and detected using techniques well known in the art, such as gel electrophoresis. Similarly, oligonucleotide probes that specifically hybridize to a polynucleotide encoding a hematological malignancy-related tumor protein may be used in a hybridization assay to detect the presence of polynucleotide encoding the tumor protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a hematological malignancy-related tumor protein that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10-40 nucleotides in length. In a preferred embodiment, the oligonucleotide primers comprise at least 10 contiguous nucleotides, more preferably at least 15 contiguous nucleotides, of a DNA molecule having a sequence disclosed in this application. Techniques for both PCR based assays and hybridization assays are well known in the art (see, for example, Mullis et al., *Cold Spring Harbor Symp. Quant. Biol.*, 51:263, 1987; Erlich ed., *PCR Technology*, Stockton Press, NY, 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a cancer. The amplification reaction may be performed on several dilutions of cDNA spanning two orders of magnitude. A two-fold or greater increase in expression in several dilutions of the test patient sample as compared to the same dilutions of the non-cancerous sample is typically considered positive.

In another embodiment, the compositions described herein may be used as markers for the progression of cancer. In this embodiment, assays as described above for the diagnosis of a cancer may be performed over time, and the change in the level of reactive polypeptide(s) or polynucleotide(s) evaluated. For example, the assays may be performed every 24-72 hours for a period of 6 months to 1 year, and thereafter performed as needed. In general, a cancer is progressing in those patients in whom the level of polypeptide or polynucleotide detected increases over time. In contrast, the cancer is not progressing when the level of reactive polypeptide or polynucleotide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple hematological malignancy-related tumor protein markers may be assayed within a given sample. It will be apparent that binding agents specific for different proteins provided herein may be combined within a single assay. Further, multiple primers or probes may be used concurrently. The selection of tumor protein markers may be based on routine experiments to determine combinations that results in optimal sensitivity. In addition, or alternatively, assays for tumor proteins provided herein may be combined with assays for other known tumor antigens.

4.24 Preparation of DNA Sequences

Certain nucleic acid sequences of cDNA molecules encoding portions of hematological malignancy-related antigens were isolated by PCR™-based subtraction. This technique serves to normalize differentially expressed cDNAs, facilitating the recovery of rare transcripts, and also has the advantage of permitting enrichment of cDNAs with small amounts of polyA RNA material and without multiple rounds of hybridization. To obtain antigens overexpressed in non-Hodgkin's lymphomas, two subtractions were performed with a tester library prepared from a pool of three T cell non-Hodgkin's lymphoma mRNAs. The two libraries were independently subtracted with different pools of driver cDNAs. Driver #1 contained cDNA prepared from specific normal tissues (lymph node, bone marrow, T cells, heart and brain), and this subtraction generated the library TCS-D1 (T cell non-Hodgkin's lymphoma subtracted library with driver #1). Driver #2 contained non-specific normal tissues (colon, large intestine, lung, pancreas, spinal cord, skeletal muscle, liver, kidney, skin and brain), and this subtraction generated the library TCS-D2 (T cell non-Hodgkin's lymphoma subtraction library with driver #2). Two other subtractions were performed with a tester library prepared from a pool of three B cell non-Hodgkin's lymphoma mRNAs. The two libraries were independently subtracted with different pools of driver cDNAs. Driver #1 contained cDNA prepared from specific normal tissues (lymph node, bone marrow, B cells, heart and brain), and this subtraction generated the library BCNHL/D1 (B cell non-Hodgkin's lymphoma subtracted library with driver #1). Driver #2 contained non-specific normal tissues (brain, lung, pancreas, spinal cord, skeletal muscle, colon, spleen, large intestine and PBMC), and this subtraction generated the library BCNHL/D2 (B cell non-Hodgkin's lymphoma subtraction library with driver #2). PCR™-amplified pools were generated from the subtracted libraries and clones were sequenced. Hematological malignancy-related antigen sequences may be further characterized using any of a variety of well known techniques. For example, PCR™ amplified clones may be arrayed onto glass slides for microarray analysis. To determine tissue distribution, the arrayed clones may be used as targets to be hybridized with different first strand cDNA probes, including lymphoma probes, leukemia probes and probes from different normal tissues. Leukemia and lymphoma probes may be generated from cryopreserved samples obtained at the time of diagnosis from NHL, Hodgkin's disease, AML, CML, CLL, ALL, MDS and myeloma patients with poor outcome (patients who failed to achieve complete remission following conventional chemotherapy or relapsed) or good outcome (patients who achieved long term remission). To analyze gene expression during hematopoetic differentiation, probes may be generated from >95% pure fractions of CD34+, CD2+, CD14+, CD15+ and CD19+ cells derived from healthy individuals.

Polynucleotide variants may generally be prepared by any method known in the art, including chemical synthesis by, for example, solid phase phosphoramidite chemical synthesis. Modifications in a polynucleotide sequence may also be introduced using standard mutagenesis techniques, such as oligonucleotide-directed site-specific mutagenesis (see Adelman et al., *DNA* 2:183, 1983). Alternatively, RNA molecules may be generated by in vitro or in vivo transcription of DNA sequences, provided that the DNA is incorporated into a vector with a suitable RNA polymerase promoter (such as T7 or SP6). Certain portions may be used to prepare an encoded polypeptide, as described herein. In addition, or alternatively, a portion may be administered to a patient such that the encoded polypeptide is generated in vivo (e.g., by transfecting antigen-presenting cells, such as dendritic cells, with a cDNA construct encoding a hematological malignancy-related antigen, and administering the transfected cells to the patient).

A portion of a sequence complementary to a coding sequence (i.e., an antisense polynucleotide) may also be used as a probe or to modulate hematological malignancy-related antigen expression. cDNA constructs that can be transcribed into antisense RNA may also be introduced into cells or tissues to facilitate the production of antisense RNA. An antisense polynucleotide may be used, as described herein, to inhibit expression of a hematological malignancy-related antigen. Antisense technology can be used to control gene expression through triple-helix formation, which compromises the ability of the double helix to open sufficiently for the binding of polymerases, transcription factors or regulatory molecules (see Gee et al., In Huber and Carr, *Molecular and Immunologic Approaches*, Futura Publishing Co. (Mt. Kisco, N.Y.; 1994)). Alternatively, an antisense molecule may be designed to hybridize with a control region of a gene (e.g., promoter, enhancer or transcription initiation site), and block transcription of the gene; or to block translation by inhibiting binding of a transcript to ribosomes.

A portion of a coding sequence or of a complementary sequence may also be designed as a probe or primer to detect gene expression. Probes may be labeled with a variety of reporter groups, such as radionuclides and enzymes, and are preferably at least 10 nucleotides in length, more preferably at least 20 nucleotides in length and still more preferably at least 30 nucleotides in length. Primers, as noted above, are preferably 22-30 nucleotides in length.

Any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-methyl-, thio- and other modified forms of adenine, cytidine, guanine, thymine and uridine.

Hematological malignancy-related antigen polynucleotides may be joined to a variety of other nucleotide sequences using established recombinant DNA techniques. For example, a polynucleotide may be cloned into any of a variety of cloning vectors, including plasmids, phagemids, lambda phage derivatives and cosmids. Vectors of particular interest include expression vectors, replication vectors, probe generation vectors and sequencing vectors. In general, a vector will contain an origin of replication functional in at least one organism, convenient restriction endonuclease sites and one or more selectable markers. Other elements will depend upon the desired use, and will be apparent to those of ordinary skill in the art.

Within certain embodiments, polynucleotides may be formulated so as to permit entry into a cell of a mammal, and expression therein. Such formulations are particularly useful for therapeutic purposes, as described below. Those of ordinary skill in the art will appreciate that there are many ways to achieve expression of a polynucleotide in a target cell, and any suitable method may be employed. For example, a polynucleotide may be incorporated into a viral vector such as, but not limited to, adenovirus, adeno-associated virus, retrovirus, or vaccinia or other pox virus (e.g., avian pox virus). Techniques for incorporating DNA into such vectors are well known to those of ordinary skill in the art. A retroviral vector may additionally transfer or incorporate a gene for a selectable marker (to aid in the identification or selection of transduced cells) and/or a targeting moiety, such as a gene that encodes a ligand for a receptor on a specific target cell, to render the vector target specific. Targeting may also be accomplished using an antibody, by methods known to those of ordinary skill in the art.

Other formulations for therapeutic purposes include colloidal dispersion systems, such as macromolecule complexes, nanocapsules, microspheres, beads, and lipid-based systems including oil-in-water emulsions, micelles, mixed micelles, and liposomes. A preferred colloidal system for use as a delivery vehicle in vitro and in vivo is a liposome (i.e., an artificial membrane vesicle). The preparation and use of such systems is well known in the art.

4.25 Therapeutic Methods

In further aspects of the present invention, the compositions described herein may be used for immunotherapy of hematological malignancies including adult and pediatric AML, CML, ALL, CLL, myelodysplastic syndromes (MDS), myeloproliferative syndromes (MPS), secondary leukemia, multiple myeloma, Hodgkin's lymphoma and Non-Hodgkin's lymphomas. In addition, compositions described herein may be used for therapy of diseases associated with an autoimmune response against hematopoetic precursor cells, such as severe aplastic anemia.

Immunotherapy may be performed using any of a variety of techniques, in which compounds or cells provided herein function to remove hematological malignancy-related antigen-expressing cells from a patient. Such removal may take place as a result of enhancing or inducing an immune response in a patient specific for hematological malignancy-related antigen or a cell expressing hematological malignancy-related antigen. Alternatively, hematological malignancy-related antigen-expressing cells may be removed ex vivo (e.g., by treatment of autologous bone marrow, peripheral blood or a fraction of bone marrow or peripheral blood). Fractions of bone marrow or peripheral blood may be obtained using any standard technique in the art.

Within such methods, pharmaceutical compositions and vaccines are typically administered to a patient. As used herein, a "patient" refers to any warm-blooded animal, preferably a human. A patient may or may not be afflicted with a hematological malignancy. Accordingly, the above pharmaceutical compositions and vaccines may be used to prevent the development of a malignancy or to treat a patient afflicted with a malignancy. A hematological malignancy may be diagnosed using criteria generally accepted in the art. Pharmaceutical compositions and vaccines may be administered either prior to or following surgical removal of primary tumors and/or treatment such as administration of radiotherapy or conventional chemotherapeutic drugs, or bone marrow transplantation (autologous, allogeneic or syngeneic).

Within certain embodiments, immunotherapy may be active immunotherapy, in which treatment relies on the in vivo stimulation of the endogenous host immune system to react against tumors with the administration of immune response-modifying agents (such as polypeptides and polynucleotides as provided herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as $CD8^+$ cytotoxic T lymphocytes and $CD4^+$ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

The compositions provided herein may be used alone or in combination with conventional therapeutic regimens such as surgery, irradiation, chemotherapy and/or bone marrow transplantation (autologous, syngeneic, allogeneic or unrelated). As discussed in greater detail below, binding agents and T cells as provided herein may be used for purging of autologous stem cells. Such purging may be beneficial prior to, for example, bone marrow transplantation or transfusion of blood or components thereof. Binding agents, T cells, antigen presenting cells (APC) and compositions provided herein may further be used for expanding and stimulating (or priming) autologous, allogeneic, syngeneic or unrelated hematological malignancy-related antigen-specific T-cells in vitro and/or in vivo. Such hematological malignancy-related antigen-specific T cells may be used, for example, within donor lymphocyte infusions.

Routes and frequency of administration of the therapeutic compositions described herein, as well as dosage, will vary from individual to individual, and may be readily established using standard techniques. In general, the pharmaceutical compositions and vaccines may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10-50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 100 µg to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a hematological malignancy-related antigen generally correlate with an improved clinical outcome. Such immune responses may generally be evaluated using standard proliferation, cytotoxicity or cytokine assays, which may be performed using samples obtained from a patient before and after treatment.

Within further aspects, methods for inhibiting the development of a malignant disease associated with hematological malignancy-related antigen expression involve the administration of autologous T cells that have been activated in response to a hematological malignancy-related antigen polypeptide or hematological malignancy-related antigen-expressing APC, as described above. Such T cells may be $CD4^+$ and/or $CD8^+$, and may be proliferated as described above. The T cells may be administered to the individual in an amount effective to inhibit the development of a malignant disease. Typically, about $1 \times 10^9$ to $1 \times 10^{11}$ T cells/$M^2$ are administered intravenously, intracavitary or in the bed of a resected tumor. It will be evident to those skilled in the art that the number of cells and the frequency of administration will be dependent upon the response of the patient.

Within certain embodiments, T cells may be stimulated prior to an autologous bone marrow transplantation. Such stimulation may take place in vivo or in vitro. For in vitro stimulation, bone marrow and/or peripheral blood (or a fraction of bone marrow or peripheral blood) obtained from a patient may be contacted with a hematological malignancy-related antigen polypeptide, a polynucleotide encoding a hematological malignancy-related antigen polypeptide and/or an APC that expresses a hematological malignancy-related antigen polypeptide under conditions and for a time sufficient to permit the stimulation of T cells as described above. Bone marrow, peripheral blood stem cells and/or hematological malignancy-related antigen-specific T cells may then be administered to a patient using standard techniques.

Within related embodiments, T cells of a related or unrelated donor may be stimulated prior to a syngeneic or allogeneic (related or unrelated) bone marrow transplantation. Such stimulation may take place in vivo or in vitro. For in vitro stimulation, bone marrow and/or peripheral blood (or a fraction of bone marrow or peripheral blood) obtained from a related or unrelated donor may be contacted with a hematological malignancy-related antigen polypeptide, hematological malignancy-related antigen polynucleotide and/or APC that expresses a hematological malignancy-related antigen polypeptide under conditions and for a time sufficient to permit the stimulation of T cells as described above. Bone marrow, peripheral blood stem cells and/or hematological malignancy-related antigen-specific T cells may then be administered to a patient using standard techniques.

Within other embodiments, hematological malignancy-related antigen-specific T cells, antibodies or antigen-binding fragments thereof as described herein may be used to remove cells expressing hematological malignancy-related antigen from a biological sample, such as autologous bone marrow, peripheral blood or a fraction of bone marrow or peripheral blood (e.g., CD34$^+$ enriched peripheral blood (PB) prior to administration to a patient). Such methods may be performed by contacting the biological sample with such T cells, antibodies or antibody fragments under conditions and for a time sufficient to permit the reduction of hematological malignancy-related antigen expressing cells to less than 10%, preferably less than 5% and more preferably less than 1%, of the total number of myeloid or lymphatic cells in the bone marrow or peripheral blood. Such contact may be achieved, for example, using a column to which antibodies are attached using standard techniques. Antigen-expressing cells are retained on the column. The extent to which such cells have been removed may be readily determined by standard methods such as, for example, qualitative and quantitative PCR analysis, morphology, immunohistochemistry and FACS analysis. Bone marrow or PB (or a fraction thereof) may then be administered to a patient using standard techniques.

4.26 Diagnostic Methods

In general, a hematological malignancy may be detected in a patient based on the presence of hematological malignancy-related antigen and/or polynucleotide in a biological sample (such as blood, sera, urine and/or tumor biopsies) obtained from the patient. In other words, hematological malignancy-related antigens may be used as a marker to indicate the presence or absence of such a malignancy. The binding agents provided herein generally permit detection of the level of antigen that binds to the agent in the biological sample. Polynucleotide primers and probes may be used to detect the level of mRNA encoding hematological malignancy-related antigen, which is also indicative of the presence or absence of a hematological malignancy. In general, hematological malignancy-related antigen should be present at a level that is at least three fold higher in a sample obtained from a patient afflicted with a hematological malignancy than in the sample obtained from an individual not so afflicted.

There are a variety of assay formats known to those of ordinary skill in the art for using a binding agent to detect polypeptide markers in a sample. See, e.g., Harlow and Lane, *Antibodies: A Laboratory Manual*, Cold Spring Harbor Laboratory, 1988. In general, the presence or absence of a hematological malignancy in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length hematological malignancy-related antigens and portions thereof to which the binding agent binds, as described above.

The solid support may be any material known to those of ordinary skill in the art to which the hematological malignancy-related antigen polypeptide may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 µg, and preferably about 100 ng to about 1 µg, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12-A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with a hematological malignancy. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a hematological malignancy, the signal detected from the reporter group that remains bound to the solid support is generally compared to a signal that corresponds to a predetermined cut-off value. In one preferred embodiment, the cut-off value for the detection of a hematological malignancy is the average mean signal obtained when the immobilized antibody is incubated with samples from patients without the malignancy. In general, a sample generating a signal that is three standard deviations above the predetermined cut-off value is considered positive for the malignancy. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, p. 106-7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a malignancy.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a hematological malignancy. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 µg, and more preferably from about 50 ng to about 500 ng. Such tests can typically be performed with a very small amount of biological sample.

Of course, numerous other assay protocols exist that are suitable for use with the hematological malignancy-related antigen sequences or binding agents of the present invention. The above descriptions are intended to be exemplary only. For example, it will be apparent to those of ordinary skill in the art that the above protocols may be readily modified to use hematological malignancy-related antigen polypeptides to detect antibodies that bind to such polypeptides in a biological sample. The detection of hematological malignancy-related antigen-specific antibodies may correlate with the presence of a hematological.

A malignancy may also, or alternatively, be detected based on the presence of T cells that specifically react with hematological malignancy-related antigen in a biological sample. Within certain methods, a biological sample comprising CD4+ and/or CD8+ T cells isolated from a patient is incubated with a hematological malignancy-related antigen polypeptide, a polynucleotide encoding such a polypeptide and/or an APC that expresses such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2-9 days (typically 4 days) at 37° C. with Mtb-81 or Mtb-67.2 polypeptide (e.g., 5-25 µg/ml). It may be desirable to incubate another aliquot of a T cell sample in the absence of hematological malignancy-related antigen polypeptide to serve as a control. For CD4+ T cells, activation is preferably detected by evaluating proliferation of the T cells. For CD8+ T cells, activation is preferably detected by evaluating cytolytic activity. A level of proliferation that is at least two fold greater and/or a level of cytolytic activity that is at least 20% greater than in disease-free patients indicates the presence of a hematological malignancy in the patient.

As noted above, a hematological malignancy may also, or alternatively, be detected based on the level of mRNA encoding hematological malignancy-related antigen in a biological sample. For example, at least two oligonucleotide primers may be employed in a polymerase chain reaction (PCR) based assay to amplify a portion of hematological malignancy-related antigen cDNA derived from a biological sample, wherein at least one of the oligonucleotide primers is specific for (i.e., hybridizes to) a polynucleotide encoding the hematological malignancy-related antigen protein. The amplified cDNA is then separated and detected using techniques well known in the art, such as gel electrophoresis. Similarly, oligonucleotide probes that specifically hybridize to a polynucleotide encoding hematological malignancy-related antigen may be used in a hybridization assay to detect the presence of polynucleotide encoding hematological malignancy-related antigen in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding hematological malignancy-related antigen that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10-40 nucleotides in length. Techniques for both PCR based assays and hybridization assays are well known in the art (see, for example, Mullis et al., *Cold Spring Harbor Symp. Quant. Biol.*, 51:263, 1987; Erlich ed., PCR Technology, Stockton Press, NY, 1989).

One preferred assay employs RT-PCR, in which PCR is applied in conjunction with reverse transcription. Typically, RNA is extracted from a biological sample such as a biopsy tissue and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a hematological malignancy. The amplification reaction may be performed on several dilutions of cDNA spanning two orders of magnitude. A two-fold or greater increase in expression in several dilutions of the test patient sample as compared to the same dilutions of the sample from a normal individual is typically considered positive.

In preferred embodiments, such assays may be performed using samples enriched for cells expressing the hematological malignancy-related antigen(s) of interest. Such enrichment may be achieved, for example, using a binding agent as provided herein to remove the cells from the remainder of the biological sample. The removed cells may then be assayed as described above for biological samples.

In further embodiments, hematological malignancy-related antigens may be used as markers for monitoring disease progression or the response to therapy of a hematological malignancy. In this embodiment, assays as described above for the diagnosis of a hematological malignancy may be performed over time, and the change in the level of reactive polypeptide(s) evaluated. For example, the assays may be performed every 24-72 hours for a period of 6 months to 1 year, and thereafter performed as needed. In general, a malignancy is progressing in those patients in whom the level of polypeptide detected by the binding agent increases over time. In contrast, the malignancy is not progressing when the level of reactive polypeptide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple markers may be assayed within a given sample. It will be apparent that binding agents specific for different proteins provided herein may be combined within a single assay. Further, multiple primers or probes may be used concurrently. The selection of markers may be based on routine experiments to determine combinations that results in optimal sensitivity.

Further diagnostic applications include the detection of extramedullary disease (e.g., cerebral infiltration of blasts in leukemias). Within such methods, a binding agent may be coupled to a tracer substance, and the diagnosis is performed in vivo using well known techniques. Coupled binding agent may be administered as described above, and extramedullary disease may be detected based on assaying the presence of tracer substance. Alternatively, a tracer substance may be associated with a T cell specific for hematological malignancy-related antigen, permitting detection of extramedullary disease based on assays to detect the location of the tracer substance.

4.27 Exemplary Definitions

In accordance with the present invention, nucleic acid sequences include, but are not limited to, DNAs (including and not limited to genomic or extragenomic DNAs), genes, peptide nucleic acids (PNAs) RNAs (including, but not limited to, rRNAs, mRNAs and tRNAs), nucleosides, and suitable nucleic acid segments either obtained from native sources, chemically synthesized, modified, or otherwise prepared in whole or in part by the hand of man.

Unless defined otherwise, all technical and scientific terms used herein have the same meaning as commonly understood by one of ordinary skill in the art to which this invention belongs. Although any methods and compositions similar or equivalent to those described herein can be used in the practice or testing of the present invention, the preferred methods and compositions are described herein. For purposes of the present invention, the following terms are defined below:

A, an: In accordance with long standing patent law convention, the words "a" and "an" when used in this application, including the claims, denotes "one or more".

Expression: The combination of intracellular processes, including transcription and translation undergone by a polynucleotide such as a structural gene to synthesize the encoded peptide or polypeptide.

Promoter: a term used to generally describe the region or regions of a nucleic acid sequence that regulates transcription.

Regulatory Element: a term used to generally describe the region or regions of a nucleic acid sequence that regulates transcription.

Structural gene: A gene or sequence region that is expressed to produce an encoded peptide or polypeptide.

Transformation: A process of introducing an exogenous polynucleotide sequence (e.g., a vector, a recombinant DNA or RNA molecule) into a host cell or protoplast in which that exogenous nucleic acid segment is incorporated into at least a first chromosome or is capable of autonomous replication within the transformed host cell. Transfection, electroporation, and naked nucleic acid uptake all represent examples of techniques used to transform a host cell with one or more polynucleotides.

Transformed cell: A host cell whose nucleic acid complement has been altered by the introduction of one or more exogenous polynucleotides into that cell.

Transgenic cell: Any cell derived or regenerated from a transformed cell or derived from a transgenic cell, or from the progeny or offspring of any generation of such a transformed host cell.

Transgenic animal: An animal or a progeny or an offspring of any generation thereof that is derived from a transformed animal cell, wherein the animal's DNA contains an introduced exogenous nucleic acid molecule not originally present in a native, wild type, non-transgenic animal of the same species. The terms "transgenic animal" and "transformed animal" have sometimes been used in the art as synonymous terms to define an animal, the genetic contents of which has been modified to contain one or more exogenous nucleic acid segments.

Vector: A nucleic acid molecule, typically comprised of DNA, capable of replication in a host cell and/or to which another nucleic acid segment can be operatively linked so as to bring about replication of the attached segment. A plasmid, cosmid, or a virus is an exemplary vector.

The terms "substantially corresponds to", "substantially homologous", or "substantial identity" as used herein denotes a characteristic of a nucleic acid or an amino acid sequence, wherein a selected nucleic acid or amino acid sequence has at least about 70 or about 75 percent sequence identity as compared to a selected reference nucleic acid or amino acid sequence. More typically, the selected sequence and the reference sequence will have at least about 76, 77, 78, 79, 80, 81, 82, 83, 84 or even 85 percent sequence identity, and more preferably at least about 86, 87, 88, 89, 90, 91, 92, 93, 94, or 95 percent sequence identity. More preferably still, highly homologous sequences often share greater than at least about 96, 97, 98, or 99 percent sequence identity between the selected sequence and the reference sequence to which it was compared. The percentage of sequence identity may be calculated over the entire length of the sequences to be compared, or may be calculated by excluding small deletions or additions which total less than about 25 percent or so of the chosen reference sequence. The reference sequence may be a subset of a larger sequence, such as a portion of a gene or flanking sequence, or a repetitive portion of a chromosome. However, in the case of sequence homology of two or more polynucleotide sequences, the reference sequence will typically comprise at least about 18-25 nucleotides, more typically at least about 26 to 35 nucleotides, and even more typically at least about 40, 50, 60, 70, 80, 90, or even 100 or so nucleotides. Desirably, which highly homologous fragments are desired, the extent of percent identity between the two sequences will be at least about 80%, preferably at least about 85%, and more preferably about 90% or 95% or higher, as readily determined by one or more of the sequence comparison algorithms well-known to those of skill in the art, such as e.g., the FASTA program analysis described by Pearson and Lipman (1988).

The term "naturally occurring" as used herein as applied to an object refers to the fact that an object can be found in nature. For example, a polypeptide or polynucleotide sequence that is present in an organism (including viruses) that can be isolated from a source in nature and which has not been intentionally modified by the hand of man in a laboratory is naturally-occurring. As used herein, laboratory strains of rodents that may have been selectively bred according to classical genetics are considered naturally occurring animals.

As used herein, a "heterologous" is defined in relation to a predetermined referenced gene sequence. For example, with respect to a structural gene sequence, a heterologous promoter is defined as a promoter which does not naturally occur adjacent to the referenced structural gene, but which is positioned by laboratory manipulation. Likewise, a heterologous gene or nucleic acid segment is defined as a gene or segment that does not naturally occur adjacent to the referenced promoter and/or enhancer elements.

"Transcriptional regulatory element" refers to a polynucleotide sequence that activates transcription alone or in combination with one or more other nucleic acid sequences. A transcriptional regulatory element can, for example, comprise one or more promoters, one or more response elements, one or more negative regulatory elements, and/or one or more enhancers.

As used herein, a "transcription factor recognition site" and a "transcription factor binding site" refer to a polynucleotide sequence(s) or sequence motif(s) which are identified as being sites for the sequence-specific interaction of one or more transcription factors, frequently taking the form of direct protein-DNA binding. Typically, transcription factor binding sites can be identified by DNA footprinting, gel mobility shift assays, and the like, and/or can be predicted on the basis of known consensus sequence motifs, or by other methods known to those of skill in the art.

As used herein, the term "operably linked" refers to a linkage of two or more polynucleotides or two or more nucleic acid sequences in a functional relationship. A nucleic acid is "operably linked" when it is placed into a functional relationship with another nucleic acid sequence. For instance, a promoter or enhancer is operably linked to a coding sequence if it affects the transcription of the coding sequence. Operably linked means that the DNA sequences being linked are typically contiguous and, where necessary to join two protein coding regions, contiguous and in reading frame. However, since enhancers generally function when separated from the promoter by several kilobases and intronic sequences may be of variable lengths, some polynucleotide elements may be operably linked but not contiguous.

"Transcriptional unit" refers to a polynucleotide sequence that comprises at least a first structural gene operably linked to at least a first cis-acting promoter sequence and optionally linked operably to one or more other cis-acting nucleic acid sequences necessary for efficient transcription of the structural gene sequences, and at least a first distal regulatory element as may be required for the appropriate tissue-specific and developmental transcription of the structural gene sequence operably positioned under the control of the promoter and/or enhancer elements, as well as any additional cis sequences that are necessary for efficient transcription and translation (e.g., polyadenylation site(s), mRNA stability controlling sequence(s), etc.

As noted above, the present invention is generally directed to compositions and methods for using the compositions, for example in the therapy and diagnosis of cancer, such as hematological malignancy. Certain illustrative compositions described herein include hematological malignancy-related tumor polypeptides, polynucleotides encoding such polypeptides, binding agents such as antibodies, antigen presenting cells (APCs) and/or immune system cells (e.g., T cells). A "hematological malignancy-related tumor protein," as the term is used herein, refers generally to a protein that is expressed in hematological malignancy-related tumor cells at a level that is at least two fold, and preferably at least five fold, greater than the level of expression in a normal tissue, as determined using a representative assay provided herein. Certain hematological malignancy-related tumor proteins are tumor proteins that react detectably (within an immunoassay, such as an ELISA or Western blot) with antisera of a patient afflicted with hematological malignancy.

4.28 Biological Functional Equivalents

Modification and changes may be made in the structure of the polynucleotides and peptides of the present invention and still obtain a functional molecule that encodes a peptide with desirable characteristics, or still obtain a genetic construct with the desirable expression specificity and/or properties. As it is often desirable to introduce one or more mutations into a specific polynucleotide sequence, various means of introducing mutations into a polynucleotide or peptide sequence known to those of skill in the art may be employed for the preparation of heterologous sequences that may be introduced into the selected cell or animal species. In certain circumstances, the resulting encoded peptide sequence is altered by this mutation, or in other cases, the sequence of the peptide is unchanged by one or more mutations in the encoding polynucleotide. In other circumstances, one or more changes are introduced into the promoter and/or enhancer regions of the polynucleotide constructs to alter the activity, or specificity of the expression elements and thus alter the expression of the heterologous therapeutic nucleic acid segment operably positioned under the control of the elements.

When it is desirable to alter the amino acid sequence of one or more of the heterologous peptides encoded by the expression construct to create an equivalent, or even an improved, second-generation molecules, the amino acid changes may be achieved by changing one or more of the codons of the encoding DNA sequence, according to Table 1.

For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated by the inventors that various changes may be made in the peptide sequences of the disclosed compositions, or corresponding DNA sequences which encode said peptides without appreciable loss of their biological utility or activity.

TABLE 1

| Amino Acids | | | Codons |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

In making such changes, the hydropathic index of amino acids may be considered. The importance of the hydropathic amino acid index in conferring interactive biologic function on a protein is generally understood in the art (Kyte and Doolittle, 1982, incorporate herein by reference). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of their hydrophobicity and charge characteristics (Kyte and Doolittle, 1982), these are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those that are within ±1 are particularly preferred, and those within ±0.5 are even more particularly preferred. It is also understood in the art that the substitution of like amino acids can be made effectively on the basis of hydrophilicity. U.S. Pat. No. 4,554,101, incorporated herein by reference, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those that are within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions which take several of the foregoing characteristics into consideration are well known to those of skill in the art and include: arginine and lysine; glutamate and aspartate; serine and threonine; glutamine and asparagine; and valine, leucine and isoleucine.

5. EXAMPLES

The following examples are included to demonstrate preferred embodiments of the invention. However, those of skill in the art should, in light of the present disclosure, appreciate that many changes can be made in the specific embodiments which are disclosed and still obtain a like or similar result without departing from the spirit and scope of the invention described in the appended claims.

5.1 Example 1

Identification of Hematological Malignancy-Related Antigen Polynucleotides

This Example illustrates the identification of hematological malignancy-related antigen polynucleotides from non-Hodgkin's lymphomas.

Hematological malignancy-related antigen polynucleotides were isolated by PCR-based subtraction. PolyA mRNA was prepared from T cell non-Hodgkin's lymphomas, B cell non-Hodgkin's lymphomas and normal tissues. Six cDNA libraries were constructed, PCR-subtracted and analyzed. Two libraries were constructed using pools of three T cell non-Hodgkin's lymphoma mRNAs (referred to herein as TCS libraries). Two others were constructed using pools of three B cell non-Hodgkin's lymphoma mRNAs (referred to herein as BCNHL libraries). Two other libraries were constructed using a pool of 2 Hodgkin's lymphoma mRNAs (referred to herein as HLS libraries. cDNA synthesis, hybridization and PCR amplification were performed according to Clontech's user manual (PCR-Select cDNA Subtraction), with the following changes: 1) cDNA was restricted with a mixture of enzymes, including MscI, PvuII, StuI and DraI, instead of the single enzyme RsaI; and 2) the ratio of driver to tester cDNA was increased in the hybridization steps (to 76:1) to give a more stringent subtraction.

The two TCS libraries were independently subtracted with different pools of driver cDNAs. Driver #1 contained cDNA prepared from specific normal tissues (lymph node, bone marrow, T cells, heart and brain), and this subtraction generated the library TCS-D1 (T cell non-Hodgkin's lymphoma subtracted library with driver #1). Driver #2 contained non-specific normal tissues (colon, large intestine, lung, pancreas, spinal cord, skeletal muscle, liver, kidney, skin and brain), and this subtraction generated the library TCS-D2 (T cell non-Hodgkin's lymphoma subtraction library with driver #2).

Similarly, the two BCNHL libraries were independently subtracted with different pools of driver cDNAs. Driver #1 contained cDNA prepared from specific normal tissues (lymph node, bone marrow, B cells, heart and brain), and this subtraction generated the library BCNHL/D1 (B cell non-Hodgkin's lymphoma subtracted library with driver #1). Driver #2 contained non-specific normal tissues (brain, lung, pancreas, spinal cord, skeletal muscle, colon, spleen, large intestine and PBMC), and this subtraction generated the library BCNHL/D2 (B cell non-Hodgkin's lymphoma subtraction library with driver #2).

The two HLS libraries were independently subtracted with different pools of driver cDNAs. Driver #1 contained cDNA prepared from specific normal tissues (lymph node, bone marrow, B cells and lung) and this subtraction generated HLS-D1 (Hodgkin's lymphoma subtraction library with driver #1). Driver #2 contained non-specific normal tissues (colon, large intestine, lung, pancreas, spinal cord, skeletal muscle, liver, kidney, skin and brain) and this generated the library HLS-D2 (Hodgkin's lymphoma subtraction library with driver #2).

To analyze the efficiency of the subtraction, actin (a housekeeping gene) was PCR amplified from dilutions of subtracted as well as unsubtracted PCR samples. Furthermore, the complexity and redundancy of each library was characterized by sequencing 96 clones from each of the PCR subtraction libraries (TCS-D1, TCS-D2, BCNHL/D1, BCNHL/D2, HLS-D1 and HLS-D2). These analyses indicated that the libraries are enriched for genes overexpressed in leukemia tissues and specifically T cell and B cell non-Hodgkin's lymphoma and M. Hodgkin's lymphoma samples.

Following PCR amplification, the cDNAs were cloned into the pCR2.1-TOPO plasmid vector (Invitrogen).

Sequences obtained from these analyses were searched against known sequences in the publicly available databases using the BLAST 2.0 release. The default BLAST parameters used were as follows: GAP PARAMETERS: Open Gap=0, Extended Gap=0; OUTPUT PARAMETERS: Expect=10.0, Threshold=0, Number of Alignments=250; For BLASTN, the search parameters were as follows: Mismatch=−3, Reward=1, Word size=0. The alignments were presented pair-wise, with a window percent identity=22. All available protein and nucleotide databases were searched, including, PIR, SwissPROT, GenBank, Mouse EST, Human EST, Other EST, Human repeat and high throughput sequences, and published patents and patent application database.

From these, a number of unique sequences were identified that represented novel polynucleotide sequences that had not previously been described in the GenBank and other sequence databases. A number of other sequences were identified that appeared to contain significant homology with one or more sequences previously identified in the databases, although they were described only as genomic or cDNA clones, and had no known function. The remaining sequences corresponded to known genes. The clones obtained from this analysis are summarized in Tables 2-6 in co-pending application U.S. Ser. No. 09/796,692.

5.2 Example 2

Analysis of Subtracted cDNA Sequences by Microarray Analysis

Subtracted cDNA sequences were analyzed by microarray analysis to evaluate their expression in hematological malignancies and normal tissues. Using this approach, cDNA sequences were PCR amplified and their mRNA expression profiles in hematological malignancies and normal tissues are examined using cDNA microarray technology essentially as described (Shena et al., 1995).

In brief, the clones identified from the subtracted cDNA libraries analyses were immobilized and arrayed onto glass slides as multiple replicas on microarray slides and the slides were hybridized with two different sets of probes, with each location on the microarray slide corresponding to a unique cDNA clone (as many as 5500 clones can be arrayed on a single slide, or chip). Each chip is hybridized with a pair of cDNA probes that are fluorescence-labeled with Cy3 and Cy5, respectively. The set of probes derived from the hematological malignancies was labeled with cy3 while the other set of probes derived from a pool of normal tissues was labeled with cy5. Typically, 1 µg of polyA$^+$ RNA was used to generate each cDNA probe. After hybridization, the chips were scanned and the fluorescence intensity recorded for both Cy3 and Cy5 channels. The difference in intensities (i.e., cy3/cy5 ratios) following hybridization with both probe sets provided the information on the relative expression level of each cDNA sequences immobilized on the slide in tumor versus normal tissues. There are multiple built-in quality control steps. First, the probe quality is monitored using a panel of ubiquitously expressed genes. Secondly, the control plate also can include yeast DNA fragments of which complementary RNA may be spiked into the probe synthesis for measuring the quality of the probe and the sensitivity of the analysis. This methodology provides a sensitivity of 1 in 100,000 copies of mRNA, and the reproducibility of the technology may be ensured by including duplicated control cDNA elements at different locations.

Analysis of hematological malignancy subtracted clones by microarray analyses on a variety of microarray chips identified the sequences set forth in SEQ ID NO:1 through SEQ ID NO:668 of co-pending application U.S. Ser. No. 09/796,692 as being at least two-fold overexpressed in hematological malignancies versus normal tissues.

5.3 Example 3

Polynucleotide and Polypeptide Compositions: Brief Description of the cDNA Clones and Open Reading Frames Identified by Subtractive Hybridization and Microarray Analysis Table 7 in co-pending application U.S. Ser. No. 09/796,692 lists the sequences of the polynucleotides obtained during the analyses of the present invention. Shown are the 668 polynucleotide sequences, along with their clone name identifiers, as well as the serial number and filing date of the priority provisional patent application in which the clone was first identified.

Table 8 in co-pending application U.S. Ser. No. 09/796,692 identifies the putative open reading frames obtained from analyses of the cDNA sequences obtained in SEQ ID NO:1- SEQ ID NO:668 in the co-pending application. Shown are the sequence identifiers, the clone name and translation frame, and the start and stop nucleotides in the corresponding DNA sequence used to generate the polypeptide sequence of the open reading frame.

Table 9 in co-pending application U.S. Ser. No. 09/796,692 identifies an additional set of particular hematological malignancy-related cDNA sequences that were obtained using the subtractive library and microarray methods as described above. These sequences, designated SEQ ID NO:2533-SEQ ID NO:9597 in the co-pending application, are shown in the Table along with the original clone name, and the serial number and filing date of the priority provisional application in which the clone was first described.

5.4 Example 4

Additional Analysis of cDNA Clones and ORFs Identified by Subtractive Hybridization and Microarray Analysis This example describes microarray analysis of previously patent-filed leukemia tumor- and tissue-specific cDNAs (SEQ ID NOs: 1-9597). Since some of the sequences described in the example are full-length versions or fragments of the previously disclosed sequences, they have been provided with new SEQ ID NOs.

Microarray analysis identifies many potential genes that are overexpressed in specific tissues/tumors. However, these genes often represent known genes or genes that subsequently are found by RealTime PCR analysis to have a broader expression profile. This disclosure describes analyses which combine microarray analysis (CorixArray) and comparisons to public databases to identify and prioritize candidate sequences for RealTime analysis, thus allowing the identification of sequences with favorable expression profiles in a more efficient manner.

Clones were tested for overexpression in lymphoma tumor samples as compared to normal tissues using Corixa Leukemia/Lymphoma Chip#3 (LyC3). The analyzed clones were originally randomly picked from lymphoma PCR subtracted libraries: B-cell non-Hodgkin's lymphoma libraries (BC-NHL/D1 and BCNHL/D2; C1D000153); T-cell non-Hodgkin's lymphoma libraries (TCS-D1 and TCS-D2; CID000166); Hodgkin's lymphoma libraries (HLS-D1 and HLS-D2; CID000204 and CID000275) and a Clontech-generated T8 leukemia PCR subtracted library. A total of 5184 clones were arrayed: 2304 from BCNHL libraries, 288 from TCS libraries, 1344 from HLS libraries, and 960 from a Clontech-T8 library. In addition, a selection of 288 clones from the above libraries that had been identified from prior leukemia/lymphoma chips were re-analyzed on LyC3.

cDNA inserts for arraying were amplified by PCR using vector-specific primers. The arrays were probed with 43 probe pairs. Analysis was performed using CorixArray computational analysis. Analysis consisted of determining the ratio of the mean or median hybridization signal for a particular element (cDNA) using two sets of probes. The ratio is a reflection of the over- or under-expression of the element (cDNA) within the probe population. Probe groups were set up to identify elements (cDNAs) with high differential expression in probe group #1. Probe group #1 consisted of 20 tumor RNAs, each probe representing a subset of lymphoma (e.g., B-cell non-Hodgkins lymphoma, T-cell non-Hodgkins lymphoma and Hodgkins lymphoma). Probes in group #2 included 16 essential and non-essential normal tissues (see, FIG. 4). A threshold (fold-overexpression in probe group #1) was set at 3.0. This threshold was set to identify elements with overexpression that could be reproducibly detected based on the quality of the chip. The sequences in this disclosure were sorted initially based on their CorixArray analysis, specifically on the basis of their mean signal 2 values.

Of the surveyed sequences, 95 were identified as highly expressed in lymphoma cells. Members of Group#1 (SEQ ID NOs:10,516; 10,505; 10,532; 10,487; 10,534; 10,500; 10,495; 10,535; 10,504; 10,488; 10,492; 10,507; 10,499; 10,498; 10,493; 10,508 (FIG. 5); SEQ ID NOs:10,548; 10,552; 10,574; 10,555; 10,547; 10,561; 10,572; 10,553; 10,541; 10,562; 10,569; 10,551 (FIG. 6)) have a mean signal 2<0.1 and can be considered as sequences with low/no expression in normal tissues. Members of Group#2 (SEQ ID NOs:10,525; 10,523; 10,528; 10,517; 10,526; 10,497; 10,513; 10,524; 10,522; 10,527; 10,533; 10,530; 10,496; 10,520; 10,509; 10,519; 10,491; 10,489; 10,494; 10,486; 10,503; 10,521; 10,490; 10,511 (FIG. 5); SEQ ID NOs:10,576; 10,567; 10,565; 10,580; 10,545; 10,540; 10,560; 10,577; 10,556; 10,550; 10,543; 10,557; 10,544; 10,579; 10,563; 10,549; 10,559; 10,554; 10,538; 10,539; 10,566; 10,537 (FIG. 6)) have a mean signal 2 between 0.1 and 0.2 and can be considered as clones with a potential for some expression in normal tissues. Members of Group#3 (SEQ ID NOs: 10,518; 10,515; 10,501; 10,529; 10,531; 10,512; 10,536; 10,510; 10,506; 10,514; 10,502 (FIG. 5); SEQ ID NOs:10,568; 10,546; 10,564; 10,570; 10,578; 10,573; 10,542; 10,558; 10,575; 10,571 (FIG. 6)) have a mean signal 2>0.2 and can be considered as clones that have the potential to have expression in some normal tissues.

5.5 Example 5

Identification of Candidate Genes with the Same Tissue Expression Profile as CD20 and CD52

This example identifies leukemia tumor and tissue-specific genes that have similar tissue expression profiles as CD20 and CD52 (FIG. 7). Antibodies against these two markers have been used for the therapy of hematological malignancies and other diseases associated with expression of these markers, i.e., FDA-approved Rituximab (anti-CD20 Ab) and Campath (anti-CD52 Ab). The similarity in gene expression between our candidate genes and CD20 and CD52 suggests that the described genes will also be useful as compounds for the diagnosis and therapy of hematological malignancies and other cancerous and non-cancerous diseases associated with expression of one or more of the described antigens.

RealTime PCR was used to compare the expression profiles of the candidate genes with the expression profiles of CD20 and CD52. FIG. 8 illustrates the expression of the candidate genes in hematopoietic subsets and hematological malignancies. Data summarized in this sheets shows that using a combination of the PCR subtracted cDNA libraries, microarray analyses, and RealTime PCR, it is possible to identify genes differentially expressed in in normal B-cells, lymphomas, myeloma, chronic lymphocytic leukemia, and acute myeloid leukemia. FIG. 9 shows the sequences of the candidate genes (SEQ ID NOs:10,581-10,596).

The following Examples 6-9 illustrate procedures used for further analysis of candidate genes identified through PCR subtractive hybridization, microarray analyses, and RealTime PCR.

5.6 Example 6

Analysis of Ly1464, One of the Genes with a Similar Expression Profile as CD20 and CD52

This example illustrates the typical procedure used to identify antigens for use as therapeutics, diagnostics, etc. and preferred methods for developing therapeutics and diagnostics for leukemia/lymphoma diseases. First, candidate genes highly enriched in leukemia/lymphoma cells are identified using PCR subtraction library cloning. Next, subtracted cDNA sequences are analyzed by microarray analysis to evaluate their expression in hematological malignancies and normal tissues. Since microarray analysis often identifies genes that represent known genes or genes that subsequently are found by RealTime analysis to have broader expression profiles, the microarray analysis is combined with comparisons to public databases to identify and prioritize candidate sequences for analysis. Next, RealTime PCR is used to analyze the expression profiles in various hematological subsets. In some cases, further analysis is focused on antigens with expression profiles similar to known therapeutics. For these genes, structural prediction programs are used to identify transmembrane domains, antigen-specific CTL are generated using human in vitro priming, and humanized monoclonal and polyclonal antibodies are generated as reagents for the diagnosis and therapy of malignancies and autoimmune disorders associated with antigen expression.

As an example, the analysis of Ly1464P (FIG. 10; nucleotide sequence—SEQ ID NO:10,597; protein sequence—SEQ ID NO:10,598) is summarized below.

Expression Analysis

Overexpression of Ly1464 was documented by microarray analyses and RealTime PCR. Ly1464P is overexpressed in lymphomas, in lymphoblastic leukemia and in multiple myeloma specimens, while expression in normal tissues is restricted to normal B-cells.

Sequence Analysis

Ly1464P PCR subtraction library clone sequences matched the Genbank clone MGC:4595 (ACCESSION XM_033969). Ly1464P was mapped to human chromosome 1 and appears to have some sequence homology to a murine Ig-like extracellular domain protein. TMpred analysis of Ly1464P indicates that this protein contains a transmembrane domain (FIG. 11).

Development of Therapeutics

Several MHC class I binding peptides of Ly1464P were identified (FIG. 12: SEQ ID NOs:10,599-10,819). These peptides are human CTL epitopes of Ly1464. Using human in vitro priming, Ly1464-specific CTL are being generated and cloned. The T-cell receptor of the Ly1464-specific T cells are cloned and used to generate genetically engineered T-cells specific for Ly1464. These T cells can be adoptively transferred into patients suffering from Ly1464-associated malignancies, such as but not restricted to lymphoma, plasma cell disorders as well as autoimmune diseases, such as but not restricted to, rheumatoid arthritis, Lupus erythematodes, Sjogrens disease, severe aplastic anemia, idiopathic thrombocytopnic purpura.

Using the TSITES program, T-helper epitopes were identified (FIG. 13). Polypeptides have been synthesized (FIG. 14; SEQ ID NOs:10,820-10,842) and are being used to generate antibodies that are specific for Ly1464P. These humanized monoclonal antibodies may be used (conjugated or unconjugated) for the diagnosis and therapy of malignancies and autoimmune disorders associated with Ly1464 expression.

5.7 Example 7

Recombinant Expression of Ly1464

The full-length sequence of the Ly1464 antigen was cloned through PCR amplification of normal tissue cDNA known to express the gene. The gene was cloned directly into the pCRX2 vector as an N-terminal Ra12 fusion, Ra12-Ly1464 (FIGS. 15 & 16; SEQ ID NO:10,467 (nucleotide); SEQ ID NO:10,468 (protein)), using restriction enzymes NcoI and XhoI and the sequence was subsequently confirmed. The optimal protein expression conditions in E. coli were determined by mini-induction screening. The recombinant protein can be used for clinical treatment, diagnosis, or a vaccine antigen.

5.8 Example 8

Analysis of Ly1484 (SEQ ID NO:10,846), One of the Genes with a Similar Expression Profile as CD20 and CD52

Ly1484P PCR subtraction library clone sequences matched the Genbank clone KIAA1607 (acc. no. XM033378, XM033379 and AB046827) and FJL00111 (acc. no. AK024502). Overexpression of Ly1484 was documented by microarray analyses and RealTime PCR. Ly1484P is overexpressed in B cell neoplasms, while expression in normal tissues is restricted to normal B-cells.

A full length sequence of candidate Ly1484P (FIG. 17) was obtained using the Genbank database. Ly1484P was mapped to human chromosome 10. There is both a long and short version of Ly1484P (FIG. 17; long version—SEQ ID NO:10, 847; short version—SEQ ID NO:10,848). TMpred analysis of Ly1484P indicates that this protein contains a transmembrane domain (FIG. 18). Several MHC class I binding peptides of Ly1464P have been identified (FIGS. 19 & 20; SEQ ID NOs:10,849-10,908) and are being used to generate antigen-specific CTLs. Using the TSITES program, T-helper epitopes have also been identified (FIGS. 21 & 22). Polypeptides have been generated and are being used to generate antibodies that are specific for Ly1484P.

5.9 Example 9

Expression and Bioinformatic Analyses of Ly1456

This example describes the characterization of one of the candidate genes, Ly1456P, identified by subtractive hybridization. Sequences representing Ly1456P (SEQ ID NOs:10, 971 and 10,972) are contained in previous filings. SEQ ID NO:10,973 corresponds to the initial sequence derived from a lymphoma PCR subtraction library clone and identified as being overexpressed in lymphomas by microarray analysis. RealTime PCR demonstrates that this gene is overexpressed in B-cell derived hematological malignancies, including lymphomas (Non-Hodgkin's and Hodgkin's), chronic lymphocytic leukemia and multiple myeloma.

The sequence was used to query public databases, including GenBank, EST human, GenSeq, and htgs. No match (<le-25) was found to sequences contained within the GenBank nucleotide database. A Blastx search of the GenBank protein data base indicated that Ly1456P contains an open reading frame that encodes a polypeptide that has 46% identity (over a 20 amino acid stretch) with the TNF-receptor. No match was found in the GenSeq nucleotide database and the only match (Blastx) to the GenSeq protein database was to TNR-R at 46% identity. EST sequences were identified that had homology to this initial Ly1456P sequence.

A Blastm search of the LifeSeq Gold database (Incyte) identified a 1442 bp Incyte unique template (LS_238330.1; SEQ ID NO:10,469) that was homologous to Ly1456P. This template sequence is the only template in LifeSeq bin #238330 and contains sequence from 78 different clones, of which 33 (~42%) were derived from libraries derived from hematologic and immune tissue (see, FIG. 23 for summary of library attributes). Four open reading frames that have an ATG translational start site and encode a polypeptide with greater than 50 amino acids were identified in LS_238330.1. None of these polypeptide sequences were predicted to have a trans-membrane region using TMpred, a Corixa in-house algorithm that identifies hydrophobic regions within polypeptides. Many open reading frames were identified that did not contain an ATG translational start site. A Blastx search of GenBank and GenSeq protein data bases did not identify any potential polypeptides within LS_238330.1 that have reasonable homology to any known proteins. The homology to TNF-R is lost as a result of single nucleotide deletion in LS_238330.1 with respect to the Ly1456P PCR subtraction library fragment.

The Ly1456P PCR subtraction library fragment is contained within the extended 1442 bp sequence for Ly1456P (SEQ ID NO:10,469) sequence for Ly1456P, derived from LS_238330.1, and both map to chromosome 17. Moreover, the 1442 bp sequence of LS_238330.1 is a contiguous sequence with respect to the available sequence from chromosome 17 indicating that this sequence represents a single exon. SEQ ID NO:10,972 extends beyond the 5'-end of LS_238330.1 with no evidence of an additional exon (i.e. still a single contiguous exon sequence mapping to chromosome 17). The resulting sequence (1637 bp) is the most extensive sequence obtained for Ly1456P and includes an Alu-like repeat element at its 5'-end (Ly1456P_FL_contig; SEQ ID NO:10,470). Repeated Blast searches using this extended sequence for Ly1456P and flanking genomic sequence from chromosome 17 fails to reveal additional sequence. Polypeptide sequence for the four identified open reading frames that have an ATG start of translation and which are >50 amino acids in length are included in this disclosure (SEQ ID NOs: 10,471-10,474). These polypeptides were identical for both LS_238330.1 and the extended Ly1456P_FL_contig sequence.

5.10 Example 10

Sequence Analyses, Expression Analyses, and Structure Analyses of Other Antigens with Similar Expression Profiles as CD20 & CD52

| | Summary of Results | | | |
|---|---|---|---|---|
| Antigen | Sequence Analysis | Expression Analysis by Realtime PCR | Number of Predicted Trans-membrane Domains | Other |
| Ly1485 | Matched with homo sapiens Genbank clone on chromosome 15q21 clone b2265b18 (acc. no. AC008131), human secreted protein-encoding gene 9 | Overexpressed in B cell neoplasms, such as B cell lymphomas, CLL and multiple myeolomas, and acute myelogenous leukemia. | unknown | |

-continued

Summary of Results

| Antigen | Sequence Analysis | Expression Analysis by Realtime PCR | Number of Predicted Transmembrane Domains | Other |
|---|---|---|---|---|
| | cDNA clone HTOHB55 (accession number AAH19210), and secreted protein-encoding gene 9 cDNA clone HTOHB55 (acc. no. AAH19178) located on chromosome 15q21. (see, Figures 24-26; SEQ ID NOs: 10,475-10,477) | Expression in normal tissues is restricted to normal B cells. | | |
| Ly1488 (see, Figure 27; SEQ ID NOs: 10,969 & 10,970) | Matched with Genbank clone Rp3-329A5 (acc. no. Z97832). Mapped to human chromosome 6. | Overexpressed in lymphomas and B cell neoplasms. | one | (see, Figure 28) |
| Ly1449 and Ly1480 | Matched via Genbank analysis with lung cancer associated polynucleotide sequence SQID 265 (Geneseq acc. no. AAF18246) and homo sapiens Genbank clone on chromosome 17 clone RP11-956N15 (acc. no. AC021581). (see, Figures 29 and 30; SEQ ID NOs: 10,478 and 10,479) | Overexpressed in B-cell neoplasms, such as such as B cell lymphomas, CLL and multiple myeolomas, and acute myelogenous leukemia. | unknown | |
| Ly1454 | Matched via Genbank with Genbank clone on chromosome 3 clone RP11-457E6 (acc. no. AC048348) | Overexpressed in B-cell neoplasms, such as B cell lymphomas, CLL and multiple myeolomas, and acute myelogenous leukemia. | unknown | |
| Ly1482 | Matched via Genbank with homo sapiens Genbank clone on chromosome 6q25 clone RP1-111C20 (acc. no. AL035530) | Overexpressed in B cell neoplasms, such as B cell lymphomas, CLL and multiple myeolomas, and acute myelogenous leukemia. | unknown | |

5.11 Example 11

Sequence Analysis of Ly1451

The Ly1451 (SEQ ID NO:10,979) sequence derived from a lymphoma PCR subtraction library clone was used to query several public databases, including GenBank and GenSeq. No matches (>90 identity) were detected for the 5'-proximal 51 bp suggesting that this sequence may contain a repeat element. A BLASTN search of the LifeSeq database (Incyte) identified a 980 bp template (template #1076101.8; SEQ ID NO:10,480 that contained all 240 bp of Ly1451. This template consisted of sequences from 6 clones, of which 2 (33%) were derived from hematologic/immune tissue libraries. Template #1076101.8 was part of a bin containing 11 templates derived from a total of 104 clones, of which 12 (9%) were derived from hematologic/immune tissue libraries.

This sequence (SEQ ID NO:10,480) was used to search further public databases but no additional sequences were obtained. However, these searches indicate this sequence is a human endogenous retroviral sequence (HERV) encoding polypeptides corresponding to portions of the integrase and envelope genes. A single ORF with an ATG translational start site is contained in the forward read of LS1076101.8

The polypeptide encoded by this ORF (SEQ ID NO:10,481) is not predicted to have a transmembrane domain.

5.12 Example 12

Identification of a Specific Gene, Ly1448, Associated with B Cell Leukemias, Lymphomas and Multiple Myelomas SEQ ID NO:9599 in co-pending application U.S. Ser. No. 09/796,692, also termed "Ly1448," a portion of which was disclosed earlier in co-pending application U.S. Ser. No. 09/796,692 as SEQ ID NO:636 was used to screen a series of MicroArray and RealTime chips and panels containing cDNAs made from RNAs isolated from normal cells and hematologically malignant cells. SEQ ID NO:9599 appeared to be expressed in normal B cell lines, CD 19$^+$ cell lines, and highly expressed in a subset of Non-Hodgkins B-cell lymphoma cell lines, Hodgkins lymphoma cell lines, follicular lymphoma cell lines, and Chronic Lymphocytic Leukemia cell lines.

SEQ ID NO:9599, which is a 523 base pair cDNA fragment, was used to screen the LIFESEQ® Gold database and two additional clones were identified, SEQ ID NO:9598, also termed "LS 1384258.1", which is a 622 base pair cDNA fragment, and SEQ ID NO:9600, also termed "LS 368109.1", which is a 1,908 base pair cDNA.

The BLAST analysis determined that the open reading frame (ORF) of SEQ ID NO: 9600 begins at nucleotide 777, ends at nucleotide 1562 and encodes a 261 amino acid protein as identified in SEQ ID NO:9611, termed LY1448 protein. Further analysis of SEQ ID NO:9600 using both TMpred and PSORTII indicated that SEQ ID NO:9611 is a type-1b membrane protein, containing a predicted transmembrane domain beginning at amino acid 156 and ending at amino acid 177. The extracellular portion of SEQ ID NO:9611 has homology with immunoglobulins and contains a predicted Ig-like domain. The intracellular portion of SEQ ID NO:9611 contains Src Homology-2 (SH2) binding domains and an Immune Receptor Tyrosine-Based Inhibition Motif (ITIM). As such, LY1448 protein may play a specific role in hematopoetic cell signaling. Further structural and homology analysis of these cDNA fragments is described in the co-pending application U.S. Ser. No. 09/796,692.

Overlapping immunogenic peptides derived from Ly1448 protein sequence (SEQ ID NO:9611) were generated and used to make antibodies immunoreactive to epitopes of the peptide for diagnostic and therapeutic purposes. Detailed description of the generation of immunogenic peptides is in Examples 4 and 5 of co-pending application U.S. Ser. No. 09/796,692.

5.13 Example 13

Detection of Ly1448-Specific and TCL-1-Specific Antibodies in Patients with Hematological Malignancies This example illustrates that Ly1448-specific and TCL-1-specific antibodies are present in the sera of patients with hematological malignancies, such as, but not restricted to, lymphoma. Detection of these specific antibodies provides a tool for early diagnosis of hematological malignancies; specifically for the screening of healthy individuals or individuals at risk for developing lymphomas, such as transplant recipients and immunocompromised patients (i.e., AIDS patients) for the presence of hematological malignancies or a marker for monitoring minimal residual disease. Furthermore, these data demonstrate that Ly1448 and TCL-1 are immunogenic in patients.

The specific antibodies derived from these patients can be used to identify epitopes which can be used for the therapy of hematological malignancies. FIG. 31 shows the Ly1448 specific Ab data (black and white). FIG. 32 shows the TCL-1 specific Ab data.

48 control sera were screened by ELISA assay using recombinant Ly1448 protein or TCL-1 protein. The mean OD reading of all 48 normal sera+2.5× standard deviations was determined as a cut off level and shown in the figures as a black line. All sera demonstrating higher values were defined as positive.

5.14 Example 14

Expression of TCL-1 and Ly1452 Lymphoma Antigens

Recombinantly expressed TCL-1 and Ly1452 antigens were constructed to allow for quick and easy purification of the protein.

The open reading frames for TCL-1 and Ly1452 were PCR amplified and subcloned into a modified pET28 vector with a His tag in-frame and recombinantly expressed in *E. coli* (His-Ly1452: SEQ ID NO:10,482 (nt), SEQ ID NO:10,483 (protein); His-TCL-1: SEQ ID NO:10,484 (nt), SEQ ID NO:10,485 (protein)).

Ly11452P Expression in *E. coli*

The open reading frame of the LS coding region was PCR amplified with the following primers:

```
                                    (SEQ ID NO:10,975)
PDM-797 5' gtgtcacaatctacagtcaggcaggattctcc 3'
Tin 64° C.

(SEQ ID NO:10,976)
PDM-799 5' gttatgtagcggccgcttatcatgttgctgcagag 3'
Tm 67° C.
```

Using the following conditions:

| |
|---|
| 10 µl 10X Herculase buffer |
| 1 µl 10 mM dNTPs |
| 2 µl 10 µM each oligo |
| 83 µl sterile water |
| 1.0 µl Herculase DNA polymerase (Stratagene, La Jolla, CA) |
| 50 ηg DNA |
| 98° C. 3 minutes |
| 98° C. 40 seconds  60° C. 30 seconds  72° C. 2 minute × 10 cycles |
| 98° C. 40 seconds  60° C. 30 seconds  72° C. 2 minutes 30 seconds × 10 cycles |
| 98° C. 40 seconds  60° C. 30 seconds  72° C. 3 minutes × 10 cycles |
| 98° C. 40 seconds  60° C. 30 seconds  72° C. 3 minutes 30 seconds × 10 cycles |
| 72° C. 4 minutes |

The PCR product was digested with Xho I and cloned into pPDM H is (a modified pET28 vector with a His tag in frame on the 5' end) that had been digested with Eco72I and XhoI. Construct was confirmed through sequence analysis and transformed into BLR (DE3) pLysS and HMS 174 pLys S cells.

TCL1 Expression in *E. coli*

The full length open reading frame was PCR amplified with the following primers:

```
                                    (SEQ ID NO:10,977)
PDM-842 5' gccgagtgcccgacactcgggg 3'
Tm 66° C.

(SEQ ID NO:10,978)
PDM-843 5' catttgaattcatcagtcatctggcagcagc 3'
Tin 62° C.
```

Using the following conditions:

| |
|---|
| 10 µl 10X Pfu buffer |
| 10 µl 10 mM dNTPs |
| 2 µl 10 gM each oligo |
| 831 sterile water |
| 1.51 Pfu DNA polymerase (Stratagene, La Jolla, CA) |
| 50 ηg DNA |
| 96° C. 2 minutes |
| 96° C. 20 seconds  63° C. 15 seconds  72° C. 1 minute × 40 cycles |
| 72° C. 4 minutes |

The PCR product was digested with EcoRI and cloned into pPDM H is (a modified pET28 vector with a His tag inframe on the 5' end) that had been digested with Eco72I and EcoRI. Construct was confirmed through sequence analysis and transformed into BLR (DE3) pLysS and HMS 174 (DE3) pLys S cells Recombinant proteins are also expressed without a histidine tag or with other lymphoma antigens. They are also expressed in other vectors, including other *E. coli* constructs, Baculovirus, yeast, and mammalian expression vectors. This recombinant antigen can be used to make polyclonal and monoclonal antibodies or used in immunological assays.

6. REFERENCES

The following references, to the extent that they provide exemplary procedural or other details supplementary to those set forth herein, are specifically incorporated herein by reference.

U.S. Pat. No. 3,817,827.
U.S. Pat. No. 3,850,752.
U.S. Pat. No. 3,901,654.
U.S. Pat. No. 3,935,074.
U.S. Pat. No. 3,984,533.
U.S. Pat. No. 3,996,345.
U.S. Pat. No. 4,034,074.
U.S. Pat. No. 4,098,876.
U.S. Pat. No. 4,235,877.
U.S. Pat. No. 4,376,110.
U.S. Pat. No. 4,429,008.
U.S. Pat. No. 4,436,727.
U.S. Pat. No. 4,452,901.
U.S. Pat. No. 4,489,710.
U.S. Pat. No. 4,507,234.
U.S. Pat. No. 4,554,101.
U.S. Pat. No. 4,569,789.
U.S. Pat. No. 4,603,112.
U.S. Pat. No. 4,625,014.
U.S. Pat. No. 4,638,045.
U.S. Pat. No. 4,671,958.

U.S. Pat. No. 4,673,562.
U.S. Pat. No. 4,683,195.
U.S. Pat. No. 4,699,784.
U.S. Pat. No. 4,735,792.
U.S. Pat. No. 4,751,180.
U.S. Pat. No. 4,769,330.
U.S. Pat. No. 4,777,127.
U.S. Pat. No. 4,866,034.
U.S. Pat. No. 4,873,088.
U.S. Pat. No. 4,877,611.
U.S. Pat. No. 4,897,268.
U.S. Pat. No. 4,912,094.
U.S. Pat. No. 4,935,233.
U.S. Pat. No. 5,017,487.
U.S. Pat. No. 5,075,109.
U.S. Pat. No. 5,145,684.
U.S. Pat. No. 5,151,254.
U.S. Pat. No. 5,215,926.
U.S. Pat. No. 5,240,856.
U.S. Pat. No. 5,350,840.
U.S. Pat. No. 5,359,681.
U.S. Pat. No. 5,399,346.
U.S. Pat. No. 5,399,363.
U.S. Pat. No. 5,466,468.
U.S. Pat. No. 5,472,869.
U.S. Pat. No. 5,543,158.
U.S. Pat. No. 5,552,157.
U.S. Pat. No. 5,565,213.
U.S. Pat. No. 5,567,434.
U.S. Pat. No. 5,633,234.
U.S. Pat. No. 5,641,515.
U.S. Pat. No. 5,738,868.
U.S. Pat. No. 5,741,516.
U.S. Pat. No. 5,795,587.
U.S. Pat. No. 5,811,128.
U.S. Pat. No. 5,814,344.
U.S. Pat. No. 5,820,883.
U.S. Pat. No. 5,853,763.
U.S. Pat. No. 5,874,265.
U.S. Pat. No. 5,928,647.
U.S. Pat. No. 5,942,252.
U.S. Pat. No. 6,110,702.
European Patent No. EP 0,345,242.
Great Britain Patent No. GB 2,200,651.
Intl. Pat. Appl. Publ. No. WO 89/01973.
Intl. Pat. Appl. Publ. No. WO 89/06280.
Intl. Pat. Appl. Publ. No. WO 91/02805.
Intl. Pat. Appl. Publ. No. WO 91/16116.
Intl. Pat. Appl. Publ. No. WO 92/07243.
Intl. Pat. Appl. Publ. No. WO 94/00153.
Intl. Pat. Appl. Publ. No. WO 94/20078.
Intl. Pat. Appl. Publ. No. WO/94/23701.
Intl. Pat. Appl. Publ. No. WO 95/17210.
Intl. Pat. Appl. Publ. No. WO 96/02555.
Intl. Pat. Appl. Publ. No. WO 96/06638.
Intl. Pat. Appl. Publ. No. WO 96/30516.
Intl. Pat. Appl. Publ. No. WO 96/33739.
Intl. Pat. Appl. Publ. No. WO 97/24447.
Intl. Pat. Appl. Publ. No. WO 99/33488.
Aaroston and Todaro, *J. Cell. Physiol.*, 72:141-48, 1968.
Adelman et al., *DNA*, 2:183, 1983.
Amin et al., *Am. J. Pathol.*, 146:344-56, 1995.
Akaza et al., "Expression of antitumor response. Role of attachment and viability of bacillus Calmette-Guerin to bladder cancer cells," *Cancer*, 72:558-63, 1993.
American *Type Culture* Collection, Catalogue of Cell Lines and Hybridomas, 7th ed., 1992.
Avrameas, "Natural autoantibodies: Self-recognition and physiological autoimmunity," In: *Natural autoantibodies: Their Physiological Role and Regulatory Significance*, Shoenfeld and Isenberg (eds.), CRC Press, Boca Raton, Fla., pp. 1-14, 1993.
Azuma et al., "Correlation Between Augmented Resistance to Influenza Virus Infection and Histological Changes in Lung of Mice Treated with Trehalose-6,6'-dimycolate," *Journal of Biological Response Modifiers*, 7:473-82, 1988.
Bajorin et al., *Proc. Annu. Meet. Am. Soc. Clin. Oncol.*, 7:A967, 1988.
Baker et al., "Ability of Monophosphoryl Lipid A To Augment the Antibody Response of Young Mice," *Infection and Immunity*, 56:3064-66, 1988a.
Baker et al., "Enrichment of Suppressor T Cells by Means of Binding to Monophosphoryl Lipid A," *Infection and Immunity*, 58:726-31, 1990.
Baker et al., "Inactivation of Suppressor T-Cell Activity by Nontoxic Monophosphoryl Lipid A," *Infection and Immunity*, 56:1076-83, 1988b.
Baker et al., "Molecular structures that influence the immunomodulatory properties of the lipid A and inner core region oligosaccharides of bacterial lipopolysaccharides," *Infection Immunity*, 62:2257-69, 1994.
Baker et al., "Structural Features That Influence the Ability of Lipid A and Its Analogs To Abolish Expression of Suppressor T Cell Activity," *Infection and Immunity*, 60:2694-701, 1992.
Bakker et al., "Melanocyte lineage-specific antigen gp100 is recognized by melanoma-derived tumor-infiltrating lymphocytes," *J. Exp. Med.*, 179:1005, 1994.
Banchereau and Steinman, *Nature*, 392:245-51, 1998.
Banerji et al., "Membrane lipid composition modulates the binding specificity of a monoclonal antibody against liposomes," *Biochim. Biophys. Acta.*, 689:319-26, 1982.
Barnd et al., "Specific tumor histocompatibility complex-unrestricted recognition of tumor-associated mucins by human cytotoxic T cells," *Proc. Natl. Acad. Sci. USA*, 86:7159, 1989.
Barnoud et al., *Am. J. Surg. Pathol.*, 24:830-36, 2000).
Bartlett and Zbar, *J. Natl. Cancer Inst.*, 48:1709, 1972.
Bast et al., "BCG and Cancer," *N. Engl. J. Med.*, 290:1413-20, 1974.
Bennett et al., "Endogenous Production of Cytotoxic Factors in Serum of BCG-Primed Mice by Monophosphoryl Lipid A, a Detoxified Form of Endotoxin," *Journal of Biological Response Modifiers*, 7:65-76, 1988
Berkner, *Biotechniques*, 6:616-27, 1988.
Berra et al., *Int. J. Cancer*, 36:363-66, 1985.
Berra et al., *J. Neurochem.*, 40:777-82, 1983.
Bogoch, "Demonstration of serum precipitin to brain gangliosides," *Nature*, 183:392-93, 1960.
Bouchon et al., *Biochem. Internatl.*, 10:531-38, 1985.
Bowen-Pope et al., *Proc. Nat'l Acad. Sci. USA*, 81:2396-400, 1984.
Bowness et al., "*Clostridium perfringens* enterotoxin is a superantigen reactive with human T cell receptors V beta 6.9 and V beta 22," *J. Exp. Med.*, 176:893-96, 1992.
Brade et al., "An Artificial Glycoconjugate Containing the Bisphosphorylated Glucosamine Disaccharide Backbone of Lipid A Binds Lipid A Monoclonal Antibodies," *Infection and Immunity*, 61:4514-17, 1993.
Brichard et al., "The tyrosinase gene codes for an antigen recognized by autologous cytolytic T lymphocytes on HLA-A2 melanomas," *J. Exp. Med.*, 178:489, 1993.
Brodin et al., "Mouse monoclonal antibodies with specificity for the melanoma-associated ganglioside disialyllactosyl ceramide (GD3) also react with the structural analogue disialylparagloboside," *Biochim. Biophys. Acta.*, 837:349-53, 1985.

Brooks et al., *Clin. Exp. Immunol.*, 39: 477, 1980.

Brown et al., *J. Biol. Chem.*, 255:4980-83, 1980.

Burchell et al., *J. Immunol.*, 131:508-13, 1983.

Bystryn et al., *Cancer*, 61:1065, 1988.

Cahan et al., "Identification of a human neuroectodermal tumor antigen (OFA-I-2) as ganglioside GD2," *Proc. Natl. Acad. Sci. USA*, 79:7629-33, 1982.

Campbell et al., "Intercellular adhesion molecule-1 expression by bladder cancer cells: functional effects," *J. Urol.*, 151:1385-90, 1994.

Campbell, in *Monoclonal Antibody Technology, Laboratory Techniques in Biochemistry and Molecular Biology*, Vol. 13, Burden and Von Knippenberg (eds.), Amsterdam, Elseview, pp. 75-83, 1984.

Campbell et al., *Int. J. Cancer*, 78:182-88, 1998.

Carr and Morrison, "A two-step mechanism for the interaction of Re lipopolysaccharide with erythrocyte membranes," *Rev. Infect. Dis.* 6:497-508, 1984.

Carubia et al., *Biochem. Biophys. Res. Commun.*, 120:500-04, 1984.

Chang et al., *Crit. Rev. Oncol. Hematol.*, 22:213, 1996.

Chase et al., "Effect of Monophosphoryl Lipid A on Host Resistance to Bacterial Infection," *Infection and Immunity*, 53(3):711-12, 1986.

Chen et al., "Activation of Macrophages From Aging Mice by Detoxified Lipid A," *Journal of Leukocyte Biology*, 49:416-22, 1991.

Chen et al., *Cancer Res.*, 54:1065-70, 1994.

Cheng et al., "Bacillus Calmette-Gerin interacts with the carboxyl-terminal heparin bindings domain of fibronectin: implications for BCG-mediated antitumor activity," *J. Urol.*, 152:1275-80, 1994.

Cheresh and Klier, "Disialoganglioside GD3 distributes preferentially into substrate associated microprocesses on human melanoma cells during their attachment to fibronectin," *J. Cell. Biol.*, 102:1887-97, 1986.

Cheresh et al., "A monoclonal antibody recognizes an O-acetyl sialic acid in a human melanoma-associated ganglioside," *J. Biol. Chem.*, 259:7453-59, 1984.

Cheresh et al., "Disialoganglioside GD3 on human melanoma serves as a relevant target antigen for monoclonal antibody-mediated tumor cytolysis," *Proc. Natl. Acad. Sci. USA*, 82:5155-59, 1985.

Cheresh et al., "Disialogangliosides GD2 and GD3 are involved in the attachment of human melanoma and neuroblastoma cells to extracellular matrix proteins," *J. Cell. Biol.*, 102:688-96, 1986.

Cheresh et al., "Localization of gangliosides GD2 and GD3 in adhesion plaques and on the surface of human melanoma cells," *Proc. Natl. Acad. Sci. USA*, 81:5767-71, 1984.

Cheung et al., "Detection of neuroblastoma cells in bone marrow using GD2 specific monoclonal antibodies," *J. Clin. Oncol.*, 4:363-69, 1986.

Chu and Sharom, "Gangliosides inhibit T-lymphocyte proliferation by preventing the interaction of interleukin-2 with its cell surface receptors," *Immunology*, 79:10-16, 1993.

Cohen, *Science*, 259:1691-92, 1993.

Colcher et al., *Proc. Natl. Acad. Sci. USA*, 78:3199, 1987.

Coligan et al., in *Current Protocols in Immunology*, Vol. 1, Wiley Interscience. Greene (ed.), 1998.

Coombes et al., *Vaccine*, 14:1429-38, 1996.

Coulie et al., "A new gene coding for a differentiation antigen recognized by autologous cytologic T lymphocytes on HLA-A2 melanomas," *J. Exp. Med.*, 180:35, 1994.

Deavin et al., *Mol. Immunol.*, 33:145-55, 1996.

DeBruijn et al., *Eur. J. Immunol.*, 21:2963-70, 1991.

Dippold et al., "Immunohistochemical localization of ganglioside GD3 in human malignant melanoma, epithelial tumors and normal tissues," *Cancer Res.*, 45:3699-705, 1985.

Dippold et al., "Inflammatory response at the tumor site after systemic application of monoclonal anti-GD3-ganglioside antibody to patients with malignant melanoma," *Am. Assoc. Cancer Res.*, 978:247, 1984.

Dippold et al., *Proc. Natl. Acad. Sci. USA*, 77:6115, 1980.

Dresser and Phillips, in *Immunopotentiation*, CIBA Foundation Symposium 18, Elsevier, Amsterdam, p. 3, 1973.

Dwivedi et al., "Plasma lipid-bound sialic acid alterations in neoplastic diseases," *Experientia*, 46:91-94, 1990.

Elder, "Skin Cancer," *Cancer*, 75:245-56, 1995.

Elliott et al., "The D-Galactosamine Loaded Mouse and Its Enhanced Sensitivity to Lipopolysaccharide and Monophosphoryl Lipid A: A Role for Superoxide," *J. Immunol.*, 10:69-74, 1991.

Euhus et al., *Cancer Immunol Immunother.*, 29:247-54, 1989.

Fawwaz et al., Statutory Invention Registration Patent No. H819, application no. 6-6-5,439, 1990.

Fischer, *Handb. Lipid Res.*, 6:123-234, 1990.

Fisher-Hoch et al., *Proc. Nat'l Acad. Sci. USA*, 86:317-21, 1989.

Fitzgerald, "Syphilis vaccine: up-regulation of immunogenicity by cyclophosphamide, Ribi adjuvant, and indomethacin confers significant protection against challenge infection in rabbits," *Vaccine*, 9:265-72, 1991.

Fleischmann, Park and Hassan, "Fibronectin expression on surgical specimens correlated with the response to intravesical bacillus Calmette-Guerin therapy," *J. Urol.*, 149: 268-71, 1993.

Flexner et al., *Ann. N.Y. Acad. Sci.*, 569:86-103, 1989.

Flexner et al., *Vaccine*, 8:17-21, 1990.

Foster et al., *Cancer Res.*, 57:3325-30, 1997.

Fraizer et al., *Blood*, 86:4704-06, 1995.

Fredman et al., *Neurol. Res.*, 8:123-26, 1986.

Freimer et al., "Gangliosides elicit a T-cell independent antibody response," *J. Autoimmun.*, 6:281-89, 1993.

Freudenberg et al., "ELISA for antibodies to Lipid A, lipopolysaccharides and other hydrophobic antigens," *Infection*, 17:322-24, 1989.

Gaiger et al., *Blood*, 96:1334, 2000

Garg and Subbarao, "Immune Responses of Systemic and Mucosal Lymphoid Organs to Pnu-Immune Vaccine as a Function of Age and the Efficacy of Monophosphoryl Lipid A as an Adjuvant," *Infection and Immunity*, 60:2329-36, 1992.

Gaugler et al., "Human gene MAGE-3 codes for an antigen recognized on a human melanoma by autologous cytolytic T lymphocytes," *J. Exp. Med.*, 179:921, 1994.

Gefter et al., *Somatic Cell Genet.*, 3:231-36, 1977.

Gennaro et al., *Am. J. Ind. Med.*, 37:275-82, 2000.

Gillard et al., "Antibodies against ganglioside $GT_3$ in the sera of patients with type I Diabetes mellitus," *J. Immunol.*, 142:3826-32, 1989.

Gillis, *Nature*, 268:154-56, 1977.

Glynn, McCoy and Fefer, *Cancer Res.*, 28:434-39, 1968.

Goding, in *Monoclonal Antibodies: Principles and Practice*, 2d ed., Orlando, Fla., Academic Press, pp. 60-61, 65-66, 71-74, 1986.

Goff et al., *Eur. J. Biochem.*, 130:553-57, 1983.

Grabarek et al., "Endotoxic Lipid A Interaction with Human Platelets," *The Journal of Biological Chemistry*, 265:8117-21, 1990.

Graus et al., "Distribution of the ganglioside GD3 in the human nervous system detected by R24 mouse monoclonal antibody," *Brain Res.*, 324:190-94, 1984.

Guzman et al., *Circulation*, 88:2838-48, 1993a.

Guzman et al., *Cir. Res.*, 73:1202-07, 1993b.

Hachida et al., *Transplant Proc.*, 22:1663-70, 1990.

Hachida et al., *Transplantation*, 56:479-82, 1993.

Harada et al., *Mol. Urol.*, 3:357-364, 1999.

Hardings et al., "Effects of pH and polysaccharides on peptide binding to class II major histocompatibility complex molecules," *Proc. Natl. Acad. Sci. USA*, 88:2740-44, 1991.

Harel et al., *Cancer Res.*, 50:6311, 1990.

Harlow and Lane, *Antibodies: A Laboratory Manual*, Cold Spring Harbor Laboratory, 1988.

Helling et al., "Construction of Immunogenic $GD_3$-conjugate vaccines," *Ann. N.Y. Acad. Sci.*, 690:396-97, 1993.

Hellstrom et al., "Strong anti-tumor activities of IgG 3 antibodies to a human melanoma-associated ganglioside," *Proc. Natl. Acad. Sci. USA*, 82:1499-1502, 1985.

Hirabayashi et al., "Syngeneic monoclonal antibody against melanoma antigen with interspecies cross-reactivity recognize $GM_3$, a prominent ganglioside of B16 melanoma," *Biol. Chem.*, 260:13328-33, 1985.

Hirabayashi et al., "Reactivity of mouse monoclonal antibody M2590 against B16 melanoma cells with chemically synthesized GM3 ganglioside," *Biochim. Biophys. Acta*, 875:126-28, 1986.

Hirabayashi et al., *Jpn. J. Cancer Res.*, 78:614-20, 1987.

Hoon et al., "Gangliosides from melanoma immunomodulate response of T-cells to interleukin-2," *Cell Immunol.*, 4:1111-19, 1988.

Horibata and Harris, *Exp. Cell. Res.*, 60:61, 1970.

Horgan, "Total and lipid-bound sialic acid levels in sera from patients with Cancer," *Clin. Chim. Acta.*, 118:327-31, 1982.

Houghten et al., "Mouse monoclonal IgG3 antibody detecting GD3 ganglioside: A phase I trial in patients with malignant melanoma," *Proc. Natl. Acad. Sci. USA*, 82:1242-46, 1985.

Houghton, "Cancer Antigens: Immune Recognition of Self and Altered Self," *J. Exp. Med.*, 180:1-4, 1994.

Hraba et al., "The Influence of Monophosphoryl Lipid A (MPL™) on Erythrocyte Autoantibody Formation," *Immunobiol.*, 189:448-56, 1993.

Hunter et al., *Vaccine*, 9:250: 1991.

Inoue et al., *Blood*, 88:2267-78, 1996.

Irie and Morton, "Regression of cutaneous metastatic melanoma by intralesional injection with human monoclonal antibody to ganglioside GD2," *Proc. Natl. Acad. Sci. USA*, 83:8694-98, 1986.

Irie and Ravindranath, "Gangliosides as targets for monoclonal antibody therapy of cancer," in *Therapeutic monoclonal antibodies*, Borrebaeck and Larrick (eds.), Stockton Press, New York, p. 75-94, 1990.

Irie et al., "Human antibody to OFA-I, a tumor antigen, produced in vitro by Epstein-Barr virus transformed human B-lymphoid cell lines," *Proc. Natl. Acad. Sci. USA*, 79:5666-70, 1982.

Irie et al., "Melanoma gangliosides and human monoclonal antibody," in *Human Tumor Antigens and Specific Tumor Therapy*, Metzgar and Mitchell (eds.), Alan R. Liss, Inc., New York, pp. 115-126, 1989.

Ishioka et al., "MHC interaction and T cell recognition of carbohydrates and glycopeptides," *J. Immunol.*, 148:2446-51, 1992.

Jackson et al., "Induction of ICAM 1 expression on bladder tumours by BCG immunotherapy," *J. Clin. Pathol.*, 47:309-12, 1994.

Johnson and Tomai, "A Study of the Cellular and Molecular Mediators of the Adjuvant Action of a Nontoxic Monophosphoryl Lipid A," *Adv. Exp. Med. Biol.*, 133:567-79, 1988.

Johnson et al., "Characterization of a nontoxic monophosphoryl lipid A," *Rev. Infect. Dis.*, 9:512-16, 1987.

Johnson et al., "Structural Characterization of Monophosphoryl Lipid A Homologs Obtained from *Salmonella minnesota* Re595 Lipopolysaccharide," *J. Biol. Chem.*, 265:8108-16, 1990.

Johnston and Bystryn, "Effect of Cell Wall Skeleton and Monophosphoryl Lipid A Adjuvant on the Immunogenicity of a Murine B16 Melanoma Vaccine," *Journal of the National Cancer Institute*, 83:1240-45, 1991.

Jones et al., *J Natl Cancer Inst*, 66:249-54, 1981.

Kabat et al., "Sequences of Proteins of Immunological Interest," 5th ed., Public Health Service, National Institutes of Health, Bethesda, Md., pp 647-669, 1991.

Kass-Eisler et al., *Proc. Nat'l Acad. Sci. USA*, 90:11498-502, 1993.

Katopodis et al., "Lipid-associated sialic acid test for the detection of human cancer," *Cancer Res.*, 42:5270-75, 1982.

Kawaguchi et al., "Characteristic mode of action of gangliosides in selective modulation of CD4 on human T lymphocytes," *Biochem. Biophys. Res. Commun.*, 158:1050-55, 1989.

Kawakami et al., "Cloning of the gene coding for a shared human melanoma antigen recognized by autologous T cells infiltrating into tumor," *Proc. Natl. Acad. Sci. USA*, 91:3515, 1994.

Kawakami, Eliyahu, Sakaguchi, Robbins, Rivoltini, Yannelli, Appella and Rosenberg, "Identification of the immunodominant peptides of the Mart-1 human melanoma antigen recognized by the majority of HLA-A2 restricted tumor infiltrating lymphocytes," *J. Exp. Med.*, 180:347-52, 1994.

Kensil et al., *J. Am. Vet. Med. Assoc.*, 199:1423, 1991.

Kloppel et al., "Glycolipid-bound sialic acid in serum: Increased levels in mice and humans bearing mammary carcinomas," *Proc. Natl. Acad. Sci. USA*, 74:3011-13, 1977.

Kohler and Milstein, *Nature*, 256:495-97, 1975.

Kohler and Milstein, *Eur. J. Immunol.*, 6:511-19, 1976.

Kolls et al., *Proc. Nat'l Acad. Sci. USA*, 91:215-19, 1994.

Koscielak et al., "Glycolipid antigen and its antibody," *Immunochemistry*, 5:441-55, 1968.

Kovach et al., "Lipid $IV_A$ Inhibits Synthesis and Release of Tumor Necrosis Factor Induced by Lipopolysaccharide in Human Whole Blood Ex Vivo," *J. Exp. Med.*, 172:77-84, 1990.

Kwok and Higuchi, *Nature*, 339:237-38, 1989.

Kyogashima et al., *Jpn. J. Cancer Res.*, 78:1229-32, 1987.

Ladisch et al., "Shedding of GD2 ganglioside by human neuroblastoma," *Int. J. Cancer*, 39:73-76, 1987.

Lamm et al., "A randomized trial of intravesical doxorubicin and immunotherapy with bacille Calmette-Guerin for transitional-cell carcinoma of the bladder," *N. Engl. J. Med.*, 325:1205, 1991.

Lengle et al., "Inhibition of the lectin-induced mitogenic response of thymocytes by glycolipids," *Cancer Res.*, 39:817-922, 1979.

Liepkalns et al., *J. Neurochem.*, 36:1959-65, 1981.

Livingston et al., "The Serologic Response to Meth A Sarcoma Vaccines After Cyclophosphamide Treatment is Additionally Increased by Various Adjuvants," *The Journal of Immunology*, 135(2):1505-09, 1985.

Livingston et al., "Approaches to augmenting immunogenicity of the ganglioside $GM_2$ in mice: purified $GM_2$ is superior to whole cells," *J. Immunol.*, 138:1524-29, 1987a.

Livingston et al., "Vaccines containing purified $GM_2$ gangliosides elicit $GM_2$ antibodies in melanoma patients," *Proc. Natl. Acad. Sci. USA*, 84:2911-15, 1987b.

Ljunggren et al., *Nature*, 346:476-80, 1990.

Lozzio and Lozzio, *Blood*, 45:321-34, 1975.

Madonna and Vogel, "Induction of Early-Phase Endotoxin Tolerance in Athymic (Nude) Mice, B-Cell-Deficient (xid) Mice, and Splenectomized Mice," *Infection and Immunity*, 53:707-10, 1986.

Mahvi et al., *Immunology and cell Biology*, 75:456-60, 1997.

Maratea et al., *Gene*, 40:39-46, 1985.

Masihi et al., "Effects of Nontoxic Lipid A and Endotoxin on Resistance of Mice to *Toxoplasma gondii*," *Journal of Biological Response Modifiers*, 7:535-39, 1988

Melling et al., *J. Immunol.*, 117:1267-74, 1976.

Menssen et al., *J. Cancer Res. Clin. Oncol.*, 126:226-32, 2000.

Merrifield, *J. Am. Chem. Soc.*, 85:2149-46, 1963.

Miller and Esselman, "Modulation of immune response by antigen reactive lymphocytes after cultivation with gangliosides," *J. Immunol.*, 115:839-43, 1975.

Minden, "Shared Antigens Between Animal and Human Tumors and Microorganisms," in *BCG in Cancer Immunotherapy*, Lamoureux, Turcotte and Portelance (eds.); pp. 73-81, 1976.

Miotti et al., *Cancer Res.*, 65:826, 1985.

Mitchell et al., "Active specific Immunotherapy of melanoma with allogeneic cell lysates: Rationale, results and possible mechanisms of action," *Ann. N.Y. Acad. Sci.*, 690:153-66, 1993.

Mitchell et al., "Active specific immunotherapy of melanoma: Phase I trial of allogeneic lysates and a novel adjuvant," *Cancer Res.*, 48:5883-93, 1988.

Mitchell et al., "Active-Specific Immunotherapy for Melanoma," *Journal of Clinical Oncology*, 8:856-59, 1990.

Miyake et al., *Cancer Res.*, 48:6154-60, 1988.

Mooney et al., "Bacterial superantigen signaling via HLA class II on human B lymphocytes," *Mol. Immunol.*, 31:675-81, 1994.

Morrison et al., "Specific ganglioside binding to receptor sites on T lymphocytes that couple to ganglioside-induced decrease of CD4 expression," *Life Sci.*, 45:1219-24, 1989.

Morton and Ravindranath, in *Cancer Medicine*, 3rd ed., Holland et al. (eds.), Lea and Febiger, Philadelphia, p. 967, 1993.

Morton et al., "Polyvalent Melanoma Vaccine Improves Survival of Patients with Metastatic Melanoma," John Wayne Cancer Institute at Saint John's Hospital and Health Center, Santa Monica, Calif., reprinted from *Specific Immunotherapy of Cancer with Vaccines*, Volume 690 of the *Annals of the New York Academy of Sciences*, 1993.

Morton et al., *Ann. Surg.*, 216:463, 1992.

Morton et al., in *Biological Function of Gangliosides, Progress in Brain Research*, Vol. 101, pp 251-275, 1994.

Mosmann and Coffman, *Ann. Rev. Immunol.*, 7:145-73, 1989.

Munjal et al., "Combined measurement and significance of lipid-bound sialic acid and carcinoembryonic antigen in detection of human cancer," *Diagn. Immunol.*, 2:36-43, 1984.

Murphy et al., *Proc. Natl. Acad. Sci. USA*, 83:8258-62, 1986.

Myers et al., "Monophosphoryl Lipid A Behaves as a T-Cell-Independent Type 1 Carrier for Hapten-Specific Antibody Responses in Mice," *Infection and Immunity*, 63:168-74, 1995.

Naiki et al., "Properties of antisera to ganglioside $GM_1$ and Asialo $GM_1$", *J. Immunol.*, 113:84-93, 1974.

Nair et al., *Nature Biotechnol.*, 16:364-69, 1998.

Natoli et al., "A murine monoclonal antibody detecting the ganglioside GM2: Characterization of cell surface reactivity," *Cancer Res.*, 46:4116-20, 1986.

Nonomura et al., *Hinyokika Kiyo*, 45:593-97, 1999.

Nudelman et al., "Characterization of a human melanoma-associated ganglioside antigen defined by a monoclonal antibody 4.2," *J. Biol. Chem.*, 257:12752-56, 1982.

Odean et al., "Involvement of Gamma Interferon in Antibody Enhancement by Adjuvants," *Infection and Immunity*, 58:427-32, 1990.

Oji et al., *Jpn. J. Cancer Res.*, 90:194-204, 1999.

Old et al., *Ann. N.Y. Acad. Sci.*, 101:80-106, 1962.

Pan et al., *Leukemia*, 14:1634, 2000.

Parker et al., *J. Immunol.*, 152:163, 1994.

Pascal et al., "Immunochemical studies on normal and Tay-Sachs' brain gangliosides," *Proc. Soc. Exp. Biol. Med.*, 121:739-43, 1966.

Patek, Collins and Cohn, "Transformed cell lines susceptible or resistant to in vivo surveillance against tumorigenesis," *Nature*, 276:510-11, 1978.

Patmasiriwat et al., *Leukemia*, 13:891-900, 1999.

Paul, *Fundamental Immunology*, 3rd ed., Raven Press, pp. 243-47, 1993.

Portoukalian et al., "Humoral immune response in disease-free advanced melanoma patients after vaccination with melanoma-associated gangliosides," *Int. J. Cancer*, 49:893-99, 1991.

Portoukalian, "Alteration of gangliosides in plasma and red cells of human bearing melanoma tumors," *Biochem. Biophys. Res. Commun.*, 85:916-20, 1978.

Portoukalian, "Immunoregulatory activity of gangliosides shed by melanoma tumors," in *Gangliosides and Cancer*, Oettgen (ed.), New York, VCH Publishers, pp. 207-16, 1989.

Powell and Newman (eds.), "Vaccine Design (the subunit and adjuvant approach)," Plenum Press, NY, 1995.

Prokazova et al., "Sialylated lactosylceramides. Possible inducers of non-specific immunosuppression and atherosclerotic lesions," *Eur. J. Biochem.*, 171:1-10, 1988.

Pukel et al., "GD3, a prominent ganglioside of human melanoma: Detection and characterization of mouse monoclonal antibody," *J. Exp. Med.*, 155:1133-47, 1982.

Qureshi et al., "Purification and structural determination of nontoxic lipid A obtained from the Lipopolysaccharide of *Salmonella typhimurium*," *J. Biol. Chem.*, 257:11808-15, 1985.

Rabinovich et al., "Vaccine Technologies: View to the Future," *Science*, 265:1401-02, 1994.

Raines and Ross, *J. Biol. Chem.*, 257:5154-60, 1982.

Rapport and Graf, "Immunochemical Reactions of Lipids," *Prog. Allergy*, 13:273-331, 1969.

Ravindranath and Irie, in Malignant Melanoma: Biology, Diagnosis, and Therapy, Nathanson (ed.), Kluwer Acad., Boston, p. 17, 1988.

Ravindranath and Morton, "Role of gangliosides in active immunotherapy with melanoma vaccine," *Int. Rev. Immunol.*, 7:303, 1991.

Ravindranath et al., "Human melanoma antigen O-acetylated Ganglioside $GD_3$ is recognized by *Cancer antennarius* lectin," *J. Biol. Chem.*, 263:2079-86, 1988.

Ravindranath et al., "An epitope common to gangliosides O-acetyl GD3 and GD3 recognized by antibodies in melanoma patients after active specific immunotherapy," *Cancer Res.*, 49:3891-97, 1989.

Ravindranath et al., "Ganglioside $GM_3:GD_3$ Ratio as an Index for the Management of Melanoma," *Cancer,* 67:3029-35, 1991.

Ravindranath et al., "Efficacy of tumor cell vaccine after incorporating monophosphoryl lipid A (MPL) in tumor cell membranes containing tumor-associated ganglioside," *Experientia*, 50:648-653, 1994a.

Ravindranath et al., "Attachment of Monophosphoryl Lipid A (MPL) to Cells and Liposomes Augments Antibody Response to membrane-bound Gangliosides," *Journal of Autoimmunity,* 7:803-16, 1994b.

Ravindranath et al., "Factors affecting the fine specificity and sensitivity of serum antiganglioside antibodies in ELISA," *J. Immunol. Methods,* 169:257-72, 1994c.

Real et al., "Class I (unique) tumor antigens of human melanoma. Identification of a 90,000 dalton cell surface glycoprotein by autologous antibody," *J. Exp. Med.,* 160:1219, 1984.

Reeves et al., *Cancer Res.,* 56:5672-77, 1996.

Reisfeld et al., *Melanoma Antigens and Antibodies,* p. 317, 1982.

Ribi, "Beneficial modification of the endotoxin molecule," *J. Biol. Resp. Mod.,* 3:1-9, 1984.

Ribi et al., "Lipid A and immunotherapy," *Rev. Infect. Dis.,* 6:567-72, 1984.

Ribi et al., "Modulation of humoral and cell mediated immune responses by a structurally established nontoxic lipid A," in *Immunobiology and Immunopharmacology of Bacterial Endotoxins,* Szentivanji and Friedman (eds.), Plenum Press, New York, pp. 407-420, 1986.

Rickman et al., *Lancet* 337:998, 1991.

Rolland, *Crit. Rev. Therap. Drug Carrier Systems,* 15:143-98, 1998.

Rosenberg et al., *Ann. Surg.,* 210:474, 1989.

Rosenberg et al., *N. Engl. J. Med.,* 319:1676, 1988.

Rosenfeld et al., *Science,* 252:431-34, 1991.

Rothbard and Taylor, *EMBO J.,* 7:93-100, 1988.

Rott et al., "Protection from experimental allergic encephalomyelitis by application of a bacterial superantigen," *Int. Immunol.,* 4:347-53, 1992.

Sato et al., "Cytoplasmic membrane-associated protein (CAP) isolated from *Streptococcus pyrogenes*: as a new bacterial superantigen," *Microbiol. Immunol.,* 38:139-47, 1994.

Sato et al., *Science,* 273:352, 1996.

Satoh et al., *Pathol. Int.,* 50:458-71, 2000.

Schuster et al., "Production of antibodies against phosphocholine, phosphatidylcholine, sphingomyelin, and lipid A by injection of liposomes containing lipid A," *J. Immunol.,* 122:900-05, 1979.

Schwab et al., "Superantigen can reactivate bacterial cell wall-induced arthritis," *J. Immunol,* 150:4151-59, 1993.

Shafer and Spitznagel, "Sensitivity of *Salmonella typhimurium* to polymorphonuclear granulocyte extracts: Role of lipid A," *Rev. Infect. Dis.,* 6:577-81, 1984.

Shepard et al., *J. Clin. Immunol.,* 11:117-27, 1991.

Sherwin et al., "The production of antisera to gangliosides from human nervous tissue," *Canad. J. Biochem.,* 42:1640-48, 1964.

Shimizu et al., *Int. J. Gynecol. Pathol.,* 19:158-63, 2000.

Shy et al., "Antibodies to $GM_1$ and $GD_{1b}$ in patients with motor neuron disease with plasma cell dyscrasia," *Ann. Neurol.,* 25:511-18, 1989.

Siddiqui et al., *Cancer Res.,* 44:5262-65, 1984.

Sidell et al., *Cancer Immunol Immunother,* 7:151-55, 1979.

Sigma Cell Culture, Volume 9, Number 2, 1993.

Skeiky et al., *Infection and Immun.,* 67:3998-4007, 1999.

Slavin and Strober, *Nature,* 272:624-26, 1977.

Spinsanti et al., *Leuk. Lymphoma,* 38:611-19, 2000.

Stiess and Krüger, "Mammalian Cell Culture Media—Overview and Applications," *The Source* (Sigma Cell Culture Technical and Product News), 9:1-8, 1993.

Stoute et al. *New Engl. J. Med.,* 336:86-91, 1997.

Svennerholm et al., "Tumor gangliosides as targets for active specific immunotherapy of melanoma in man," in *Biological Function of Gangliosides, Progress in Brain Research*, Vol. 101, 1994.

Tai et al., "Ganglioside GM2 as a human tumor antigen (OFA-I-1)," *Proc. Natl. Acad. Sci.,* 80:5392-96, 1983.

Takada et al., "Molecular and Structural Requirements of a Lipoteichoic Acid from *Enterococcus hirae* ATCC 9790 for Cytokine-Inducing, Antitumor, and Antigenic Activities," *Infection and Immunity,* 63:57-65, 1995.

Takahashi et al., *J. Immunol.,* 140:3244, 1988.

Tamaki et al., *Leukemia,* 13:393-99, 1999.

Tamauchi et al., *Immunology,* 50:605, 1983.

Tanamoto, "Dissociation of Endotoxic Activities in a Chemically Synthesized Lipid A Precursor after Acetylation," *Infection and Immunity,* 63:690-92, 1995.

Tanamoto, "Free Hydroxyl Groups Are Not Required for Endotoxic Activity of Lipid A," *Infection and Immunity,* 62:1705-09, 1994a.

Tanamoto, *FEBS Lett.,* 351:325-29, 1994b.

Tautu et al., "Improved procedure for determination of serum lipid-associated sialic acid: Application for early diagnosis of colorectal cancer," *J. Natl. Cancer Inst.,* 80:1333-37, 1988.

Thor et al., *Cancer Res.,* 46:3118, 1986.

Thurin et al., "Proton NMR and fast-atom bombardment mass spectrometry analysis of the melanoma-associated ganglioside 9-O-acetyl GD3," *J. Biol. Chem.,* 260:14556-563, 1985.

Timmerman and Levy, *Ann. Rev. Med.,* 50:507-29, 1999.

Tomai and Johnson, "T Cell and Interferon-γ Involvement in the Adjuvant Action of a Detoxified Endotoxin," *Journal of Biological Response Modifiers,* 8:625-43, 1989.

Tomai et al., "The Adjuvant Properties of a Nontoxic Monophosphoryl Lipid A in Hyporesponsive and Aging Mice," *Journal of Biological Response Modifiers,* 6:99-107, 1987.

Tsuchida et al., *J. Dermatol.,* 11:129-38, 1984.

Tsuchida et al., "Gangliosides of Human Melanoma: Altered Expression in Vivo and in Vitro," *Cancer Research,* 47:1278-81, 1987.

Tsuchida et al., "Gangliosides as tumor markers of human melanoma: biochemical and immunologic assays," in New Horizons of Tumor Immunotherapy, Torisu and Yoshida (eds.), pp. 315-325, 1989.

Tuting et al., *J. Immunol.,* 160:1139-47, 1998.

Ulmer et al., *Science,* 259:1745-49, 1993.

Vadhan-Raj et al., *J. Clin. Oncol.,* 6:1636, 1988.

van der Bruggen et al., "A gene encoding an antigen recognized by cytolytic T lymphocytes on a human melanoma," *Science,* 264:716, 1991.

Verma et al., "Adjuvant Effects of Liposomes Containing Lipid A: Enhancement of Liposomal Antigen Presentation and Recruitment of Macrophages," *Infection and Immunity,* 60:2438-44, 1992.

Vijayasaradhi et al., "The melanoma antigen gp75 is the human homologue of the mouse b (brown) locus gene product," *J. Exp. Med.,* 171:1375, 1990.

Von Bultzingslowen, *Pneumologie*, 53:266-75, 1999.
Vosika et al., *Cancer Immunol. Immunother.*, 18:107, 1984.
Watson, Ralph, Sarkar and Cohn, "Leukemia viruses associated with mouse myeloma cells," *Proc. Natl. Acad. Sci. USA*, 66:344, 1970.
Westrick et al., *Biochim. Biophys. Acta*, 750:141-48, 1983a
Westrick et al., *Cancer Res.*, 43:5890-94, 1983b
Whisler and Yates, "Regulation of lymphocyte responses by human gangliosides. I. Characteristics of inhibitory effects and the induction of impaired activation," *J. Immunol.*, 125:2106-12, 1980.
Wide et al., in *Radioimmunoassay Methods*, Kirkham and Hunter (eds.), E. and S. Livingstone, Edinburgh, 1970.
Wilschut, "Preparation and properties of phospholipid vesicles," in *Methodologie des liposomes appliquee a la pharmacologie et a la biologies cellulaire*, Leserman and Barbet (eds.), INSERM, Paris, pp. 1-10, 1982.
Yamaguchi et al., "Cell-surface antigens of melanoma recognized by human monoclonal antibodies," *Proc. Natl. Acad. Sci. USA*, 84:2416-20, 1987.
Yamamoto et al., "In vitro Augmentation of Natural Killer Cell Activity and Production of Interferon-α/β and -γ with Deoxyribonucleic Acid Fraction from *Mycobacterium bovis* BCG," *Jpn. J. Cancer Res.*, 79:866-73, 1988.
Yeh et al., "A cell-surface antigen which is present in the ganglioside fraction and shared by human melanomas," *Int. J. Cancer*, 29:269-75, 1982.
Yin et al., "Effect of Various Adjuvants on the Antibody Response of Mice to Pneumococcal Polysaccharides," *J. Biol. Resp. Modifiers*, 8:190-205, 1989.
Yokoyama et al., "Immunochemical studies with gangliosides," *J. Immunol.*, 90:372-80, 1963.
Zapata et al., *Protein Eng.*, 8:1057-62, 1995.
Zitvogel et al., *Nat. Med.*, 4:594-600, 1998.

All of the compositions and methods disclosed and claimed herein can be made and executed without undue experimentation in light of the present disclosure. While the compositions and methods of this invention have been described in terms of preferred embodiments, it will be apparent to those of skill in the art that variations may be applied to the composition, methods and in the steps or in the sequence of steps of the method described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims. All publications, patents, and patent applications cited herein are hereby incorporated by reference in their entirety for all purposes. Accordingly, the exclusive rights sought to be patented are as described in the claims below:

SEQUENCE LISTING (10979 sequences)

SEQ ID NO: 1 - DNA, 406 bp, Homo sapiens
ggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacag

SEQ ID NO: 2 - DNA, 330 bp, Homo sapiens
ccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggagg

SEQ ID NO: 3 - DNA, 113 bp, Homo sapiens
  misc_feature (1)...(113): n = g, a, c or t
ggncgaggtctgtggctgctgtgggacttccactgctcaggcgtcaggctcanatagctgctggccgnntacttgttgttgctttgtttggagggtgtggtggtctccactcc

SEQ ID NO: 4 - DNA, 269 bp, Homo sapiens
ccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagc

SEQ ID NO: 5 - DNA, 372 bp, Homo sapiens
  misc_feature (1)...(372): n = g, a, c or t
ccacgntgnccatcaacagggncgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcanatagcagccccgtcaaggcgggagtggagaccaccacaccctccaaacaaagcaacaacaagtacgcggccagcagctatctgagcctgacgcctgagcagtggaagtcccacanaactacag

SEQ ID NO: 6 - DNA, 373 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggcctcatcgccggcttcgaccctgttgatggtcagggtgg

SEQ ID NO: 7 - DNA, 484 bp, Homo sapiens
  misc_feature (1)...(484): n = g, a, c or t
ccttgcctcagatccaaggtcactcggaagaggccatgtctaccctcaatgacactcatggaggaaatgctgagagaagcattcagatgcatgacacaagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactggggtggtaccctctctggggaggcattatgtatattatttccggatcactcctggcagcaaccggaaaaaaaactccaggaagtgtttggtcaaaggaaaaaatgataatgaattcattggnccctctttgcttgccttttctggaaagaattcttttcaaatcatgggaccatact

SEQ ID NO: 8 - DNA, 457 bp, Homo sapiens
  misc_feature (1)...(457): n = g, a, c or t
cctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtaacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggcctcccctgaacgctacctcggcttgccaggatccctgaagtgggaggacagangtccaagtgggcaagggcanggggcagttcttgatacagcaggtgacccttgaa

SEQ ID NO: 9 - DNA, 364 bp, Homo sapiens
  misc_feature (1)...(364): n = g, a, c or t
ggcatcatactcctatngtnatgagaagccctctgccatccagcagcgagccattctaccttgtatcaagggttatgatgtgattgctcaagcccaatctgggactgggaaaacggccacatttgccatatcgattctgcancagattgaattagatctaaaagccacccaggccttggtcctagcacccactcgagaattggctcagcagatacagaaggtggtcatggcactaggagactacatgggcgcctcctgtcacgcctgtatccggggcaccaacgtgcngtgctgacgtgcataaactgcanatggaactccccacatcatcgtgggtacccctggccgngtgtnttgaaatgcn

SEQ ID NO: 10 - DNA, 382 bp, Homo sapiens
  misc_feature (1)...(382): n = g, a, c or t
tcaggacacagcatggacatgagggtccccgctcagctcctggggctcctgctgctctggctcccaggtgccaaatgtgacatccagatgacccaatctccttccaccctgtctgcatctgtcggagatacaagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgncaacattattctgcatctcttcgcagtttttggacctcg

SEQ ID NO: 11 - DNA, 292 bp, Homo sapiens
  misc_feature (1)...(292): n = g, a, c or t
ctgtggctgctgtgggacttccactgctcaggcgtcaggctcagatagctgctggccgcgtacttgttgttgctttgtttggagggtgtggtggnctccactcccgccttgacggggcttgctatctgccttccaggccactgtcacngctcccgggtagaagtcacttatgagacacaccagngtggccttgttggcttgaagctcctcanaggagggcgggaaacagaatgaccgagggggcagncttgggctgacctangacggccagtttgggtccctcccccaagac

SEQ ID NO: 12 - DNA, 465 bp, Homo sapiens
  misc_feature (1)...(465): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagacctgcccgggcggccaagggcgaattccagcacacttggcgccgttactatggatccnactcggtaccaacttggcgtaatcatggncata

SEQ ID NO: 13 - DNA, 206 bp, Homo sapiens
ccatggatatggctaggttaggtattcatatccaaatatctgaactctaacctaatgtggatatgattctgtagcattatattaaaagctatgatgatgcaatgcaggaaataacctttcattctcccccctagaggatcacgacaggtgcttcaatgcctgccttatctatgggacagtagtgtgattctcagtgagagtgaagg

SEQ ID NO: 14 - DNA, 378 bp, Homo sapiens
  misc_feature (1)...(378): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggcncagcagctatctgaagccttgacccctgagcaggtggaaagtcccacagaagctacag

SEQ ID NO: 15 - DNA, 170 bp, Homo sapiens
ccgccgcgggtccgtgcgcccagcgtcccagggcccaggccgagcagacaaagatcattccactcagcctgggacgatggggaggaaaaaaatccagatctcccgcatcctggaccaaaggaatcggcaggtgacgttcaccaagcggaagttcgggctgatgaagaagg

SEQ ID NO: 16 - DNA, 462 bp, Homo sapiens
  misc_feature (1)...(462): n = g, a, c or t
ccagtacacccatgaatttgatggagatgagcagttctacgtggacctggggaggaaggagactgtctggtgtttgcctgttctcagacaatttagatttgacccgcaatttgcactgacaaatatcgctgcctaaaacataacttgaacagtctgattaaacgctccaactctaccgctgctaccaatgaggntcctgaggtcacagtgttttccaagtctcccgtgacactgggtcagcccaacatcctcatctgtcttgtggacaacatctttcctcctgtggncaacatcacatggctgagcaatgggcactcagtcacagaangtgtttctgagaccagcttcctctccaagagtgatcattccttcttcaagatcagtacctcaccctcctcccttctggntgaggagagttatgactgcaaggnggancactggggactgggacaagcctcttct

SEQ ID NO: 17 - DNA, 207 bp, Homo sapiens
  misc_feature (1)...(207): n = g, a, c or t
ggcaagtcctgggctggcttacctgggcaccgtgggcatgggggaggtgtgtcacaagatttgggctctgcagagagaagattgggagttacggggatctgggatggaggtggatgcgtcagcaccctgctggggcctgtccctggactcgggccactctagggctcttgtcccgccttgagctggagggcgaggacctcngccgcn

SEQ ID NO: 18 - DNA, 294 bp, Homo sapiens
ccatgtccccagaattgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggctgaggcaccaccagtgctgcttcctt

SEQ ID NO: 19 - DNA, 197 bp, Homo sapiens
  misc_feature (1)...(197): n = g, a, c or t
caagccngcgatgaggccgactattactgtcaagngtgggatcgtaataatgaccatgtcgtcttcggcggagggaccaaactggccntcctangtcancccaacgctgccccctcagncactctgttcccgccctcctctgaggagcttcaagccaacaangccacactngtgtgtctcataantgacttctaccc

SEQ ID NO: 20 - DNA, 387 bp, Homo sapiens
aaatttctcaaataactaagtcttcactaaggcagcagttcaaaactgttccaggaattaaaatatattcccatttgaggagtcttccttcacaccttcacctcctcagccttaagtatatacacacacacccaacaccctcaatacttgactagcaacaggctttaccatctttacctgacaatgaccccagggcggagatcgaaattcttcttcacaatctctaatagctctctctcactcttctgagaggtaccataatggaaaatggagatagataatggatgagaaactccaatagcataagagacctgaacaagaaccctccggcacagacctcctttaacaagggattttgccacccaacgagcagcataagcagacctg

SEQ ID NO: 21 - DNA, 290 bp, Homo sapiens
  misc_feature (1)...(290): n = g, a, c or t
aagcagcactggtggtgcctcagccatggcctggaccgttctcctcctcggcctcctctctcactgcacagactctgtgacctcctatgtgttgactcagacaccctcagtgtcagtggccccangaaagacggccaagattacctgtgggggaaacaatattgggagttacagtgtacactggtattaccaaaagccaggccaggcccctgtcctaatcatctcttttgatgacnaccggccctcanggatatctgagcgattctctgggcttcaattctgggggacat

SEQ ID NO: 22 - DNA, 148 bp, Homo sapiens
  misc_feature (1)...(148): n = g, a, c or t
ctgtagcttctgtgggacttccactgctcaggcgtcaggctcaganagctgctggccgcgtacttgttgttgctttgtttggagggtgtggtggtctccactcccgccttgacggggctgctatctgccttncangccactgtcacgg

SEQ ID NO: 23 - DNA, 265 bp, Homo sapiens
  misc_feature (1)...(265): n = g, a, c or t
ctgtagcttctgtgggacttccactgctcaggcgtcaggctcagatagctgctggccgcgtacttgttgttgctttgtttggagggtgtggnggtctccactcccgccttgacggggctgctatctgccttccaggccactgtcacggctcccgggtagaagtcacttatgagacacaccagtgtggccttgttggcttgaagctcctcacaggagggcgggaacagagtgaccgagggggcagccttgggctgacctaggacgg

SEQ ID NO: 24 - DNA, 377 bp, Homo sapiens
aggtccaccctgaccatcaacagggtcgaagccggcgatgaggccgactattactgtcaagtgtgggatcgtaataatgaccatgtcgtcttcggcggagggaccaaactggccgtcctaagtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacccctgagcattggaagtcccacaaaagctacag

SEQ ID NO: 25 - DNA, 323 bp, Homo sapiens
cctgggaggaacctgctcagtctgggcctaaggaagcagcactggtggtgcctcagccatggcctggaccgttctcctcctcggcctcctctctcactgcacagactctgtgacctcctatgtgttgactcagacaccctcagtgtcagtggccccaggaaagacggccaagattacctgtgggggaaacaatattgggagtaacaatgtacactggtattaccagaagccaggccaggcccctgtcctaatcatctcttttgataacgaccggccctcagggatatctgagcgattctctggcttcaattctggggacatgg

SEQ ID NO: 26 - DNA, 433 bp, Homo sapiens
  misc_feature (1)...(433): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgannctgacgcctgagcagtggaagtcccacagaagctacagcctgggcttggcttaccttgggcacccgtggggcaatgggggaangtgtgtcacaaaaat

SEQ ID NO: 27 - DNA, 419 bp, Homo sapiens
  misc_feature (1)...(419): n = g, a, c or t
ngcggccnaggtccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcanatgtcggtgttgggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaanggcaccccaacacctcatcatatactgagggcaggggctccccaggtggacaccaggactctgacccccttgcccctc

SEQ ID NO: 28 - DNA, 201 bp, Homo sapiens
  misc_feature (1)...(201): n = g, a, c or t
gctgccccctcggtcactctgttcccgccctcctctgaggagcttcaagccaacaaggccacactggtgtgtctcataagtgacttctacccgggagccgtgacagtggcctggaangcagatagcacccccntcaaggcgggagtggagaccaccacaccctncaaacaaagcaacaacaagtacccggccagcagctat

SEQ ID NO: 29 - DNA, 292 bp, Homo sapiens
ccatgtccccagaattgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggctgaggcaccaccagtgctgcttcc

SEQ ID NO: 30 - DNA, 417 bp, Homo sapiens
  misc_feature (1)...(417): n = g, a, c or t
ngtccttgnctnagatccaaggtcactcggaagaggccatgtctaccctcaatgacactcatggaggaaatgctgagagaagcattcagatgcatgacacaaggtaagactgccaaaaaatcttgttcttgctctcctcattttgttatttgttttatttttangagttttgagagcaaaatgacaacacccagaaattcagtaaatgggactttcccggcagagccaatgaaaggncctattgctatgcaatctggtccaaaaccactcttcaggaggatgtcttcactggtgggccccacgcaaagcttcttcatgagggaatctaagactttgggggctgtccagattatgaatgggctcttccacattgccctggggggncttctgatgatcccancagggatntatgccccc

SEQ ID NO: 31 - DNA, 454 bp, Homo sapiens
  misc_feature (1)...(454): n = g, a, c or t
ctgtagcttttgtgggacttccactgctcaggcgtcaggctcaggtagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcanaggagggcgggaacagagtgaccgagggggcagccttgggctgacctgcggggtggatgaggggcagggggtcaaagtcctggtgtccacctggggagcccctgacctcagtatatgatgaggtgttggggtgcccttgttcaggggctctgtgtctgaaggtctatgccaggcagaggggtnanggtgttttcactatgccctgatttgcccgggagctgcttaccttagaccctgacancn

SEQ ID NO: 32 - DNA, 482 bp, Homo sapiens
aaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatgggctatggaaagggtgactgtgcctggggacaaagcgaggtcccaaggggacagcctgaactccctgctcatagtagtgg

SEQ ID NO: 33 - DNA, 383 bp, Homo sapiens
  misc_feature (1)...(383): n = g, a, c or t
ngtccaccctgaccatcaacagggncgaagccggcgatgaggccgactattactgtcaagtgtgggatcgtaataatgaccatgtcgtcttcggcggagggaccaaactggccgtcctaggtcagccccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaancaacaacaagtacncggccagcagctatctgagcctgacgcctgagcagtggaagtnccacataagctacanacctcn

SEQ ID NO: 34 - DNA, 246 bp, Homo sapiens
aaatctttagagataccataaatcaacatttaatctttgtaacacatctgaaggaatattcttgaaatagcgtgatgatggtctttaaggattctagaaagggagtgatgagtcagaatttgccagaatgtcccagcatagtcaggagaaagagaacctctctggtcgatgtacatgttctaatcccatggagattagggcaccagactatgagatttggtaacatttgctatcaagatgaaccag

SEQ ID NO: 35 - DNA, 309 bp, Homo sapiens
  misc_feature (1)...(309): n = g, a, c or t
gcgcggtcgangtggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggagagacacagagctctctttatctgtcaggatggcaggaggggacagggtcagggcactgagggtcanatgtcggtgtggggggccaaggccccgagagatctcaggacangtggncatgtgtctaangtaaaanagcttccccgtgc

SEQ ID NO: 36 - DNA, 363 bp, Homo sapiens
  misc_feature (1)...(363): n = g, a, c or t
atggacatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatnaccaggtctgcagcctgacgattcancaacttattattgtnaacattattctgcatctnttnncagttttgg

SEQ ID NO: 37 - DNA, 416 bp, Homo sapiens
  misc_feature (1)...(416): n = g, a, c or t
ccagtacacccatgaatttgatggagatgagcagttctacgtggacctggggaggaaggagactgcctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggncaacatcacatggctgagcaatgggcactcagtcacanaangtgtttctgagaccagcttcctctccaagagtgatcattncttcttcaanatcagntaccccaccctcctcccttcttctgaggaga

SEQ ID NO: 38 - DNA, 253 bp, Homo sapiens
  misc_feature (1)...(253): n = g, a, c or t
gtctgtagcttctgtgggacttccactgctcaggcgtcaggctcagatagctgctggccgcgtacttgttgttgctttgtttggagggtgtggtggnctccactcccgccttgacggggntgctatctgncttccaggccactgtcacggctcccgggtagaagtcacttatgagacacaccagtgtggccttgttggcttgaanctcctcatangagggcgggaacagagtgaccganggggcagccttggg

SEQ ID NO: 39 - DNA, 178 bp, Homo sapiens
  misc_feature (1)...(178): n = g, a, c or t
gcccnggnaggtccaaatgtctgagacaccttcaaatgggcccagtgccagccaactgggctcctcactggcaccacgtcccagatgcccttctctgcccacaccctgcaggctgaggccagaggaggncacccctccggagatggggnatgtgngtgtgtgtgngtatgttctgcgn

SEQ ID NO: 40 - DNA, 156 bp, Homo sapiens
  misc_feature (1)...(156): n = g, a, c or t
ccaaaagaagtaagacagcttgctgaagatttcctgaaagactatattcatataaacattggtgcacttgaactgantgcaaaccacaacattcttcanantgtggatgtgtgtcatgacntanaaaaggatgaaaaacttattcgtctaatggaa

SEQ ID NO: 41 - DNA, 287 bp, Homo sapiens
  misc_feature (1)...(287): n = g, a, c or t
ccatgtccccagaattgaagccagagaatcgctcagatatccctgagggccggtcgttatcaaaagagatgattaggacaggggcctggcctggcttctggtaataccagngtacattgttactcccaatattgtttcccccacaggtaatcttggccgcctttcctggggccactgacactgagggtgtctgagtcaacacataggaggncacagagtntgtgcagtgagagaggaggccgaagaggagaacggcccangccatggctgangcnccaccagtgctg

SEQ ID NO: 42 - DNA, 272 bp, Homo sapiens
gtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttgg

SEQ ID NO: 43 - DNA, 533 bp, Homo sapiens
  misc_feature (1)...(533): n = g, a, c or t
cttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgagtccatcctaaggtgactgtgtatccttcaaagacccacccctgcagcaccacaacctcctggtctgttctgngagtggtttctatccaggcagcattgaatcangtggttccggaatggn

SEQ ID NO: 44 - DNA, 332 bp, Homo sapiens
tcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccagg

SEQ ID NO: 45 - DNA, 391 bp, Homo sapiens
  misc_feature (1)...(391): n = g, a, c or t
ctgtngctnctgtgggacttccactgctcaggcgtcaggctcanatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagncttgggctgacttaggacggccagtatggtccctccgccgaagacgacatggttattattacnatcccncacttgacagtaatagtcngccttcatcgccggcttctgacccttttgatggtncagggngggacctttggcccgcn

SEQ ID NO: 46 - DNA, 478 bp, Homo sapiens
  misc_feature (1)...(478): n = g, a, c or t
ccaccctgaccatcaacagggtcgaagccggcgatgaggccgactattactgtcaagtgtgggatcttaataatgaccatgtcgtcttcggcggaggaaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggngggagtggagaccaccacaccctncaaacaaagcaacaacaagtacgcggccagcagctatctnagcctgacgcctgagcagtggaagtcccacagaanctacagacctgcccgggcggncaanggcgaattccagcacactggggggcgttactagtggatncgagctcggtaccaagcttggcgnaatcatggncatagctggtttcc

SEQ ID NO: 47 - DNA, 244 bp, Homo sapiens
  misc_feature (1)...(244): n = g, a, c or t
ccacggtnnccntcaacaggggcgaagccggcgatgaggccgactattactgtcaagtgtgggatcttaataatgaccatgtcgtcttcggcggagggaccaaactggncgtcctaggtcagcccaaggctgccccctcggtcactctgttcccgccctcctctgaggagcttcaagccaacaaggccacactggtgtgtctcataagtgacttntacccgngagccgtgacagtggcctggaa

SEQ ID NO: 48 - DNA, 343 bp, Homo sapiens
  misc_feature (1)...(343): n = g, a, c or t
cccggcaggnaaatgccactgctgnggacaaaaaactgaatgaantctattagaagcttctgaaaaatgttaaatgttaaatcctgctatggtctgatnagaanaactcaagacttagaattagatattttcttccttcgaattatgtattagattatctccctacatattttctcccagccataagtaactgagttatgctggaaaaaaaaacacanaaatcttaagatctctttttctactggtgaaattgggggtttgataataatttttagagaaaaatctanaattctctgtgtatagctggtcaacncataaaccangtaaattttgattttcttgg

SEQ ID NO: 49 - DNA, 373 bp, Homo sapiens
  misc_feature (1)...(373): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttntacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacag

SEQ ID NO: 50 - DNA, 375 bp, Homo sapiens
ccaaaactgcgaagagatgcagaataatgttgacaataataagttgctgaatcgtcaggctgcagactggtgatggttaaattgaattgtgtcccagatccactgccagtaaatcttaatgagaccccttcttctaaactggaagtcgcataaattaggacattaggggctttgcctggtttctgttgatgccaggccaaccaccgatctatattctgagaggcccgacaacttattgtaactgtatctccgacagatgcagacagggtggaaggagattgggtcatctggatgtcacatttggcacctgggagccagagcagcaggagccccaggagctgagcggggaccctcatgtccatgctgtgtcctgac

SEQ ID NO: 51 - DNA, 347 bp, Homo sapiens
  misc_feature (1)...(347): n = g, a, c or t
ccaccctgaccatcaatagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggnagatagcagccccgtcaaggcgggagtggagaccaccacaccctccaaacaaagcaacaacaagtaccgcgggcagcagctatctgagcctgacgcctga

SEQ ID NO: 52 - DNA, 449 bp, Homo sapiens
  misc_feature (1)...(449): n = g, a, c or t
aaaattgatcacaacnagggaaaacaaaataaaattagggggcaaagggtaggagtatggggggaggggagagcaaacctatcgaatatatcttagaattttgctcagaaatcactgctgcctctcaagtgttgcattgtccctgcctaaaccaagaaggctaaacaaagcccctcctgtttgaattcttaaggtaagaaatttctaagctaagaaaacactattgcctaaaaccaatgatagtggagctcatttacaaataggcatgcctcacacacacagtccaaaggcaagacactggctttgaaattaggctcatgatgtgattcctattatatgtacctgatttttttaggccccaggtatgtggaccagagttaatgtcatgactcttcaaagatatgatgaaaagttgccctagaaatctagagatgcatgtttatttaatt

SEQ ID NO: 53 - DNA, 199 bp, Homo sapiens
  misc_feature (1)...(199): n = g, a, c or t
ccaccctgaccatcaacagggtcgaagccggcgatggggccgactattattgtcaagtgtgggatcgtaataatgaccatgtcgtcttcggcggagggaccaaactggccgtcctaagtcagcccaaggctgccccctcggncactctgttcccgccctnctctgangagcttnaagccaacaaggncacactggtgtg

SEQ ID NO: 54 - DNA, 79 bp, Homo sapiens
  misc_feature (1)...(79): n = g, a, c or t
ctgtagcttctgtncgacttccactgctcaggcgtcaggctcanatagctgctggccgcgtacttgttgttgctttgtt

SEQ ID NO: 55 - DNA, 93 bp, Homo sapiens
  misc_feature (1)...(93): n = g, a, c or t
ctgtagcttttgtnggncttccactgctcaggcgtcaggctcaggtagctgctggccgnntacttgttgntnctttgnttggagggtgtggtg

SEQ ID NO: 56 - DNA, 426 bp, Homo sapiens
  misc_feature (1)...(426): n = g, a, c or t
gtgaaccanctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagnncgtgctccanacccaaatctaacatagttctcctgtcagnagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttncagaacctccccaagatcaggaatcctcaccaatagaaaatgacagctctcctnaagtgatttcttctgntttctgnntcctttttt

SEQ ID NO: 57 - DNA, 232 bp, Homo sapiens
gctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtgg

SEQ ID NO: 58 - DNA, 191 bp, Homo sapiens
  misc_feature (1)...(191): n = g, a, c or t
ccttgcctcagatccaanntcactcgnaagaggccatgtctaccctnaatgacactcatggaggaaatgctgagagaagcattcanatgcatgacacaaggtaagactgccaaaaatcttgttcttgctctcctcattttgttatttgttttatttttaggagttttgagagcaaaatgacaacacccaga

SEQ ID NO: 59 - DNA, 259 bp, Homo sapiens
  misc_feature (1)...(259): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttncaggccactgtcacggntnccgggtagaagtcacttatgagacacaccagtgtggncttgttggcttgaagctcntnanaggagggcgggaacanagtgaccgagggggcagccttgggctgaccta

SEQ ID NO: 60 - DNA, 410 bp, Homo sapiens
cctggtcaaatgtcacctccactgggaagccctccttgatctcccaggctgttaggggcctgccccaggttcctgcagactccctgcttctctccatcacaaacctgagcagtgtggggctgtcattatcatgtgtgaggttttagtaccaggaagtggggtactaccatagcaaatacccaaaaatggggaaatggcttggggaatggaaagaattggacaatgagcacttgatagaaaaagcctagattgccctgaagaggtggtcagtagaaatatggatgttaaaggtgcccctgctgaggtcctaggaggaaatgagggacatgacattggacgtgaagatggaggtggggactgcagtgatgcatccacagatctgggagaccaggatgctgcagccatcacag

SEQ ID NO: 61 - DNA, 361 bp, Homo sapiens
  misc_feature (1)...(361): n = g, a, c or t
cttctgtgnnacttccactgctcacgcgtnaggctcagatagctgctggccgcgtacttgttgttgctttgnttggagggtgtggtggtctccacccccgccttgacggggctgctatctgccttccaggccactgtcacggctcccgggtagaagtcacttatgagacacaccagtgtggccttgttggcttgaagctcctcanaggagggcgggaacagagtgaccgagggggcagccttgggctgacctaggacggccagtttggtccctccgccgaanacgacatggtcattattacgatcccacacttgacagtaatagtcggcctcatcgccggcttcgaccctgttgatggtca

SEQ ID NO: 62 - DNA, 368 bp, Homo sapiens
  misc_feature (1)...(368): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcanaggagggcgggaacagagtgaccgagggggcanccttgggctgacctaggacggccagtttggtccctccgccgaagacgacatggtcattattacgatcccacacttnacagttnatagtcngcctcatngccggnttcgaccctgttgatggtca

SEQ ID NO: 63 - DNA, 383 bp, Homo sapiens
  misc_feature (1)...(383): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctangacggccagtttggtccctccgccgaagacgacatggtcattattacgatcccacacttgacagtaatagtcggcctcatcgccggcttcgaccctgttgatggtcagggtggacctcggccg

SEQ ID NO: 64 - DNA, 373 bp, Homo sapiens; identical to SEQ ID NO: 6

SEQ ID NO: 65 - DNA, 334 bp, Homo sapiens
  misc_feature (1)...(334): n = g, a, c or t
ctgtagcttctgtgggacttccactgctcgggcgtcaggctcaggtagctgctggccgcgtacttgttgttgctctgtttggagggtttggtggtctccactcccgccttgacggggctgccatctgccttccaggccactgtcacagctcccgggtagaagtcacttatgagacacaccagngtggccttnntggcttgaanctcctcanaggagggcgggaacanngtgaccnagggggcanncttgggctgacctaggacggccagtttggtccctccgccgaagacgacatggtcattattacgatccnacacttgacagtaatagtcgg

SEQ ID NO: 66 - DNA, 377 bp, Homo sapiens
  misc_feature (1)...(377): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggnctcatcgtcggcttcgaccctgttgatggtcagggtggacct

SEQ ID NO: 67 - DNA, 392 bp, Homo sapiens
  misc_feature (1)...(392): n = g, a, c or t
ngtcttgcctgctgctctggcccctggtcctgtcctgttctccagcatggtgtgtctgaggctccctggaggctcctgcatggcagttctgacagtgacactgatggtgctgagctccccacttgctttgggctggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacngagctggggcgggctgatgaggagtactggaacagccannaaggacttcctggaanacaggcgggncgcggtggacacctactgcanacacaactacggggttgg

SEQ ID NO: 68 - DNA, 446 bp, Homo sapiens
  misc_feature (1)...(446): n = g, a, c or t
naaaaatggagagtctgaattttattagagctcacacaccatatattaacatatacaactgtgaaccacctaatccctctgagaaaaactccccatctacccaatactgntacagcatacaatctctgttcttgggcattttgtcagtgatgctgatctttgccttcttccaggaacttgtaatanctggcatcgttgacaatgaatggaaaagaacgtgctccagacccaaatctaacatagttctcctgtcagcagaagaaaaaaaagaacanactattgaaataaaagaagaagtggttgggctaactgaaacatcttcccaaccaaagaatgaagaanacattgaaattattccaatncaagaagaggaagaagaaagaaacnggagacgaactttccagaacctnccaagatcaggaatcctcaccaatagaaaatgacag

SEQ ID NO: 69 - DNA, 180 bp, Homo sapiens
  misc_feature (1)...(180): n = g, a, c or t
ctgctgccacagccagtattgccggggctccaacccagtacccacctggccgtgggggtcctcccccacctatgggccgaagaacaccccctccaggcatgatgggcccacctcccnggtttganacctcctatgggtgcccccaatgggggatcccccntggaagangactccaatggg

SEQ ID NO: 70 - DNA, 113 bp, Homo sapiens
  misc_feature (1)...(113): n = g, a, c or t
nccatgtccccagaattgaagccagagaatcgctcanatatccctgagggccggtcgttatcaaaagagatgattaggacaggggcctggcctggcttctggtaataccaacg

SEQ ID NO: 71 - DNA, 117 bp, Homo sapiens
  misc_feature (1)...(117): n = g, a, c or t
ngtaaattcctgtaataaaagggaaattgagggcagagcaatcaggctggagttgcaaggacccaggggatcacctaatgccagaagccagccatccaaaactctgtttgtcaaagg

SEQ ID NO: 72 - DNA, 247 bp, Homo sapiens
ccactgcaacagtgagtcaaactctcctcgcatgaccacaaagtatagggacaggtgtgaccccctccctgacccatccccattcaggtatgctctagcacagagccggtagccacagcgggttggtgtagaaggactggctgaagatggacactgtgtgcccatccaccgcctctctcttcttcatcttgtaatctgtcaccttccaaatgagccttccattatagcaagtaccctccagcagttt

SEQ ID NO: 73 - DNA, 373 bp, Homo sapiens; identical to SEQ ID NO: 6

SEQ ID NO: 74 - DNA, 371 bp, Homo sapiens
ggacacagcatggacatgagggtccccgctcagctcctggggctcctgctgctctggctcccaggtgccaaatgtgacatccagatgacccaatctccttccaccctgtctgcatctgccggaaatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 75 - DNA, 293 bp, Homo sapiens
ggaagcagcactggtggtgcctcagccatggcctggaccgttctcctcctcggcctcctctctcactgcacagactctgtgacctcctatgtgttgactcagacaccctcagtgtcagtggccccaggaaaagacggccaagattacctgtgggggaaacaatattgggagtaacaatgtacactggtattaccagaagccaggccaggcccctgtcctaatcatctcttttgataacgaccggccctcagggatatctgagcgattctctggcttcaattctggggacatgg

SEQ ID NO: 76 - DNA, 209 bp, Homo sapiens
aagcagcactggtggtgcctcagccatggcctggaccgttctcctcctcggcctcctctctcactgcacaggtgatccccccagggtctcaccaacctgcccagcccaaggcttctgggtccagcgtgtccttaattctgagctcaggagggcccttcctgtggtgggcaggatgctcatgaccctggtgcaaggtgggaaggttgggg

SEQ ID NO: 77 - DNA, 396 bp, Homo sapiens
  misc_feature (1)...(396): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagcgtggccttgttggcttgaaactcctcanangaaggcgggaaacagaangaccgaggggcanccttgggctgactaggacggcagtttggtcctccgccaaacacatggcattattacgatccacacttgacagtaatagtcngctcatcgncggcttcaccctgtgatggtcagggtggactcggccccgacacctaagggcgaatccancac

SEQ ID NO: 78 - DNA, 202 bp, Homo sapiens
  misc_feature (1)...(202): n = g, a, c or t
cctcggatgatgaagacagtgcccaccacaatgcccacgaggcccacagacaaccccagggcgcagaccacagtctctgtgagctctgacataggggctggaatctcaggctcccagtgtttcagaagaggcttgtccagtccccagtgctccaccttgcagtcatanctctcctcanctgaagggaggagggtgaggnaac

SEQ ID NO: 79 - DNA, 356 bp, Homo sapiens
  misc_feature (1)...(356): n = g, a, c or t
ccaaaactgcgaagagatgcagaataatgttgacaataataagttgctgaatcgtcaggctgcagactggtgatggttaaattgaattgtgtcccagatccactgccagtaaatcttaatgagaccccttcttctaaactggaagtcgcataaattaggacattaggggctttgcctggtttctgttgatgccaggccaaccaccgatctatattctgagaggccccgacaacttattgtaactggtatctccgacagatgcagacagggtggaaggagattgggtcatctggatgtcacatttggcacctgggagccagagcagcaggagccccangagctgagcggggaccctc

SEQ ID NO: 80 - DNA, 149 bp, Homo sapiens
  misc_feature (1)...(149): n = g, a, c or t
ccagnacncccatgaanttgatgganatgagcacttntacgtggacctggggaggaaggagactgtctggtgtttgcctgttctcatacaatttagatttgacccgcaatttgncctgacaaacactggctgttctaaaacataacttg

SEQ ID NO: 81 - DNA, 292 bp, Homo sapiens
  misc_feature (1)...(292): n = g, a, c or t
ggaagcagcactggtggtgcctcagccatggcctggaccgttctcctcctcggcctcctctctcactgcacagattctgtgacttcctatgtgttgactcagacaccctcagtgtcagtggccccaggaaagacggccaagattacctgtgggggaaacaatattgggagtcacaatgtacactggtattaccagaagccaggccaggcccctgtcctaatcatctcttttgataacgaccggncctcanggatatctgagcgattctctggcttcaattctggggacatgg

SEQ ID NO: 82 - DNA, 284 bp, Homo sapiens
  misc_feature (1)...(284): n = g, a, c or t
aatgaaaaggccctattgctatgcaatctggtccaaaaccactcttcaggaaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctgcancaacggaaaaaactccaggaagt

SEQ ID NO: 83 - DNA, 374 bp, Homo sapiens
cctaggcatgacaatcggaggactcgagggggatggaggactagtgatcggctggctgcttccagtcgattagagaggtgaaaaagctgaacgtgtgccagtaatcttcaaaaggcagaacatatcacctctgccccgtaaactgttctctccgagggaaaaaatggaagttatcctcacagttcactgccgtggtatttcttcttgtcccatcttttgcatgacttgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagcttt

SEQ ID NO: 84 - DNA, 357 bp, Homo sapiens
catgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 85 - DNA, 372 bp, Homo sapiens
ccaccctgaccatcaacaggatcgaagccggcgatgaggccgactattactgtcaagtgtgggatcttaataatgaccatgtcgtcttcggcggaggaaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggcagcagctatctgagcctgacgcctgagcagtggaagtcccacagaagctacag

SEQ ID NO: 86 - DNA, 111 bp, Homo sapiens
  misc_feature (1)...(111): n = g, a, c or t
cgaagtcctgggaggaacctgctcantctgggcctaangaancagcactggtggtgcctnanccatngactggaccgttctnactcctcngncttctctttcactncacan

SEQ ID NO: 87 - DNA, 357 bp, Homo sapiens
  misc_feature (1)...(357): n = g, a, c or t
ccaccctgaccatcaacagggtcgaagccggcgatgaggccgactattactgtcaagtgtgggatcttaataatgaccatgtcgtcttcggcggaggaaccaaactggccgtcctaggtcagcccaaggctgccccctcggtcactctgttcccgccctcctctgaggagcttcaagccaacaaggccacactggtgtgtctcataagtgacttctacccgggagccgtnacagtggcctggaaggcagatagcagccccgtcaaggcgggagtggagaccaccacaccctncaaacaaagcaacaacaagtacgcggccagcagctatctgagcctgacgcctgagcagtggaagt

SEQ ID NO: 88 - DNA, 308 bp, Homo sapiens
ctcagtctgggcctaaggaagcagcactggtggtgcctcagccatggcctggaccgttctcctcctcggcctcctctctcactgcacagactctgtgacctcctatgtgttgactcagacaccctcagtgtcagtggccccaggaaagacggccaagattacctgtgggggaaacaatattgggagtaacaatgtacactggtattaccagaagccaggccaggcccctgtcctaatcatctcttttgataacgaccggccctcagggatatctgagcgattctctggcttcaattctggggacatgg

SEQ ID NO: 89 - DNA, 206 bp, Homo sapiens
  misc_feature (1)...(206): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggnnactctgttcccgccctcctctgaggagcttcaagccaacaaggccacactggtgtgtctcata

SEQ ID NO: 90 - DNA, 373 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattatgatcccacacttgacagtaatagtcggcctcatccccggcttcgaccctgttgatggtcagggtgg

SEQ ID NO: 91 - DNA, 347 bp, Homo sapiens
cccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaacctggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 92 - DNA, 421 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggcctcatcgccggcttcgaccctgttgatggtcagggtggccatgtccccagaattgaagccaggccaggcccctgtcctaatcatct

SEQ ID NO: 93 - DNA, 324 bp, Homo sapiens
  misc_feature (1)...(324): n = g, a, c or t
ctgtagcttctgtggnacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccanngnggccttgntggcttgaagctcctnagaggagggcgggaacagagtgaccgagggggcagccttgggctgacctaggacggccagtttggtccctncgccnaanacgacntggtcattattacngatcccacacttgaca

SEQ ID NO: 94 - DNA, 150 bp, Homo sapiens
  misc_feature (1)...(150): n = g, a, c or t
ctgtagcttctgtggnncttccactgctcangcgtcaggctcagatagctgctggccgcgtacttgttgttgctttgtttgnagggtgtgnnggtctccactcccgnnttgacggggctgctatctgccttccaggccactgtcacggct

SEQ ID NO: 95 - DNA, 167 bp, Homo sapiens
  misc_feature (1)...(167): n = g, a, c or t
ctgtagcttctgcnggacttccactgctcaggcgtcaggctcagatagctgctggccgcgtacttgttgntgctttgtttggagggtgtggtggnctccactcccgncttgacggggctgnnatctgccttccaggccactgtcacggntcccggntagaagtcact

SEQ ID NO: 96 - DNA, 307 bp, Homo sapiens
  misc_feature (1)...(307): n = g, a, c or t
ctgtagcttctgtgggncttccactgctcaggcgtcaggctcagatagctgctggccgcgtacttgttgttgctttgtttggagggtgtggtggtctccactcccgccttgacggggctgctatctgccttccangccactgtcacggctcccgggtagaagtcacttatgagacacaccagtgtggccttgttggcttgaagctcctcanagganggcggnaacagagtgaccganggggcanccttgggctgacctangacggccagttnggtccctccgccgaanacgacatggtcattattac

SEQ ID NO: 97 - DNA, 571 bp, Homo sapiens
  misc_feature (1)...(571): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctcaatctgggtctggatcctggctctgggtcccagctctgtgattcccgagcatcagccccgagggcactgggtccttctaaagtctcccangaggtgcctccctcagaccccttgttcccaattccccaggagatggaacccacgtaacccaagggtaaacctgttccgacaagaacccagactgagggggccagaacagaacaaggcttanagacccagtctgcgcctgtcagacacacaaagagacaaacagagagagagagacagacagacagacngacagacgaggctcagtaggtcattctatctagt

SEQ ID NO: 98 - DNA, 337 bp, Homo sapiens
  misc_feature (1)...(337): n = g, a, c or t
ctgtagcttctgtgggncttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacnatcccacacttnacagtaatagtcggcct

SEQ ID NO: 99 - DNA, 342 bp, Homo sapiens
  misc_feature (1)...(342): n = g, a, c or t
ccaccctgaccatcaacagggtcgaagccggcgatgaggccgactattactgtcaagtgtgggatcgtaataatgaccatgtcgtcttcggcggannaaccaaactggccgnnctaggtcagcccaannctgccccctnggtnactcatgntcnngccctcctctgaggagcttcaagccaacaaggccacactggtgtgtctcataantgacttctacccgggagccgtgacagtggcctggaaggcanatagcanccccgtcaaggcggnagtgganaccacnacancctccaaacaaagcaacaacaagtacgcggncagnagctatctgagtcctgac

SEQ ID NO: 100 - DNA, 366 bp, Homo sapiens
  misc_feature (1)...(366): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagttttggtccctccgtcgaagacnacatggtcattattacgatcccacacttgacagtaatagncggnctcatcgccggcttcnaccctgttgatggt

SEQ ID NO: 101 - DNA, 131 bp, Homo sapiens
  misc_feature (1)...(131): n = g, a, c or t
ctgtagcttctgtgggncttccactgctcangcgtcaggctcagatagctgctggccgcgtacttgttgttgctttgtttggagggtgtggnggtctccactcccgccttgacggggctgctatctgcctt

SEQ ID NO: 102 - DNA, 330 bp, Homo sapiens
  misc_feature (1)...(330): n = g, a, c or t
ctgtagcttctgtggnacttccactgctcaggcgtnaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacanagtgaccgagggggcanncttgngctgacctangacggccagtttggtccctccgccgaagacgacatggtcattattacgatcccacacttgacagtaatag

SEQ ID NO: 103 - DNA, 369 bp, Homo sapiens
  misc_feature (1)...(369): n = g, a, c or t
cttctgtgggacttccactgctcaggcgtnaggctcanatagctgctggccgcgtacttgttgttgctttnnttggagggtgtggtggtcnncactcccgccttgacggggctgctatctgccttccaggccactgtcacggctcccgggtagaagtcacttatgagacacaccantgtggccttgttggcttgaagctcctcanaggagggcgggaacagagtgaccgagggggcagccttgggctgacctaggacggccagtttggtccctccgccgaagacgacatggtcattattacgatcccacacttgacagtaatagtcggcctcatcgccggcttcgaccctgttgatggtcagggtggcc

SEQ ID NO: 104 - DNA, 254 bp, Homo sapiens
  misc_feature (1)...(254): n = g, a, c or t
ccaccctgaccatcaacagggtcgaagccggcgatgaggccgactattactgtcaagtgtgggatcgtaataatgaccatgtcntcttcngnggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagc

SEQ ID NO: 105 - DNA, 366 bp, Homo sapiens
  misc_feature (1)...(366): n = g, a, c or t
caggacacagcatggacatgagggtccccgctcagctcctggggctcctgctgctctggctcccaggtgccaaatgtgacatccagatgacccaatctccttccaccctgtctgcatctgtcggagatacagttacaataagttgncgggcctctcanaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattntgcatctcttngca

SEQ ID NO: 106 - DNA, 485 bp, Homo sapiens
  misc_feature (1)...(485): n = g, a, c or t
aaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcggcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgnttcctttttt

SEQ ID NO: 107 - DNA, 373 bp, Homo sapiens
ccaccctgaccatcaacagggtcgaagccggcgatgaggccgactattactgtcaagtgtgggatcgtaattatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacag

SEQ ID NO: 108 - DNA, 75 bp, Homo sapiens
  misc_feature (1)...(75): n = g, a, c or t
ctgtagcttctgtgggacttccactgctcaggcgtcaggctcanatanctgctggccgcgtacttgttgttgctt

SEQ ID NO: 109 - DNA, 485 bp, Homo sapiens
  misc_feature (1)...(485): n = g, a, c or t
aaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgnttcctttttt

SEQ ID NO: 110 - DNA, 561 bp, Homo sapiens
  misc_feature (1)...(561): n = g, a, c or t
aaggaagcagcactggtggtgcctcagccatggcctggaccgttctcctcctcggcctcctctctcactgcacaggtgatccccccagggtctcaccaacctgcccagcccaaggcttctgggtccagcgtgtccttaattctgagctcaggagggcccttcctgtggtgggcaggatgctcatgaccctggtgcagggtgggaggctggtggggctgaattccccccaaactgtgctcaaggacttgtgagaacctgagggactgcacctgccaagagaaagtagtgagttttcagttcgaagtctccatacaacaggacatttgtgggccactggggctacggctgattgcaggggataccctgagggtttacagactctctggattttgtctgggacagcaggacaagggatttcaaaaggaatacctttcacttggaaggcaacctctctgncatttattcttttgnttatttatttatttttttatttattcttatctttgcagactctgtgacctcctatgtgttgactcagacaccctcagtgtcagtggcccc

SEQ ID NO: 111 - DNA, 255 bp, Homo sapiens
  misc_feature (1)...(255): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccggnagccgtgacagtggcctggaaggcanatagca

SEQ ID NO: 112 - DNA, 365 bp, Homo sapiens
  misc_feature (1)...(365): n = g, a, c or t
ctgtagcttctgtgggacttccactgctcangcgtcangctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcataggagggcggnaacagantgaccganggggcagccttgngctgacctaggacggccagtttggtccctccgccgaagacgacatggtcattattacgatcccacacttgacagtaatagtcggcctcatngccggcttcgaccctgttgatggt

SEQ ID NO: 113 - DNA, 66 bp, Homo sapiens
  misc_feature (1)...(66): n = g, a, c or t
ctgtagcttccnccggacttccactgctcangcgtcaggctcagatagctgctggccgcgtacttg

SEQ ID NO: 114 - DNA, 94 bp, Homo sapiens
  misc_feature (1)...(94): n = g, a, c or t
ctgtagcttctgtnggacttccactgctcaggcgtcaggctcagatagctgctggccgcgtacttgttattgctttgnttggagggngtggtgg

SEQ ID NO: 115 - DNA, 386 bp, Homo sapiens
  misc_feature (1)...(386): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctannacggccagtttggtccctccgccnaagacgacatggttcattattacgatcccacacttgacagtaatagtcggcctcatcgccggcttcnaccctgttgatggtcagggtggctgttcatgctt

SEQ ID NO: 116 - DNA, 188 bp, Homo sapiens
  misc_feature (1)...(188): n = g, a, c or t
ccaccctgaccatcaacagggtcgaagccggcgatgaggccgactattactgtcaagtgtgggatcgtaataatgaccatgtcgtcttcngcggagggaccaaactggccgtcctaggtcancccaaggctgccccctcggtcactctgttcccgccctcctctgangagcttcaanccaacaaggcc

SEQ ID NO: 117 - DNA, 308 bp, Homo sapiens
  misc_feature (1)...(308): n = g, a, c or t
ctgtagcttctgtgggncttccactgctcanncgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccantgtggccttgttggcttgaagctcctcagaggagggcgggaacanantgaccganggggcagccttgggctgacctangacggccagtttggttcctccgccnaanacgacatggtcaattattaa

SEQ ID NO: 118 - DNA, 203 bp, Homo sapiens
  misc_feature (1)...(203): n = g, a, c or t
ctgtagcttctgtgnnncttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgntggcttgaag

SEQ ID NO: 119 - DNA, 293 bp, Homo sapiens
  misc_feature (1)...(293): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgactttctacccgggagccgtgacantggcctgnaaggcanatagcangnnccgtcaaggcggnagtggagaccaccacaccct

SEQ ID NO: 120 - DNA, 266 bp, Homo sapiens
  misc_feature (1)...(266): n = g, a, c or t
ctaaggaagcagcactggtggtgcctcagccatggcctggaccgttctcctcctcggcctcctctctcactgcacagactctgtgacctcctatgtgttgactcagacaccctcagtgtcagtggccccangaaagacggccaagattacctgtgggggaaacaatattgggagtaacaatgtacactggtattaccagaagccnggccangcccctgttcctaatcatctcttttgataacgaccggnnctcagggatatctgag

SEQ ID NO: 121 - DNA, 210 bp, Homo sapiens
  misc_feature (1)...(210): n = g, a, c or t
ctgtagcttctgtnggacttccactgctcaggcgtcaggctcagatagctgctggccgcgtacttgttgttactttgtttggagggtgtggtggtctccactcccgccttgacggggctgctatctgccttccaggccactgtcacggctcccgggtagaagtcacttatgagacacaccantgtggccttgttggcttgaagctcctca

SEQ ID NO: 122 - DNA, 292 bp, Homo sapiens
ccatgtccccagaattgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggccgaggcaccaccagtgctgcttcc

SEQ ID NO: 123 - DNA, 474 bp, Homo sapiens
  misc_feature (1)...(474): n = g, a, c or t
ggaagcagcactggtggtgcctcagccatggcctggaccgttctcctccccggcctcctctctcactgcacagactctgtgacctcctatgtgttgactcagacaccctcagtgtcagtggccccaggaaagacggccaagattacctgtgggggaaacaatattgggagttacagtgtacactggtattaccaaaagccaggccaggcccctgtcctaatcatctcttttgataacgaccggccgcccgggcaggtccaatgaagatactccacagttgtatgtggcctgtggtaggggaccccgatcatctctgagagtcctaagacatggacttgaggtgtcagaaatggctgtttctgagctacctggtnaccccaaacgctgtctggacagtgcgtcgacacattgaagatgagtttgatgcctacatcattgtgtctttcgtgaatgccaccctagtgttgtccattg

SEQ ID NO: 124 - DNA, 200 bp, Homo sapiens
  misc_feature (1)...(200): n = g, a, c or t
ccaccctgaccatcaacagggtcgaagccggcgatgaggccgactattactgtcaagtgtgggatcgtaataatgaccatgtcgtcttcggcgganngaccaaactggccgtcctaggtcagcccaaggctgccccctcggtcactctgttcccgccctcctctgaggagcttcaagccaacaaggccacactggtgtgt

SEQ ID NO: 125 - DNA, 155 bp, Homo sapiens
  misc_feature (1)...(155): n = g, a, c or t
ctgtagcttcngccggacttccactgctcaggcgtcaggctcagatagctgctggccgcgtacttgttgttgctttgtttggagggtgtggtggtctccactcccgccttgacggggctgctatctgccttccaggccactgtcacggctcccgg

SEQ ID NO: 126 - DNA, 160 bp, Homo sapiens
  misc_feature (1)...(160): n = g, a, c or t
ccaccctgaccatcaacagggtcgaagccggcgatgaggccgactattactgtcaagtgtgggatcttaatgatgaccatgtcgtcttcggcggangaaccaaactggccgtcctaggtcagcccaaggctgccccctcggtcactctgtnnccgccctc

SEQ ID NO: 127 - DNA, 201 bp, Homo sapiens
  misc_feature (1)...(201): n = g, a, c or t
ccaccctgaccatcaacagggtcgaagccggcgatgaggccgactattactgtcaagtgtgggatcgtaataatgaccatgtcgtcttcggcgganngaccaaactggccgtcctaggtcagnccaaggctgncccctcggtcactctgttcccgccctcctntgangagcttcaagccaacaaggccacactggtgtgtc

SEQ ID NO: 128 - DNA, 198 bp, Homo sapiens
  misc_feature (1)...(198): n = g, a, c or t
ctgtagcttctgnnggncttccactgctcaggcgtcaggctcanatagctgctggccgcgtacttgttgttgctttgtttggagggtgtggtggtctccactcccgccttgacggggctgctatctgccttccaggccactgtcacggctcccgggtagaagtcactttatganacacaccantgtggccttgttggc

SEQ ID NO: 129 - DNA, 485 bp, Homo sapiens
  misc_feature (1)...(485): n = g, a, c or t
aaaaaaggaaacanaaaacagaagaaatcacttaaggagagctgtcattttctattggtgaggattcctgatcttggggaggttctggaaagttcgtctctgtttcttcttcttcctcttcttggattggaataatttcaatgtcttcttcattctttggttgggaagatgtttcagttagcccaaccacttcttcttttatttcaatagtctgttcttttttttcttctgctgacaggagaactatgttagatttgggtctggagcacgttcttttccattcattctcaacgatgccagctattacaagttcctggaagaaggcaaagatcagcatcactgacaaaatgcccaagaacagagattgtatgctgtaacagtattgggtagatggggagtttttctcagagggattagctggttcacagttgtatatgttaatatatggtgtgtgagctctaataaaattcagactctccattttt

SEQ ID NO: 130 - DNA, 77 bp, Homo sapiens
  misc_feature (1)...(77): n = g, a, c or t
ctgtagcttctgtnggacttccactgctcaggcgtcaggctcagatagctgctggccgcgtacttgttgttgctttg

SEQ ID NO: 131 - DNA, 161 bp, Homo sapiens
  misc_feature (1)...(161): n = g, a, c or t
ctgtagcttctgtnggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaa

SEQ ID NO: 132 - DNA, 294 bp, Homo sapiens
  misc_feature (1)...(294): n = g, a, c or t
ccaccctgaccatcaacagggtcgaagccggcgatgaggccgactattactgtcaagtgtgggatcataataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacantnncctggaaggcanatancagccccgtcaangcgggagtgganaccaccacaccctcca

SEQ ID NO: 133 - DNA, 298 bp, Homo sapiens
  misc_feature (1)...(298): n = g, a, c or t
ccaccctgaccatcaacagggtcnaagccggcgatgaggccgactattactgtcaagtgtgggatcgtaataatgaccatgtcgtcttcggcggagggaccaaactggccgtcctaggtcagcccaaggctgccccctcggtcactctgntcccgncctcctntgangagcttcaagccaacaaggccacactggtgtgtctcataagtgacttctacccgggagccgtgacagtggcctggaaggcantatagcagccccgtcaaggcgggagtggagaccaccacaccctccaaac

SEQ ID NO: 134 - DNA, 373 bp, Homo sapiens
  misc_feature (1)...(373): n = g, a, c or t
ctgtagcttctgtgggacttccactgttcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctangacggccagtttggtccctccaccgaagacgacatggtcattattacgatcccacacttgacagtaatagtcggcctcatcgccggcttcgaccctgttgatggtcagggtgg

SEQ ID NO: 135 - DNA, 487 bp, Homo sapiens
  misc_feature (1)...(487): n = g, a, c or t
aaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcacnaatagaaaatgacagctctccttaagtgatttcttctgttttctgtttttcctttttt

SEQ ID NO: 136 - DNA, 368 bp, Homo sapiens
acagcatggacatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtgcaacattattctgcatctcttcgcagttttgg

SEQ ID NO: 137 - DNA, 59 bp, Homo sapiens
  misc_feature (1)...(59): n = g, a, c or t
ctgtagcttctgtgggncttccactgctcgggcgtcaggctcaggtagctgctggccgc

SEQ ID NO: 138 - DNA, 357 bp, Homo sapiens
  misc_feature (1)...(357): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgannagcttnaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacncggccagcanctatctgagcctgacgcctgagcagtggaagt

SEQ ID NO: 139 - DNA, 79 bp, Homo sapiens
ctgtagcttctgtgggacttccactgctcaggcgtcaggctcagatagctgctggccgcgtacttgttgttgctttgtt

SEQ ID NO: 140 - DNA, 239 bp, Homo sapiens
  misc_feature (1)...(239): n = g, a, c or t
ctgtagcttctgtgggacttccactgctcaggcgtcaggctcagatagctgctggccgcgtacttgttgttgctttgttnngagggtgtggnngtctccactcccgccttganngggctgctatcnnccttccagagccacnntcacggctcccgggtagaagtcacttatgagacacaccantgtggccttgttngcttnaagctcctcagaggagggcgggaacagagtgaccgagg

SEQ ID NO: 141 - DNA, 373 bp, Homo sapiens
ccaccctgaccatcaacagggtcgaagccggcgatgaggccaactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgcctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacag

SEQ ID NO: 142 - DNA, 373 bp, Homo sapiens
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacag

SEQ ID NO: 143 - DNA, 267 bp, Homo sapiens
cacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttgg

SEQ ID NO: 144 - DNA, 367 bp, Homo sapiens
cttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggttcctccgccgaagacgacatggtcattattaagatcccacacttgacagtaatagtcggccttatcgccggcttcgaccctgttgatggtcagggtgg

SEQ ID NO: 145 - DNA, 90 bp, Homo sapiens
  misc_feature (1)...(90): n = g, a, c or t
ccaccctnaccatcaacagggtcgaagccggggatgaggccgactattactgnnaagtgtgggatcataataatgaccatgtcgnnttcg

SEQ ID NO: 146 - DNA, 291 bp, Homo sapiens
ccatgtccccagaattgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggctgaggcaccaccagtgctgcttc

SEQ ID NO: 147 - DNA, 244 bp, Homo sapiens
ccatgtccccagaattgaagccagagaatcgctcagatatccctgagggccagtcgttatcaaaagagatgattaggacaggggcccggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgag

SEQ ID NO: 148 - DNA, 513 bp, Homo sapiens
ccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggaacactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctgg

SEQ ID NO: 149 - DNA, 181 bp, Homo sapiens
cttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtgg

SEQ ID NO: 150 - DNA, 373 bp, Homo sapiens; identical to SEQ ID NO: 6

SEQ ID NO: 151 - DNA, 252 bp, Homo sapiens
cttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacct

SEQ ID NO: 152 - DNA, 499 bp, Homo sapiens
  misc_feature (1)...(499): n = g, a, c or t
cctcggatgatgaagacagtgcccaccacaatgcccacgaggcccacagacaaccccagggcgcagaccacagtctctgtgagctctgacataggggctggaatctcaggctcccagtgtttcagaagaggcttgtccagtccccagtgctccaccttgcagtcataactctcctcagcagaagggaggagggtgaggtaactgatcttgaagaaggaatgatcactcttggagaggaagctggtctcanaaacaccttctgtgactgagtgcccattgctcanccatgtgatgttgaccacaggaggaaagatgttgtccacaagacagatgaggatgttgggctgacccagtgtcacgggagacttggaaaacactgtgacctcaggaacctcattggtagcagcggtagagttggagcgtttaatcagactgttcaagttatgttttangacagcgatgtttgtcagtgcaaattgcgggtcaaatctaaattgtc

SEQ ID NO: 153 - DNA, 373 bp, Homo sapiens; identical to SEQ ID NO: 90

SEQ ID NO: 154 - DNA, 243 bp, Homo sapiens
  misc_feature (1)...(243): n = g, a, c or t
ctgtagcttctgngggacttccactgctcaggcgtcaggctcagatagctgctggccgcgtacttgttgttgctttgtttggagggtgtggnggtctccactcccgccttgacggggctgctatctgccttccaggccactgtcacngctcccgggtanaagtcacttnngagacacaccantgtggccttgntggcttgaanctcctcataggagggcgggaacagantgaccgagggggca

SEQ ID NO: 155 - DNA, 307 bp, Homo sapiens
  misc_feature (1)...(307): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcanccccgtcaaggcgggagtggagaccaccacaccctccaaacaaagnaacaa

SEQ ID NO: 156 - DNA, 502 bp, Homo sapiens
ccatgtccccagaattgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagttactttctcttggcaggtgcagtccctcaggttctcacaagtccttgagcacagtttggggggaattcagccccaccagcctcccaccctgcaccagggtcatgagcatcctgcccaccacaggaagggccctcctgagctcagaattaaggacacgctggacccagaagccttgggctgggcaggttggtgagaccctggggggatcacctgtgcagtgagagaggaggccgaggaggagaacggtccaggccatggctgaggcaccaccagtgctgcttcc

SEQ ID NO: 157 - DNA, 538 bp, Homo sapiens
  misc_feature (1)...(538): n = g, a, c or t
ctgtcccaaacgggccagccctggggctttggggctgggcctccgtgaggagaggtcagtcggtcagcggcccggggtggctgccctgagccccagggctggtcctggggtctgtcagtccttccccaggctttccaggtccagaaggctttgtggggtctggggctgtgtcagggtaaggaaagctgccttggtggaggaagagaagtcagagaggtcacacatgtggccttagaacctgctaagtccaacgtcagcatgtgacaggaggggaagtgaggcaagacggcagaacccaggggaaaaggtggcagggagtctgagagtgaggttgggaggaccagcatcttttaggccctgagcaagaaggaggtgaccggagtcttccaggtatccctccctcctagcttctggaagtgggagtcggggagggggctccagtcagtcangtgtaagctccatgccatggggactctgcaggacaggcaggcttgaggagccactgtgcctggacaggttctgcaggctcccccacttg

SEQ ID NO: 158 - DNA, 373 bp, Homo sapiens; identical to SEQ ID NO: 6

SEQ ID NO: 159 - DNA, 290 bp, Homo sapiens
  misc_feature (1)...(290): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctangacggccagtttgnnccctccgccgaagac

SEQ ID NO: 160 - DNA, 274 bp, Homo sapiens
  misc_feature (1)...(274): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccantgtggccttgttggcttgaagctcctcanaggagggcgggaacagagtgaccgagggggcagccttgggctgacctaggacggccagtttgg

SEQ ID NO: 161 - DNA, 375 bp, Homo sapiens
gtcaggacacagcatggacatgagggtccccgctcagctcctggggctcctgctgctctggctcccaggtgccaaatgtgacatccagatgacccaatctccttccaccctgtctgcatctgtcggagatacagttacaataagctgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 162 - DNA, 288 bp, Homo sapiens
  misc_feature (1)...(288): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcanatagcanccccgncaaggcgggagtggagaccaccacac

SEQ ID NO: 163 - DNA, 297 bp, Homo sapiens
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggcgtgtctcataagtgacttctacccgggagccgtgacagtggcctggaaggcagatagcagccccgtcaaggcgggagtggagaccaccacaccctccaaac

SEQ ID NO: 164 - DNA, 395 bp, Homo sapiens
ccatgtccccagaattgaagccagagaatcgctcagatatccctgagggccggtcgttatcaaaagagatgattaggacaggggcctggcctggcttttggtaataccagtgtacactgtaactcccaatattgtttcccccacaggtaatcttggccgtctttcctggggccactgacactgagggtgtctgagtcaacacataggaggtcacagactctgtgcagtgagagaggaggccgaggaggagaacggtccaggccatggctgaggcaccaccagtgctgcttccttaggcaaagttatccctgtctgaaatggtatcttttgtgaggaggtctgacttgctgaggatttggactatgaaagagagaaccttgagtttcctgggaaag

SEQ ID NO: 165 - DNA, 292 bp, Homo sapiens; identical to SEQ ID NO: 29

SEQ ID NO: 166 - DNA, 193 bp, Homo sapiens
  misc_feature (1)...(193): n = g, a, c or t
gaaccgnacccgctccgtcccattgaagaaatgacactcagacgtagagtactccaagaaacgtggnctggtgtccccagccaaagccagtggggagctcancaccatcantgtcactgncagaactgncatgcaggaacctccagggagcctnagacacaccatgctgganaacaggacaggaccaggggcc

SEQ ID NO: 167 - DNA, 373 bp, Homo sapiens
  misc_feature (1)...(373): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggcctcatngccggcttcgaccctgttgatggtcagggtgg

SEQ ID NO: 168 - DNA, 83 bp, Homo sapiens
  misc_feature (1)...(83): n = g, a, c or t
ccaccctgaccatcaacagggtcgaagccggngatgaggccgactattactgncaagtgtgggatcgtaataatgaccatgtc

SEQ ID NO: 169 - DNA, 466 bp, Homo sapiens
  misc_feature (1)...(466): n = g, a, c or t
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgtttcatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggangaancggaagcataaagtg

SEQ ID NO: 170 - DNA, 429 bp, Homo sapiens
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcaggaatctatgcacccatctgtgtgactgtgt

SEQ ID NO: 171 - DNA, 553 bp, Homo sapiens
  misc_feature (1)...(553): n = g, a, c or t
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaggcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattnngcctctttgc

SEQ ID NO: 172 - DNA, 421 bp, Homo sapiens
  misc_feature (1)...(421): n = g, a, c or t
ccaatcatagagatatctgcaccagcctgcaaagcttccatgaacgctttggtcccagacttggcgatagtaccaaggttattgatcaagtcagccttggtcattccaattccagtatccacaatagtgagagttcgatcttgtttgttcggtataaggttaatatgcagctctttctcagagtctaatttactgggatctgtcaagctttcataccggattttgtccaatgcatctgatgaatttgaaatgagctctctcagaaagatctctttgttcgagtagaaagtattgatgatcaatgacatcaactgggcaatttctgcctgaaaggcgaacgtntnaacctcctnctcctccatcggttggtcttgggtctgggtttcctcangcatntggaacgacaccgcgccggtntacc

SEQ ID NO: 173 - DNA, 481 bp, Homo sapiens
  misc_feature (1)...(481): n = g, a, c or t
ccttgcctcanatccanggtcactcggaagaggccatgtctaccctcaatgacactcatggaggaaatgctganagaagcattcanatgcatgacacaaggtaagactgccaaaaatcttgntcttgctctcctcattttgttattngttttanttttaggagttntgagagcaaaatnacancacccagaaattcagtaaatgggactttcccggcaganccaatgaaaggccctattgctatgcaatctggtccaaaaccactcttcaggaggatgtnttcactggtgggccccacgcaaagcttcttcatgagggaatctaagactttgggggctgtccagattatgaatgggctcttccacattgccctggggggtcttctgatgatcccancagggatctatgcncccatctgtgtgactgtgtggtaccctctctggggaggcattatgtatattatttccggatcactcctggc

SEQ ID NO: 174 - DNA, 110 bp, Homo sapiens
  misc_feature (1)...(110): n = g, a, c or t
cccgggctggcttacctgggcaccgtgggcatgggggaggtgtgtcacaagatttgggctctgcagagagaanattgggagttacggggatctgggatngaggtggntgc

SEQ ID NO: 175 - DNA, 372 bp, Homo sapiens
aggacacagcatggacatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 176 - DNA, 373 bp, Homo sapiens
  misc_feature (1)...(373): n = g, a, c or t
ctgtagcttctgtgggacttccactgctcaggcgtcaggctcagatagctgctggccgcgtacttgttgttgctttgtttggagggtgtggtggnctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggcctcatcgccggcttcgaccctgttgatggtcagggtgg

SEQ ID NO: 177 - DNA, 373 bp, Homo sapiens
ctgtagcttctgtgggacttccactgctcaggcgtcaggctcagatagctgctggccgcgtactagttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacttaggacggccagtttggtccctccgccgaagacgacatggtcattattacgatcccacacttgacaataatagtcggcctcatcgccggcttcgaccctgttgatggtcagggtgg

SEQ ID NO: 178 - DNA, 136 bp, Homo sapiens
  misc_feature (1)...(136): n = g, a, c or t
cttctgtgggacttccactgctcaggcgtcaggctcagatagctgctggccgcgtacttgttgttgctttgtttggagggtgtggtggtctccactcccnccttgacggggctgctatctgccttccaggccactg

SEQ ID NO: 179 - DNA, 327 bp, Homo sapiens
  misc_feature (1)...(327): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcataattacgatcccacacttgncagtaa

SEQ ID NO: 180 - DNA, 192 bp, Homo sapiens
  misc_feature (1)...(192): n = g, a, c or t
ctgtagcttctgtgggacttccactgctcangcgtcaggctcagatagctgctggccgcgtacttgttgttgctttgtttggagggtgtggtggtctccactcccnccttgacggggcnngctatctgccttccangccactgncacggctcccnggtagaagtcacttatgagacacaccantgtggcctt

SEQ ID NO: 181 - DNA, 171 bp, Homo sapiens
  misc_feature (1)...(171): n = g, a, c or t
ccaccctgaccatcaacagggtcgaagccggcgatgaggccgactattactgtcaagtgtgggatcgtaataatgaccatgtcgtnttcggcggagggaccaaactggccgtcctaggtnancccaaggctgccccctcggtcactctgttccnnccctnctctgangagc

SEQ ID NO: 182 - DNA, 373 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattaagatcccacacttgacagtaatagtcagcctcatcgccggcttcgaccctgttgatggtcagggtgg

SEQ ID NO: 183 - DNA, 585 bp, Homo sapiens
ccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggactggacaagcctcttctgaaacactgggagcctgagattccagcccctatgtcagagctcacagagactgtggtctgcgccctggggttgtctgtgggcctcgtgggcattgtggtgggcactgtcttcatcatccgagg

SEQ ID NO: 184 - DNA, 155 bp, Homo sapiens
  misc_feature (1)...(155): n = g, a, c or t
aagcagcactggtggtgcctcagccatggcctggaccgttctcctnctcggnctcctctctcaccgnacagactctgtgacctcctatgtgttgactcagacaccctnagtgtnagnggccccaggananacggccaagattacctgtgggggaa

SEQ ID NO: 185 - DNA, 119 bp, Homo sapiens
  misc_feature (1)...(119): n = g, a, c or t
ggacacagcntggacatgagggtccccgctcagctcctggggctcctgctgctctggctnccaggtgccaaatgtganatccagatgacccaatctccttccaccctgtctgcatctgt

SEQ ID NO: 186 - DNA, 101 bp, Homo sapiens
  misc_feature (1)...(101): n = g, a, c or t
ccaccctgaccatnaacagggtngaagccggcgatnaggccgactatnactgtcaagtgtgggatcgtaatnatgaccatgtcntcttnngcggagggacc

SEQ ID NO: 187 - DNA, 239 bp, Homo sapiens
cccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacag

SEQ ID NO: 188 - DNA, 84 bp, Homo sapiens
  misc_feature (1)...(84): n = g, a, c or t
ccaccctgaccatcaacagggtcgaagccggngatgaggccgactattactgncaagngtgggatcgtaataangaccatgtcg

SEQ ID NO: 189 - DNA, 139 bp, Homo sapiens
  misc_feature (1)...(139): n = g, a, c or t
ccaccctgaccatcaacagggtcnaantccggcgatgaggccgactattactgtcaagtgtgggatcgtaataatgaccatgtcgtcttcggcggagggaccaaactggccgncctaggtcagcccaaggctgccccct

SEQ ID NO: 190 - DNA, 283 bp, Homo sapiens
  misc_feature (1)...(283): n = g, a, c or t
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcanaggagggcgggaacagagtgaccgagggggcagccttgggctgacctaggacggccngtttggtccctncgc

SEQ ID NO: 191 - DNA, 179 bp, Homo sapiens
  misc_feature (1)...(179): n = g, a, c or t
aatgtttcattgnactcaacatgtgaagaaaactattggtnntgncccatgactgtttgcacttntctgntaacctgacaaattcctactccttccccatgagcattgtaaanccttgtgcacaatntgaaaacttatgagtgacctgagatnttatctatcccctanctttttaccta

SEQ ID NO: 192 - DNA, 90 bp, Homo sapiens
  misc_feature (1)...(90): n = g, a, c or t
ctgtagcttctgtgggacttccactgctcaggcgtcaggctcagatagctgctggccgcgtacttgttgttgctttgnttggagggtgtg

SEQ ID NO: 193 - DNA, 585 bp, Homo sapiens; identical to SEQ ID NO: 183

SEQ ID NO: 194 - DNA, 283 bp, Homo sapiens
actggtggtgcctcagccatggcctggaccgttctcctcctcggcctcctctctcactgcacagactctgtgacctcctatgtgttgactcagacaccctcagtgtcagtggccccaggaaagacggccaagattacctgtgggggaaacaatattgggagtaacaatgtacactggtattaccagaagccaggccaggcccctgtcctaatcatctcttttgataacgaccggccctcagggatatctgagcgattctctggcttcaattctggggacatgg

SEQ ID NO: 195 - DNA, 54 bp, Homo sapiens
  misc_feature (1)...(54): n = g, a, c or t
ctgtagcttctgtgggacttncactgctcaggcgtcaggctcanatagctgctg

SEQ ID NO: 196 - DNA, 375 bp, Homo sapiens; identical to SEQ ID NO: 50

SEQ ID NO: 197 - DNA, 130 bp, Homo sapiens
  misc_feature (1)...(130): n = g, a, c or t
atggacatgagggtccccgctcagctcctggggctcctgcnngctctggctcccaggtgccaaatgtgacatncagatgacccaatctcctnccacccngtctgcatctgncggagatacanntncaata

SEQ ID NO: 198 - DNA, 191 bp, Homo sapiens
  misc_feature (1)...(191): n = g, a, c or t
taataatgaccatgtcgtcttcggcggagggaccaaactggccgtcctaggtcagcccaaggctgccccctcggtcactctgttcccgccctnctntgagnagcttcaagccaacaaggccacactggtgtgtctcataagtgacttctacccgggagccgtgacagtggcctggaaggcanatagcagcc

SEQ ID NO: 199 - DNA, 282 bp, Homo sapiens
ctggtggtgcctcagccatggcctggaccgttctcctcctcggcctcctctctcaccgcacagattctgtgacttcctatgtgttgactcaaacaccctcagtgtcagtggccccaggaaagacggccaagattacctgtgggggaaacaatattgggagtcacaatgtacactagtattaccagaagccaggccaggcccctgtcctaatcatctcttttgataacgaccggccctcagggatatctgagcgattctctggcttcaattctggggacatgg

SEQ ID NO: 200 - DNA, 464 bp, Homo sapiens
  misc_feature (1)...(464): n = g, a, c or t
caggcagaggctctgggtcagtgcaggaagcagagtcacagccagcgccttggggtggggatgaaaggagatgacctggtggctgcgtgacagccactgtaggactctgatctcagggggacaggctgacacaggcagttgggaattctgggcagggacaagcaggcgttacagaaaagtgataaccaatcccagttaaaatagtctcaggagtcagtgcaggagccctttctgactcctgtgatggataataaggcccancccgaggaagatgagccccagcacgaagcctccaatgccactcagcatcttgctctgggcagattcagactgagcccgccactccacggtgatggggttctggaggctggggtgctccacgtggcaggtgtagacgtctccatgctggggagtcatttccagcatcaccaggatctggaaggnccagtcaccgnttcctaata

SEQ ID NO: 201 - DNA, 373 bp, Homo sapiens; identical to SEQ ID NO: 6

SEQ ID NO: 202 - DNA, 373 bp, Homo sapiens
  misc_feature (1)...(373): n = g, a, c or t
ccaccctgaccatcaacagggtcgaagccggcgatgaggccgactattactgtcaagtgtgggatcgtaataatgaccatgtcgtcttcggcggagggaccaaactggncgtnctaggtnagnccaaggctgccccctcggtcactctgttcccgccctcctctgaggagcttcaagccaacaaggccacactggtgtgtctcataagtgacttctacccgggagccgcgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacag

SEQ ID NO: 203 - DNA, 373 bp, Homo sapiens; identical to SEQ ID NO: 6

SEQ ID NO: 204 - DNA, 565 bp, Homo sapiens
cagagctcaagtctgaactctacctccagacagaatgaagttcatctcgacatctctgcttcttatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtt

SEQ ID NO: 205 - DNA, 474 bp, Homo sapiens
  misc_feature (1)...(474): n = g, a, c or t
gtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcagggatcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattccnaaaaaaaaaaaaaaaanaaaaaaaaagg

SEQ ID NO: 206 - DNA, 237 bp, Homo sapiens
ccagtattcctggaggatataacactgacatcagcagggttttcaatggcaacaattgcacgagctgccagcagaagcttctcccaggtcctcttgagatttatgatatagatgccatcacttttccttttatagatgtactgttccatctggaagtcaagattggtgccacctaagtgggttcctgctgcaaggaacttaaggacatcctcctccttcatttgcaggacatcaagg

SEQ ID NO: 207 - DNA, 585 bp, Homo sapiens
ctcagagctcaagtctgaactctatctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgaggctatgtaaaaataaccttgcagaagctgatggggcaaactcaagcttcttcactcacagcaccctatatacacttggagtttgcattcttattcatcag

SEQ ID NO: 208 - DNA, 436 bp, Homo sapiens
ctgagcagagggacctgcacacagagactccctcctgggctcctggcaccatggccccactgaagatgctggccctggttaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgtcggtgttcaccgcccccaccctgagcgcctgggtccaggggagg

SEQ ID NO: 209 - DNA, 524 bp, Homo sapiens
gctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatgg

SEQ ID NO: 210 - DNA, 579 bp, Homo sapiens
  misc_feature (1)...(579): n = g, a, c or t
aaagaatatgtagaatctaggtaagtggataaaaggtctgggggcaggggaaaggagagcatttcattgtgaatcaaggaatttctccacctgttttaactcttccatatgacatcaaagagatgtcacttgcagctagcatttcagtgatgttttcttgctaataatatcgtgataaaagaaacattgactataagaaataggaatgggtctcataaaaggaaacagcaaaacccccaaactaaaaaacagcgcaggctatttctctcttctctccttttgcttggcactcatgagatgctaggtgtggaagtcagccaactgaaaaagagaggtggctgaagaaggtggggaggctgaagccagttaaataggatggtccaattcacagacggcgaggctacagtgcaaataggactctttcaacttgagcaggaccccattacttcactggagttagaaagaaaggagagcgtagactttttgaactttctataagagtgtacctccncagtatacagaagacgacgtgaaatttgatctgcaagaaaactgagtccatattcacatatgtatcaa

SEQ ID NO: 211 - DNA, 556 bp, Homo sapiens
cagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacaacaccctatataca

SEQ ID NO: 212 - DNA, 353 bp, Homo sapiens
cgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacac

SEQ ID NO: 213 - DNA, 513 bp, Homo sapiens
ctgctactcatttgcttctatgggtatgctagaagcgagaatccgtatactaaccaacaattctcagaccccaatcctaagccctcaggaggttgtgtcttgtagccagtatgctcaaggctgtgatggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacag

SEQ ID NO: 214 - DNA, 538 bp, Homo sapiens
aaacattaaacaacaagtatataatcaaaataatcctgtattacttataactgaataactattttcaaagaaactttcctccctgatgaataagaatgcaaactccaagtgtatatagggtgctgtgagtgaagaagcttgagtttgccccatcagcttctacaaggttatttttacatagtctcatgcttatttgtatggggaagttctttttcctggaaaagatttaactaagcacaaaactaaaatccagagcagggataagggaagaatgcaggtgttcttagtggaaatatcagcatcagggaatctttctcttaaacactggaactggtagagttgaagaacttctttttctcaatacttccatcattctttgtatccattcagcttgagggcccacacacacaattgacttgttcttcttccagactatgatttcttttcttggacaaccactcccacggggcaagatttgaattcgatcaatgaagcgtctagggataaagactgagctctcttggacacatctacacct

SEQ ID NO: 215 - DNA, 588 bp, Homo sapiens
aaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtattttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatgg

SEQ ID NO: 216 - DNA, 580 bp, Homo sapiens
cagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataacctcgcagaagctgatggggcaaactcaagcttcttcactcacagcaccctatatacacttggagtttgcattcttattcat

SEQ ID NO: 217 - DNA, 396 bp, Homo sapiens
  misc_feature (1)...(396): n = g, a, c or t
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgtntganttggctctcacagtttatgcagacattggagagacaatttggttatttcaaacatcacaggatttgagtaagaagacctggttatgaaacaaggctctcataattactagttatgactgttgacaaggttaccttttcttgttt

SEQ ID NO: 218 - DNA, 426 bp, Homo sapiens
  misc_feature (1)...(426): n = g, a, c or t
tggacagncctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacag

SEQ ID NO: 219 - DNA, 431 bp, Homo sapiens
  misc_feature (1)...(431): n = g, a, c or t
tcaagtctgaactctacctccagacagaatgaagttcatctcgacatctctgcttctcatgctgctggtcagcagcctctctccagtccaaggtgttctggaggtctattacacaagcttgaggtgtagatgtgtccaanagagctcagtctttatccctanacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgngcttagtt

SEQ ID NO: 220 - DNA, 286 bp, Homo sapiens
  misc_feature (1)...(286): n = g, a, c or t
ctgtctcacactttacaagctgtgagagacacatcagagccctgggcactgtcactgcttgcagcctgagtgtaactccctccttttctatctgagctcttcctcctccacatcacggcagcgaccacagctccagtgatcacagctccaaggagaaccaggccagcaatgatgcccacgatggggatggtgggctgggaagacagctcccatctcanggtgaggggcttgggcagaccctcatgctgcacatggcaggtgtatctctgctcctctccagaaggca

SEQ ID NO: 221 - DNA, 536 bp, Homo sapiens
  misc_feature (1)...(536): n = g, a, c or t
ctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgngcttagttaaatcttttccaggaaaaagaacttccccatacaaataagcatgagactatgtaaaaataaccttgcagaagctgatggggcaaactcaagcttnttcactcac

SEQ ID NO: 222 - DNA, 565 bp, Homo sapiens
  misc_feature (1)...(565): n = g, a, c or t
ctcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcngaagctgatggngcaaactcaagcttcttcactcacagcaccctatatacacttggag

SEQ ID NO: 223 - DNA, 529 bp, Homo sapiens
cgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacag

SEQ ID NO: 224 - DNA, 297 bp, Homo sapiens
  misc_feature (1)...(297): n = g, a, c or t
cctcccctggacccaggcgctcagggtgggggcggtgaacaccaacggtggaggtcccaggtagtcccgggagacagtcaggagtctggggtgaggaggcttcaagacctctcaaggctttgcaggtatttaactgcattcttcactctcttgttgttggggtccgaacagatggccctgccctgcacagttacaaaaacgatggcntccctggagcagncctnagatgnctggnaccacgtcttcagctttctaangggaatggctcccttgaagtactccaggcangcactcccg

SEQ ID NO: 225 - DNA, 253 bp, Homo sapiens
cctcccctggacccaggcgctcagggtgggggcggtgaacaccaacggtggaggtcccaggtagtcccgggagacagtcaggagtctggggtgaggaggcttcaagacctctcaaggctttgcaggtatttaactgcattcttcactctcttgttgttggggtccgaacagatggccctgccctgcacagttacaaaaacgatggcatccctggagcagtcctcagatgtctggtaccacgtcttcagctttc

SEQ ID NO: 226 - DNA, 598 bp, Homo sapiens
ccatctgatctataaatgcggtggcatcgacaaaagaaccattgaaaaatttgggaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagt

SEQ ID NO: 227 - DNA, 612 bp, Homo sapiens
  misc_feature (1)...(612): n = g, a, c or t
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgttgacttggctctcacagtttatgcagacattggagagacaatttggttatttcaaacatcacaggatttgagtaagaagacctggttatgaaacaaggctctcataattactagttatgactgttgacaagttaccttttcttgtttacaagttatttggcctctttgaattacttgtaaaatagagatagggattctttcttgatcatggaacatcaaatgaagttatttgatgaaatactttgtcatctggaaattataaatataactaaatgttaattattatttggaaatttngggcacctcatggnggcattttctatggtcattttttttcttttctcgcataatggctaaaagtaggt

SEQ ID NO: 228 - DNA, 288 bp, Homo sapiens
  misc_feature (1)...(288): n = g, a, c or t
agccattgnntgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgngctgcatactatcctcctagccaaattgctcaactaagaccaagtcctcgctggactgctcagggtgccagacctcatccattccaaaatatgcccggtgctatccgcccag

SEQ ID NO: 229 - DNA, 594 bp, Homo sapiens
ctcagagctcaagtctgaactctacctccagacagaatgaagttcatctcgacatctctgcttctcatgctgctggtcagcagcctctctccagtccaaggtgttctggaggtctattacacaagcttggggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagtttttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaag

SEQ ID NO: 230 - DNA, 571 bp, Homo sapiens
ctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaa

SEQ ID NO: 231 - DNA, 584 bp, Homo sapiens
  misc_feature (1)...(584): n = g, a, c or t
aaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactacctttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatancttatac

SEQ ID NO: 232 - DNA, 457 bp, Homo sapiens
ccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcaaaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatga

SEQ ID NO: 233 - DNA, 256 bp, Homo sapiens
  misc_feature (1)...(256): n = g, a, c or t
cctcccctggacccaggcgctcagggtgggggcggtgaacaccaacggtggaggtcccaggtagtcccgggagacagtcaggagtctggggtgaggaggcttcaagacctctcaaggctttgcaggtatttaactgcattcttcactctcttgttgntggggtccgaacagatggccctgccctgcncagttacaaaaacgatggcatccctggagcagtcctcagatgtctggtaccacgtcttcagctttctaa

SEQ ID NO: 234 - DNA, 571 bp, Homo sapiens
  misc_feature (1)...(571): n = g, a, c or t
cagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatganactatgtaaaaataacccttgcagaagctgatggggcaaactcaagcttcttcactcacagcaccctatatacacttggagtttgcat

SEQ ID NO: 235 - DNA, 489 bp, Homo sapiens
  misc_feature (1)...(489): n = g, a, c or t
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctntcagtgcttgtttattgctggtcagagagtaaattcttgataaaagctgttgacttggctctcacagtttatgcanacattggagagacaatttggttatttcaaacatcacaggatnngagtaagaanacctggttatgaaacaaggctctcataattactagttatgactgttgacaagttaccttntcttgnttacaagttatttggcctctttgaattacttgnaaaatagagatagggattctttcttgatcatggaacatcnaatgaagttattngatgaaatact

SEQ ID NO: 236 - DNA, 306 bp, Homo sapiens
ctgctgcacccagagctcctttgggtctgcacatagctctgcctgagagcgcttgcggggcaagaacaggatagctgggatggagcagcccaagcttggttcctgcttccggtagctgcggacaaccttggcgggaatcttcctttggctgtacttgaggcaacagtcctgagcccctccatcactgccttgggtcctggggatgccaaaggccagaaccaggataaggaggctcagagccagtgactgagccatgtctgtggtagagggtgagtaagaggccagagctgagggtgaggtgggcag

SEQ ID NO: 237 - DNA, 560 bp, Homo sapiens
  misc_feature (1)...(560): n = g, a, c or t
ctcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagancttccccatacaaataagcatgagactatgtaaaaataaccttgcagaagctgatggggcaaactcaagcttcttcactcacagcaccctatatacact

SEQ ID NO: 238 - DNA, 484 bp, Homo sapiens
  misc_feature (1)...(484): n = g, a, c or t
aaaaaaggaaacagaaaacagaagaaatcacttaaggagagctgtcattttctattggtgaggattcctgatcttggggaggttctggaaagttcgtctctgtttcttcttcttcctcttcttggattggaataatttcaatgtcttcttcattctttggttgggaagatgtttcagttagcccaaccacttcttcttttatttcaatagtctgttctttttttcttctgctgacaggagaactatgttagatttgggtctggagcacgttcttttccattcattctcaacgatgccagctattacaagttcctggaagaaggcaaagatcagcatcactgacaaaatgcccaagaacagagattgtatgctgtaacagtattgggtagatggggagtttttctcanagggattagctggttcatagttgnatatgttaatatatggtgtgtgagctctaataaaattcanactctccattttt

SEQ ID NO: 239 - DNA, 493 bp, Homo sapiens
ctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactcca

SEQ ID NO: 240 - DNA, 439 bp, Homo sapiens
  misc_feature (1)...(439): n = g, a, c or t
cagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatgaatacaaagaatgatggaagtattgagaaaaagaagttcttcaactctaccagttccagtgtttaaganaaagattccctgatgctgatatttccactaagaacacctgcattcttcccttatccctgctctggattttagttttgngcttagttaa

SEQ ID NO: 241 - DNA, 529 bp, Homo sapiens
  misc_feature (1)...(529): n = g, a, c or t
tgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgntgnttaatgttt

SEQ ID NO: 242 - DNA, 440 bp, Homo sapiens
ctccctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggagg

SEQ ID NO: 243 - DNA, 345 bp, Homo sapiens
  misc_feature (1)...(345): n = g, a, c or t
cctcccctggacccaggcgctcagggtgggggcggtgaacaccaacggtggaggtcccaggtagtcccgggagacagtcaggagtctggggtgaggaggcttcaagacctctcaaggctttgcaggtatttaactgcattcttcactctcttgntgttggggtccgaacagatggccctgccctgcacagttacaaaaacgatggcatccctggagcagtcctcagatgtctggtaccacgtcttcagctttctaaggggaatggctcccttgaagtactccaggcagcactcccggcccacattggtccctcgagctgcgtggatgtgctgcananaanccccc

SEQ ID NO: 244 - DNA, 368 bp, Homo sapiens
  misc_feature (1)...(368): n = g, a, c or t
caagcttttttttttttttttttttttttttttttatgantaatggtctatttatngatnccattctattttaacaaanaaaatntttcaaattacaaggtntacaantcaatactgntttgaanngaaaaatnatttgctttgaaagtgtntgcatgtatatatatatgataaatgattataacgtgtgtgtcanngacaanatgtantctttggttgttagttatatactgnctacctgtganangcaaggtaagngggtnacanactntnaaatttatnaaacacttanatttttcanggaagttacntgaaggaactagggagtttcatgantanataaaangttcgggngggatctccaccgg

SEQ ID NO: 245 - DNA, 573 bp, Homo sapiens
ccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcag

SEQ ID NO: 246 - DNA, 425 bp, Homo sapiens
gacctgcacacagagactccctcctgggctcctggcaccatggccctactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggagg

SEQ ID NO: 247 - DNA, 593 bp, Homo sapiens
atctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcggggaggaaagtttctttgaaaatagttattcagttataagtaatacaggattat

SEQ ID NO: 248 - DNA, 453 bp, Homo sapiens
  misc_feature (1)...(453): n = g, a, c or t
cagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaagacnaaaaaaaaaaaaaaaaaaaaaaaaaaaagcttg

SEQ ID NO: 249 - DNA, 608 bp, Homo sapiens
ctcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgcgtgtgtggaccctcaagctgaatggatacaaagaatgatggaagtattgagaaaaagaagttcttcaactccaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttctttactcacagcaccctatatacacttggagtttgcattcttattcatcagggaggaaagtttctttgaaaata

SEQ ID NO: 250 - DNA, 400 bp, Homo sapiens
ccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttg

SEQ ID NO: 251 - DNA, 393 bp, Homo sapiens
ctgctcatcagatggcgggaagatgaagacagatggtgcagccacagttcgtttgatctctaccttggtccctcccccgaaagtgagcgaaggaggccacttggcacgaccgtgacagtaataaactgcaaaatcttcaggctctaggctgctgacggtgagagtgaagtctgtcccagatccactgccagtgaatctggcggggatgccagcggccctgtaggatgtatcataaatgatgatcctgggagcctggccaggtttctgttgggaccagcctaagtaggtggcaacactctgactggccctgcaggagagggtggctctctcccctggagacaaagacagggtggctggagactgtgacaacacaagttctccggtggagtctgg

SEQ ID NO: 252 - DNA, 425 bp, Homo sapiens
cctggtggaaagaaggctctagaacctgcttatagagccacaacagggtgcagacaactgtgatgtcaaccaatgtcactcgttcgcccaccagaaaagtcctcgtcttcaagtaagcatccagcagccccagaattcgcctcacttcctcctttgcattctcagtggcctgtttgttgtggtgcatgatgcccaaggtggggaacacccaggtactggctgggggcactatatcggaatcagcaaagctcacccactgcaccacctgggctgctgcctctggagtacttccccgcagctcctcattgctcacatagtaggcaatggcgttgctctcaaacacacagaatccatcatcaccctcaaatgctgggaccttgccggcaggaaatttgcggagaaattcaggggtgcggttggtttgg

SEQ ID NO: 253 - DNA, 603 bp, Homo sapiens
aaaaaaacttgtgcaaattgcaatcactgagtgattatggaaaggcaaagtatatacagtaatgtgagagaaactcaaaccaagtaagggtaaaaatgaaatgattaacaccaccagaggaggaagctactatcaaaataaaaccatacttcctaataaaggtaaggccatcataaccccagaaaatgcttcatactttagataattaaaaacacattataaccaaaagcagatagtaacattgagtatgctgatttcaaaaagaagatgggtctagataccaggacagctctttttagtgccttccttaaaaagggcaaaactttttagagccatgtaattgtttatagccatggcctggcttcaggcatctcataagtgaggcttcagaaagtccttgaagagtatatggcagtgaaactgggctcccatctttaccataaagatgttcttcttgagaataagtgcatataggaagtgatcgcttatgacatcatttcattgatcttgaggccatataaagagacttgctgatattagagcagtttctttctaatcaatattccgctgaattccaagcaatgaggcacacaccagtttgtc

SEQ ID NO: 254 - DNA, 485 bp, Homo sapiens
aaaaaaggaaacagaaaacagaagaaatcacttaaggagagctgtcattttctattggtgaggattcctgatcttggggaggttctggaaagttcgtctctgtttcttcttcttcctcttcttggattggaataatttcaatgtcttcttcattctttggttgggaagatgtttcagttagcccaaccacttcttcttttatttcaatagtctgttcttttttttcttctgctgacaggagaactatgttagatttgggtctggagcacgttcttttccattcattctcaacgatgccagctattacaagttcctggaagaaggcaaagatcagcatcactgacaaaatgcccaagaacagagattgtatgctgtaacagtattgggtagatggggagtttttctcagagggattagctggttcacagttgtatatgttaatatatggtgtgtgagctctaataaaattcagactctccattttt

SEQ ID NO: 255 - DNA, 568 bp, Homo sapiens
ctcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagttt

SEQ ID NO: 256 - DNA, 518 bp, Homo sapiens
cctcccgcttacgcagcttgtcatactggcgacaggttctctcgaagagcgaggagatgctggtgtggttggaaaaaaggaaacagaaaacagaagaaatcacttaaggagagctgtcattttctattggtgaggattcctgatcttggggaggttctggaaagttcgtctctgtttcttcttcttcctcttcttggattggaataatttcaatgtcttcttcattctttggttgggaagatgtttcagttagcccaaccacttcttcttttatttcaatagtctgttcttttttttcttctgctgacaggagaactatgttagatttgggtctggagcacgttcttttccattcattctcaacgatgccagctattacaagttcctggaagaaggcaaagatcagcatcactgacaaaatgcccaagaacagagattgtatgctgtaacagtattgggtagatggggagtttttctcagagggattagctggttcacagttgtatatgttaatatat

SEQ ID NO: 257 - DNA, 231 bp, Homo sapiens
aaacttgatccaacctctttgcatcttacaaggttaaacagctaaaagaagtaaaataagaaggcaatgcttgtggaatgtacagtgcatattggcggcgcacgcctcattacgattcgcctgcttgcttctcctgttcaatcgtttctttggaaggcagtggatttttctcttgcgtctctgtcttcttcagtttcgacttatcgaatttctcgatctcagccatatcgg

SEQ ID NO: 258 - DNA, 551 bp, Homo sapiens
  misc_feature (1)...(551): n = g, a, c or t
ctgaatatactaaacnttgctctattatctgttgaattgctgtatttcactttttcagcatttggggatcattatttaattgaatttgtagagatcgattttccagacaggtctctgttcttcaatgaacaaatgataagaaacaatttgactccttatatgacaatggaattaaataaattgacactcatctaggaataattctacaatcatctccatctctaagattacctactgcaaacaaagaattgatctttctttctcaaaaaccacatgggtaagatgatcattgtgactctgaatgcaagaataagtgagtggaagctacaaggggagattatctgccaacatagaaagaatctagaagaaaagattttattacaggtaacatgacatagcttggagccatctttttggtctcttgcatacattttctctgcatgtctaaggaagaattcacaaggtagcaagcaccaatactttctgctttggagtttcacaaattgaaaatttgtccctctcttgttaagtcaatcaaacatctaccaatg

SEQ ID NO: 259 - DNA, 231 bp, Homo sapiens
aaacttgatccaacctctttgcatcttacaaagttaaacagctaaaagaagtaaaataagaaggcaatgcttgtggaatgtacagtgcatattggcggcgcacgcctcattacgattcgcctgcttgcttctcctgttcaatcgtttctttggaaggcagtggatttttctcttgcgtctctgtcttcttcagtttcgacttatcgaatttctcgatctcagccatatcgg

SEQ ID NO: 260 - DNA, 278 bp, Homo sapiens
aaaatatccctgaagtgacacactccttttttgagaccgatactggtattcttttattatagagactaaaaggtctgccttactagacttcccactttttgttctgaaaggaattaaggactgcaggtttccagctctgtcttcccgaggccattatgaacagattaaatggaaggacaaattctaaataactgggctttcaacatgaaaagggaaaggctgatggggagttcagaaccttgaatactgtaactgaacatccctcaaggttaatgcag

SEQ ID NO: 261 - DNA, 272 bp, Homo sapiens
ccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatgg

SEQ ID NO: 262 - DNA, 500 bp, Homo sapiens
  misc_feature (1)...(500): n = g, a, c or t
ccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcnaagaaattggtggtg

SEQ ID NO: 263 - DNA, 287 bp, Homo sapiens
ctctggcctcttactcaccctctaccacagacatggctcagtcactggctctgagcctccttaccctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcag

SEQ ID NO: 264 - DNA, 306 bp, Homo sapiens
ctgcccacctcaccctcagctctggcctctgactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcag

SEQ ID NO: 265 - DNA, 242 bp, Homo sapiens
ctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactg

SEQ ID NO: 266 - DNA, 132 bp, Homo sapiens
ctgcttccattggtgggtcatttttgctgtcaccagcaacgttgccacgacgaacatccttgacagacacattcttgacattgaagcccacattgtccccaggaagagcttcactcaaagcttcatggtgca

SEQ ID NO: 267 - DNA, 108 bp, Homo sapiens
ccatgggaatctaattaatttcataatgatgttggttgaacatgataccaaaaaatgcaggtattttcaagaacaataagatagataacagcattaaagcataatcct

SEQ ID NO: 268 - DNA, 414 bp, Homo sapiens
cctgacacaatatccctgttcactttgaagtgaattttgactctatattcagaaccttcctttaacacaatggtttcctttttgagggcttccagatctccagtaaggtccatggtgattggtcccggggcactctcacaaaccagggtgagccgggtgacaacgacattgggggctttcggatctgtcaccacaggaccatctcccagcagcgttttcttgtacttaattagactctcatcatctttgtccatttcctgcagctctttcagggacttctgtggtggaggcttataattgagcttgctgtccagctcatcatcgtcatcctcctccacatgtgggctctggggctttttcagtcattctgatctatttattcagtgcttcacgtctctgtccggggtgcctctg

SEQ ID NO: 269 - DNA, 461 bp, Homo sapiens
cgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaaccggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcccagc

SEQ ID NO: 270 - DNA, 206 bp, Homo sapiens
gaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggacaaggattccaactagtagacgaaagtgatgctttccatgac

SEQ ID NO: 271 - DNA, 500 bp, Homo sapiens
  misc_feature (1)...(500): n = g, a, c or t
atgatgcagaagctactcaaatgcagtcgggttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcnaactacttccaggtgaatccaacaagatcccccgtctgaggactgacctttttccaaagaccagaatccaggacttgaatcgtatcttcccnctttctgaggactactctggatcaggcttcggctccggctccggntctggatcaggatctgggagtggcttcctaacggaaatggaacaggattaccaactagtagaccaaagtgatgctttccatgacaaccttaggtctcttgacaggaatctgccctcanacagccnggacttgggtcaacatggattagaagaggattttatgttataaaagaggattttccccccttgncn

SEQ ID NO: 272 - DNA, 511 bp, Homo sapiens
  misc_feature (1)...(511): n = g, a, c or t
ggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccnctttctgaggactactctggatcaggcttcggctcccgctccggctctggatcaggatctgggagtggcttcctaacggaaatggaaccnggattacccaactagtagacgaaagtgatgctttccatgacaacccttaggtctcttgacaggaatctgccctcacacngccaggacttgggtcaacatggattagaagaggattttattgntataaaagaggattttccccnccnttgaccc

SEQ ID NO: 273 - DNA, 101 bp, Homo sapiens
  misc_feature (1)...(101): n = g, a, c or t
gttngtaatnatgcanaagctactcnaatgcagtccnnctttttctggctcttgccctcatcctggttctngaatcctcacttcaaggttatcctacncac

SEQ ID NO: 274 - DNA, 451 bp, Homo sapiens
  misc_feature (1)...(451): n = g, a, c or t
anctagactannntggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttngaactacttncaggtgaatncaacangatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactantagacgaaagtgatgctttccatgacaaccttangtctcttgacaggaatctgcccncagacagcc

SEQ ID NO: 275 - DNA, 423 bp, Homo sapiens
attgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttgg

SEQ ID NO: 276 - DNA, 433 bp, Homo sapiens
  misc_feature (1)...(433): n = g, a, c or t
tgnncatgatgcanaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccangtgaatccaacaagatcccccgtctgaggactgacctttttncaaagacgagaatccaggacttgaatcgtatcttcccactttctgaggactactctggatcaggcttnggntccggctccggctctggatcangatctgggagtggcttcctaacggaaatggaacaggattaccaactagnngacgaaagtgatgctttccatgacaaccttaggtctcttgacaggaatctgccctcaga

SEQ ID NO: 277 - DNA, 478 bp, Homo sapiens
ctggctaggtgtgtgtgtatgtgagtaggggtgctattgattggcacatattttcccccctggagtttaggggtggcagaaagcttttatagtaccaaaaaagtaaacattgataatatggcctgacaacaatcagatatgctaagctctagaagcaaaagcaaggtaggattgcctccaaatgttgacaggtattagccataccacagtaactagatctaatgtgagggctaaatgcctggagaggcagaaccctaaaggatgcttagttatagctccatgctgccgccgagtggcttgatgctccattacaccctccttggatccaaccttccattaaggctgaaggctctagagggcagagtattcaagatgttagatctggtccaagcccaaattctagagttaaaagcagaggggttcttagtggctgaaaaaaaacaaaacctgatgacatttgggactccagttttgagga

SEQ ID NO: 278 - DNA, 208 bp, Homo sapiens
aagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactg

SEQ ID NO: 279 - DNA, 330 bp, Homo sapiens; identical to SEQ ID NO: 2

SEQ ID NO: 280 - DNA, 294 bp, Homo sapiens
ccaaactcctccagatgccagacggtctccttcttgtccagatccacatagaacatctcatcttcatcaaattcaaacataaactcccctgttggtctatgcgtctgtacaaacgcggcataagttgacacatggtccgccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactga

SEQ ID NO: 281 - DNA, 269 bp, Homo sapiens; identical to SEQ ID NO: 4

SEQ ID NO: 282 - DNA, 491 bp, Homo sapiens
ccaggagtgtcaaactctgtaagcacacggataccccggagccgtgcgtattcaatgacctccttcacatcctgtgctgtgtagatgtgggtgacagggttgtaggacccctttctcatgagctctggaaaagtgaagctctcatatgggaaggaaggatcatctaccagatgccagtggaacacgttcaatttattgtacgccatgacatccagagtgtccaggatgctagagagtggcaggtaatggcgagatgtatccaacagcaagccccggtgaggaaagcggggaaagtcctcaatctcagtcttgttgataaagaactcggagagctccccagacagtctcagagaggagtaaacactggtcatcatttatggtcagggtataattctccactgactccaaagtaggaagctggttacatccaggtgtgactacagagacaaccaacacattcttctccagtgtatgcccgtttccctaggttg

SEQ ID NO: 283 - DNA, 472 bp, Homo sapiens
  misc_feature (1)...(472): n = g, a, c or t
cctcnnacngaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagtcccgggtcacgtgcagcaggaacaagcagccactctgggggcaccaggtggagaggcaagacgacaaagagggtgcccgtgttcttgcgaaagcggggctgctggccacgagtgctggacagaggcccccacgctctgcttgcccccatcacgccgttccgtgactgtcacgcagaatctgcanacaggaagggagactctaagcgggagtgcggccaagcctgcctccgcccgtcagggaggactcccgggctcactcnaaggaggtgccaccatttccgctttggnnagcttttctttttcttt

SEQ ID NO: 284 - DNA, 349 bp, Homo sapiens
  misc_feature (1)...(349): n = g, a, c or t
aaaaaatttactcatcttccataaagcgacttttaatgtatcaacacttaaagatacacagtgacttaatgaaatatcagcacaactgcatagaattgagctccagagaattatacactcgagctgctttcctgggctctggtttataagggtattggcttagagaccagcttggagtcatttgcccctacccgggaaatgcaggccaggaaacttaagattttgcgggccttttctgtttctaggtaaaatgcagggagctccctgaaggncttgaaaaccatcaaccattcaaatatggtatcctggggacctttcctcttgagtaaanggaagaaaggaggtttgg

SEQ ID NO: 285 - DNA, 179 bp, Homo sapiens
  misc_feature (1)...(179): n = g, a, c or t
aaagntggctcaagactggcccangcataatactgtcaatctaaaggtaaccggcaacatcaaaaagtacatctcaaaagaatcaggcttaaagataaacaggagaactggatatatctaagagtaagaagtgtaaacaatagaaaagaggtagggtttagggttctcatctagggatt

SEQ ID NO: 286 - DNA, 462 bp, Homo sapiens; identical to SEQ ID NO: 16
  misc_feature (1)...(462): n = g, a, c or t

SEQ ID NO: 287 - DNA, 388 bp, Homo sapiens
ggacattcaaatgtctttatccacattcctgaaggataattgttatagattccctacctccataggaatgcttataatggattatctatacaatctccacattcccacattttgcattagagaatggaatcagtcaaaccctgttcccagagtttcccttagagttctcacctgttgtcttatatccatctaggaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccag

SEQ ID NO: 288 - DNA, 387 bp, Homo sapiens; identical to SEQ ID NO: 20

SEQ ID NO: 289 - DNA, 279 bp, Homo sapiens
  misc_feature (1)...(279): n = g, a, c or t
ngnccacaagatatgttctatagacgtccatgagtcctcttgctgtgngggagcggtatccacagacttntggaataattggcctgtgaggaagctcatcaaagctgcaaacagtacaantgaatgcaataganagncacagggccttattagcctttctgatggaggacttganatttgttgnccaggaanctattgtgtcataaactgaagagacatnccactttgatggattatttttcttttcagaaagacttggcttccttgtcctttctactg

SEQ ID NO: 290 - DNA, 235 bp, Homo sapiens
  misc_feature (1)...(235): n = g, a, c or t
ngtccagtagggctgagatgttgggagccatcaatcaggaaagccgggttagtaaagcagttgaagtgatgattcancacgtagaaaacttgaagaggatgtatgccaaaaagcaccgctgaattagaagaactgaaacaggttcttctgcagaatgaaaggcctttcaatnctcttgaagatgatgatgactgccaaattaaaaaacgttcagcttttctaaactccaagccat

SEQ ID NO: 291 - DNA, 318 bp, Homo sapiens
  misc_feature (1)...(318): n = g, a, c or t
cctttccttgagctgcacgtgaacctgtgtgggcaggcagcgtttgcaggcgtgtttacgggcaggcagcgtttgcaggcgtgtttaccggcaggcagcgtttgcaggcgtgtttacatgcaggcgtancaccatgtgagaccactggtccagggtttcagaggtcctgctcaggtgaatcggctgtgttctcacaagttcacggagctgantgggtgtgcaacatgaaatactagtgctgtgagggacagaagggacagaaagaggctnaagaccatnatccagctatacctgtgcctcggcttttctcagacctcg

SEQ ID NO: 292 - DNA, 381 bp, Homo sapiens
  misc_feature (1)...(381): n = g, a, c or t
ccaagcctcatcaataactgtatccaaaaggagacgctgcttggggtgtacccagagaaaacaccaagctttcctggcttcccggccctccctctccccattagtctttggggtgcatacataagtgttgtgtgaagtctcttggggtttagaagatcttgcactcattgatggagaagagcctccttctgtttcgtctcctggcctggttgacggcagttcggacgacgcactcaaacacctgctgtactccccgattgctaagggctgagcactccaggtagcccttggctctgacatcctgggccagnttcttcccttccatggcattgacgcangaggccctgtggggccccatctcccgctggtcagtctgggtgg

SEQ ID NO: 293 - DNA, 416 bp, Homo sapiens; identical to SEQ ID NO: 37
  misc_feature (1)...(416): n = g, a, c or t

SEQ ID NO: 294 - DNA, 317 bp, Homo sapiens
aaattatgacacaaaattttattaacaaggaaatatccattaattgactactacagtaaaaactttataatgcttgtatcatgaagaaagaccttccttttccttatatattaattgaactacataggcttgctgtacattttgttattcatgttataagaattctagattccattgcttttgaaatatgtttctttttaggaactaaaagtcaacttatagtttgatttctgttttatttgtactgtgtttctgattttgtgggtttctaaataaaaagatcaaacccaccactttcaatatactgttttctattt

SEQ ID NO: 295 - DNA, 156 bp, Homo sapiens; identical to SEQ ID NO: 40
  misc_feature (1)...(156): n = g, a, c or t

SEQ ID NO: 296 - DNA, 533 bp, Homo sapiens; identical to SEQ ID NO: 43
  misc_feature (1)...(533): n = g, a, c or t

SEQ ID NO: 297 - DNA, 529 bp, Homo sapiens
  misc_feature (1)...(529): n = g, a, c or t
cctgtggaaacgggcccctcccggagcccanggaaaagactgcttctctctcagcagccccattcctggttattccagggctgaccaacaaggacatttccacctcacaagctgctgctcactgatgttcccgtgggataagaggggaaattaagtgacaaccgcagcagcatccgctgggtctgtccctgtatcgcatgccagaggcttgcgcatcaccaagggtcgggcgtagctgtgctgccctgcgttgtgtgcatagcctctctctcctctgcttgcttaagtccttcttanccaccctctcccttanggctctaccaggtatgccacggggagcaggaatattaatcctagaatcctgactctcagtggcaatacagagtgtactccagggatgctgggtgaaacccggggaattctactcaccattaaccttgggagtaagaggccatacctcatctgaaactttacctgcccgggcgggccgttcaaaaggccnattcccccnccctttgcgccnttatag

SEQ ID NO: 298 - DNA, 345 bp, Homo sapiens
  misc_feature (1)...(345): n = g, a, c or t
ccaatgtggttggtcttcancttgcanttagccaggttccataccttgaccagcttgtcccagccacaggagacgatgatagggttgctgctgttgggcgagaagcggacacaagacacccactctgagtggctctcatcctggacagtgtatttgcacacacccagggtattccatagcttgatggttttatctcgagatccagagacaatctgccggttgtcagaggagaaggccacactcagcacatccttggtatggcccacaaatcgcctcgtggtggtgcccgttgtgagatcccagaggcgcagggttccatcccaggagcctgagagggcaaactgg

SEQ ID NO: 299 - DNA, 182 bp, Homo sapiens
  misc_feature (1)...(182): n = g, a, c or t
ccacaagatatgttctagagacgtccatgagtcctcttgctgtgtgggagcggnatccacagacttctggaataattggcctgtgaggaagcccatcaaagctgcaaacagtacaatgaatgcaatagagagccagagggccttattagcctttntgatggaggacttgagatttgttgccc

SEQ ID NO: 300 - DNA, 440 bp, Homo sapiens
ctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttcctcaacggcaagtctctcaaggggaccacgcaccatgatgccttgg

SEQ ID NO: 301 - DNA, 396 bp, Homo sapiens
  misc_feature (1)...(396): n = g, a, c or t
cttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttangggtaaacaatatctctggtattgaagaggtgaatatgtttacaaaccaaggaacagtgatccactttaacaaccctaaagttcaggcatctctggcagcgaacactttcaccattacaggccatgctgagacaaagcag

SEQ ID NO: 302 - DNA, 548 bp, Homo sapiens
  misc_feature (1)...(548): n = g, a, c or t
ctgcgtgattcccgtgattgcgttacaagctttgtctccttcgacttggagtctttgtccaggacaatgagacactcaaagagaacttattgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatctggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaaccgtttttacctgcccgggcgggcgctaanggcgaattccagcacactnggcgccgttctaggggatccgagctcggtccanctt

SEQ ID NO: 303 - DNA, 232 bp, Homo sapiens
ccagcgacagcctggcctgggaatggactggcagctcatcactaaaatgactcctttcatggaatccactgctatgcagccacactgaccacagagcaactgaataggtgagcattggattgttgatgacaactcttcagcagaacaattgtgtgtttgaagggactgttttatgatgaaataactgttatttcctggagctaattgttgaatgacagtttgtcaactgttt

SEQ ID NO: 304 - DNA, 232 bp, Homo sapiens; identical to SEQ ID NO: 57

SEQ ID NO: 305 - DNA, 191 bp, Homo sapiens; identical to SEQ ID NO: 58
  misc_feature (1)...(191): n = g, a, c or t

SEQ ID NO: 306 - DNA, 342 bp, Homo sapiens
aaacttttgagttgtagtcagaaactgttgttggactgcatagttttcaaaagtttttggtacatttctgactttagaaatctggggtaggaatccctttccatatgcatatagactattttctgagcttcttcaaaacatgtttcagtgggttcctgaatgttcctgatgatagtctctcttgtcgaactgtcaatgttaatctctctaggggactgtggctggatgtaaatcttataaagcttctttgccctagaaattctgctccaccgtgaggcaattttcttataggtttcacatgccatccagaattgaatattctcgtcactgtgctccattttt

SEQ ID NO: 307 - DNA, 545 bp, Homo sapiens
ccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctct

SEQ ID NO: 308 - DNA, 330 bp, Homo sapiens
cctccatctcggctccagtccacactgtagatcgtgtctgggtgcacctctgggcccagtgtcagcatggccgccccagtgcccacgtcccacaccatgatcacgttgtcacaacctgcactgagcagcacgttctgggctgtggtgtgccaggccacaatgcccacacgcttggtgtggccctccagggtgacgacgggctcccgcaggggcagcatcaggcccccatccgggatctcccacaccatgactgtgcagtcctcggagccactggcaatgacgttgtcattgtgcgggcaccaggcgatgtctagcgcaggggctgtgtgg

SEQ ID NO: 309 - DNA, 392 bp, Homo sapiens; identical to SEQ ID NO: 67
  misc_feature (1)...(392): n = g, a, c or t

SEQ ID NO: 310 - DNA, 221 bp, Homo sapiens
  misc_feature (1)...(221): n = g, a, c or t
nccaggctcaggccctggggtgaaaggagacaggtgctgccaagaccatacatcagtcatctggcagcagctcgagaagcatgtcctccacgccgtcaatcttgatgtggtgcactaaagcgccnagaaaacttggagtctgaggatcggtatcgtccatcagggtagagctgccacatgataggcagcaggcttgggcctatctgggtgggggtcatagg

SEQ ID NO: 311 - DNA, 118 bp, Homo sapiens
  misc_feature (1)...(118): n = g, a, c or t
ncctcccagagaaggctggtgaccaggtcccaggcgggcaagactcagccttggtggggcctgaggacagaggaggcccaggagcatcggggagagaggtggagggacaccnggaaaa

SEQ ID NO: 312 - DNA, 133 bp, Homo sapiens
  misc_feature (1)...(133): n = g, a, c or t
gccggncaggtaaagaactaatttgtaaattatgacacaaaattttattaacaaggaaatatccattaattgactactacagtaaaaactttataatgcttgtatcatgaagaaagaccttccttttncctat

SEQ ID NO: 313 - DNA, 274 bp, Homo sapiens
  misc_feature (1)...(274): n = g, a, c or t
ngtaaatgattctttatttcaataaactttaacaaacaatatataatatttcttccttaaaaagctcattcaaagatcataggcagacttcttccccattgtattttagttggggagataaaggcaaaaagaggaaatgtaagctatcttacagtcattctgagaacctctggtttcatgctatactttcccagctaaaagttactaatttacgaagttcagatctgaaacttaaaaatcaanatccatatattaggatgtcctgctgtcacac

SEQ ID NO: 314 - DNA, 268 bp, Homo sapiens
  misc_feature (1)...(268): n = g, a, c or t
gtgatctccccatttgaaggtcgactgattagcaatctaagttctgcccggaactttaattcctctttgccaggtaatgcattcacagatcctggggactagggtgtggacatctttgggaggcattattctgcctgccataatagaattgttnggaagattaaacaacataatatacatgacgtatgttgangcacgcttggcacctgggaaatactcaggatgtactaaccattgctcctacacagntcagctnctgaaggagtcc

SEQ ID NO: 315 - DNA, 201 bp, Homo sapiens
aaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctg

SEQ ID NO: 316 - DNA, 202 bp, Homo sapiens; identical to SEQ ID NO: 78
  misc_feature (1)...(202): n = g, a, c or t

SEQ ID NO: 317 - DNA, 182 bp, Homo sapiens
  misc_feature (1)...(182): n = g, a, c or t
accagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttnaggaaacgatggcaagaacganaactcngg

SEQ ID NO: 318 - DNA, 149 bp, Homo sapiens; identical to SEQ ID NO: 80
  misc_feature (1)...(149): n = g, a, c or t

SEQ ID NO: 319 - DNA, 240 bp, Homo sapiens
  misc_feature (1)...(240): n = g, a, c or t
ccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggctttttcana

SEQ ID NO: 320 - DNA, 374 bp, Homo sapiens; identical to SEQ ID NO: 83

SEQ ID NO: 321 - DNA, 285 bp, Homo sapiens
cctttccttgagctgcacgtgaacctgtgtgggcaggcagcgtttgcaggcgtgtttacgggcaggcagcgtttgcaggcgtgtttaccggcaggcagcgtttgcaggcgtgtttacatgcaggcgtagcaccatgtgagaccactggtccagggtttcagaggtcctgctcaggtgaatcggctgtgttctcacaagttcacggagctgagtgggtgtgcaacatgaaatactagtgctgtgagggacagaagggacagaaagaggctgaagaccatcatccag

SEQ ID NO: 322 - DNA, 135 bp, Homo sapiens
aaagagaactaatggaagtggattgaatacagcagtctcaactgggggcaattttgccccccagaggacattgggcaatgtttggagacattttggtcattatacttggggggttgggggatggtgggatgtgtg

SEQ ID NO: 323 - DNA, 297 bp, Homo sapiens
ccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcag

SEQ ID NO: 324 - DNA, 413 bp, Homo sapiens
  misc_feature (1)...(413): n = g, a, c or t
ccttgcctcanatccnnggtcactcggaagaggccatgtctaccctcaatgacactcatggaggaaatgctgagagaagcattcagatgcatgacacaagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcaagggatctatgcacccatctgtgtgactgtgtggtaccctctctgggggaggcattatgtatattattttccggatcactcctggcagnaacggagaaaaaactccangaagttgtttggtcaaaggaaaaatg

SEQ ID NO: 325 - DNA, 340 bp, Homo sapiens
ctggggggtccgggaaaggggttgggccatgagccaggcagctccgaagcagtcactgaggccagggagcctgcacccaggtcatggggcgacctggctctcactcctggcctgggtgctcacctacagaccacttcacttcccctgtccgcagcgtcactatgtcctcataggtggctgtctggtcaatgtccaggccctcgtaggtgtgatcttcctccatgccagccttgctgtcatccttgtccagcagcaggaagataggcacgatgatgaagaggatgatcagcagcgtctggatcatgatgataccatccttcagcgtgttcctctgcttcag

SEQ ID NO: 326 - DNA, 240 bp, Homo sapiens
ccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcag

SEQ ID NO: 327 - DNA, 353 bp, Homo sapiens
aaaaaaacaaagaagaagaagtcacaaagcaattgaaatggagcatccgcttggagaattaagacagggtgctcctgagacagacttccaagacagcttctttgaagtgctgtgtggggttaaatattcttcagcaaagagggtcacaggtaagggccccgtgaaacagcagttcttaatatcatctttatcttcccttaggataatataccccaaaatactttgcatctataagatgtatacatcactgcagttcacgaaacacagtctgctgcccaatacatatccatgttgcatggctaatgaaatgtcaaaccctactgggtacatggcagtggagctccacagcaagg

SEQ ID NO: 328 - DNA, 267 bp, Homo sapiens; identical to SEQ ID NO: 143

SEQ ID NO: 329 - DNA, 228 bp, Homo sapiens
cctccccaggacgacgtcttcccgacgcaagagcacccgtaactgtaacctatcctttatctcgatggttaagggcagccaggcgtgctgcttctcgtccaaatacacgaacttctcccaggcccacaggcggtccgggtggtcggtgactgcctccccgagtgtcgggcactcggccatggcgtcctcgggccgcctaagaagcaagagccagagcctctcaaggcc

SEQ ID NO: 330 - DNA, 580 bp, Homo sapiens
ctgaaggatgaaagagattggcaaggaagcaggaatgagtcagctttgggggaatattacctggtggctcccatcatttattgcttaggacatacccttttacctacttgctatcatgctggacctcagcatttcagggaccagaaaagatggggacaccaatgcaagcccaagactaccatccagaggaccgttcctgcccatgctgcttcctctagttttgctttcagagtggtgtcaccccacttgctaactcaagagtgcatcactaggcttcctgagcaggtttgatcgggatttggcctgggtctgttggtcagggaggcagaggtgtggggagaagggtgaaaggtgactgagccagggttccaggctcctcactcacggggctgaagctgggcatcgtcaggctcagagcccctcgacgtgcggcagcggtagcccttcttcttgagcacgtggcagatcatgaagcctgccaggcccatgaggaagaagaccagcacaagcaggaagagcatatatagcccatgttggggcggttccaggtcaggctgtggttccgacatgaggccctggg

SEQ ID NO: 331 - DNA, 542 bp, Homo sapiens
  misc_feature (1)...(542): n = g, a, c or t
aaactccaaattcctttatcgaagcagctatctgctaatattactgaatgacaagtctttggaaatgatagttaaccgaaaatgcagaaagaatcatagcaactaatgataatgacgggtaaaggatagaaaataaaatttttagccacaggttgtggttacagcatccaggccatcaccgacatctcggcagggctatgccgccacttcgtattaaacgtctactcctccgagaatgcccttattaaattaagtgcaaagtaaggcatcccaccccagacagagggatccacattctttaatcatgatgcgggccactgtaacagggagatggatgcaggacgcagacggggtggggcgcccaagcgacgcacttagacggtgatctgttggttttctctgaaaaatgatctctggtgtgaggcacaaatatctggaaacatccggaagacctggtctggcggcggctcctcgggggcctgcatcacaganccggctccacagctcttcccagcctcttctgccagttgccggacatacag

SEQ ID NO: 332 - DNA, 345 bp, Homo sapiens
ccaatgtggttggtcttcagcttgcagttagccaggttccataccttgaccagcttgtcccagccacgggagacgatgatagggttgctgctgttgggcgagaagcggacacaagacacccactctgagtggctctcatcctggacagtgtatttgcacacacccagggtattccatagcttgatggttttatctcgagatccagagacaatctgccggttgtcagaggagaaggccacactcagcacatccttggtatggcccacaaatcgcctcgtggtggtgcccgttgtgagatcccagaggcgcagggttccatcccaggagcctgagagggcaaactgg

SEQ ID NO: 333 - DNA, 542 bp, Homo sapiens
ctgtatgtccggcaactggcagaagaggctgggaagagctgtggagccggctctgtgatgcaggcccccgaggagccgccgccagaccaggtcttccggatgtttccagatacttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccccgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagttt

SEQ ID NO: 334 - DNA, 618 bp, Homo sapiens
  misc_feature (1)...(618): n = g, a, c or t
aaaaaaaaaataattaagatacaggtttcaaaccatattaccacgatttcaaaaattttgtgaataaaagaagacacaccgtatttataaagcttctaggggctgtaatagatacataattttggatgtggtataggttggcctatatatacaaaaatacgtcactaaaattaagtggagtcacaataactttttatgtaactttgttttagttctaatttggtaacagtgactcaaaataaatagaatcatattttaggtggaaactcgatgatccatgtaagtagcggggctggagttctgtgctgtctgggcagagaaagcacttggactgaatgatgggcacagctctctctgtgaagtcctgcagagtcactaaccttgagttcatgtgctctaagcttcactgtccctccaacccaagatcccaatttcttttattccatcttgtttcctcttgtaaacagaagagcacaatatgacctgttttcaaaggagccggcaggaatctggttctgataacaaagtccctgtcactcctgtgtctattagttctcctaggtagtttcttcagggctgcgccaacttcacttcacagtanatgaaggaatagtgcca

SEQ ID NO: 335 - DNA, 193 bp, Homo sapiens; identical to SEQ ID NO: 166
  misc_feature (1)...(193): n = g, a, c or t

SEQ ID NO: 336 - DNA, 421 bp, Homo sapiens; identical to SEQ ID NO: 172
  misc_feature (1)...(421): n = g, a, c or t

SEQ ID NO: 337 - DNA, 481 bp, Homo sapiens; identical to SEQ ID NO: 173
  misc_feature (1)...(481): n = g, a, c or t

SEQ ID NO: 338 - DNA, 146 bp, Homo sapiens
  misc_feature (1)...(146): n = g, a, c or t
gtgtttgatggtaaggtttntcacanagccgaaaatgtngctgaanatcaaaaaaatctcacaagaaggggagggagaagagattcgattctgagtctcctactcccgggttctgcgtagagaagccgactgntgctggaggtcng

SEQ ID NO: 339 - DNA, 395 bp, Homo sapiens
  misc_feature (1)...(395): n = g, a, c or t
ctggaaaaggcnaaanagagncttaagaacgtggatgagaacattcgcangctcacngggcgggatccgaatgacntgaggcccatccaagccagattgctggccctttctggtcctggnggaggnagaggacgtggtagtntattactgaggcgtggattctnanatagtgnaggaggacccncagccnaacagagagaccttgaaggggcagtcantangctgggcggggagcgtnggaccagaagagaatcacgccaggaaagcgacccggangatgatgatgttaaaaagccancattgcagncttcagttgtagctacctncaaagagcgcacacgtanagacnttatccagnatcaaaatatggatgaaaagggaaagcaaaggaaccg

SEQ ID NO: 340 - DNA, 579 bp, Homo sapiens
ctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgcgttcttttctgcaacagatgattccaacatgggtgtttgtctattcttctttactcttgaaacattagaccatgggaggctcttacagccttgagttgatatttatacaacccaaatctaggcttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcagg

SEQ ID NO: 341 - DNA, 585 bp, Homo sapiens; identical to SEQ ID NO: 183

SEQ ID NO: 342 - DNA, 295 bp, Homo sapiens
aaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagagg

SEQ ID NO: 343 - DNA, 534 bp, Homo sapiens
aaatgtttcatttgcagagttttatatccattaagtgcctttgaaagtttccagttgtgtgggctgctgtctcacctcccaccaatttctcctttctccatatggtgctaaaacctcaaagctgaggagggctgcaggacccttagcagattcagtgtgtcacccttgtcctgtgttcacgccagggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgc

SEQ ID NO: 344 - DNA, 464 bp, Homo sapiens; identical to SEQ ID NO: 200
  misc_feature (1)...(464): n = g, a, c or t

SEQ ID NO: 345 - DNA, 437 bp, Homo sapiens
  misc_feature (1)...(437): n = g, a, c or t
cctccgtggcagcagaagatcttttcgtccactatggccgcgatgggcaggcagttgaagcagtcagtgaaggttttccacagtttgatgttgtagcgtctcttgcactcatcgtagaaaccatagatgcggttgatgctggcacactcgtggttcccacggagcaggaagaagttctcggggtacttgatcttataggccagcagcaggcagatggtctccaaggactgcttgcccctgtccacatagtcccccagaaagaggtagttgctctcgggagggaaaccgccatactcaaatagtcgcagaaggtcgtagtactggccgtgtatgtcaccgcagatcttgaggggtgcctccagctccanaagaatgggctggctcagaaaaatctcccgggatttcaggcacagaccgcggatctcgttctctgtcag

SEQ ID NO: 346 - DNA, 562 bp, Homo sapiens
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgttgacttggctctcacagtttatgcagacattggagagacaatttggttatttcaaacatcacaggatttgagtaagaagacctggttatgaaacaaggctctcataattactagttatgactgttgacaagttaccttttcttgtttacaagttatttggcctctttgaattacttgtaaaatagagatagggattctttcttgatcatgaaacatcaaatgaagttatttgatgaaatactttgtcatctggaaattataaatataactaaatgttaattattatttgaaatttgggcacctcatggtggcatt

SEQ ID NO: 347 - DNA, 332 bp, Homo sapiens
aaatattgtacagggaataatcgagcatgcaaaattgaaaaccccatgtaaagacagcatgataagctcactggaaattttttaattaaataagcttaaaaagacattggactaaatgctaatatatggaatataagatttcccaatgttaatttagttaacaacttttttgtagtagcatacacacacataccacctttatgtactatctctagaagtaaaatagtaaactatataagatagatatatatgagtagaacaaggaggacatcttgaggtcatttcagaaatgtacatgattttattgagtctgcacacagtttatgattttt

SEQ ID NO: 348 - DNA, 126 bp, Homo sapiens
  misc_feature (1)...(126): n = g, a, c or t
ggntgttgactcanattcggcattttaattacattgtttccaagtatgatattctgagagtgtctatagcacttagtgtctgcttcatataaactaccagttattatatatttatgatgcaagtag

SEQ ID NO: 349 - DNA, 294 bp, Homo sapiens
ccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccag

SEQ ID NO: 350 - DNA, 237 bp, Homo sapiens; identical to SEQ ID NO: 206

SEQ ID NO: 351 - DNA, 428 bp, Homo sapiens
  misc_feature (1)...(428): n = g, a, c or t
gtacaagcttttttttttttttttttttttttttttttccaccaaagtttatttntntgaaacaatcaccagttgctgtcctntntggcacactganagccccaggagggtctttaactccnttcctcanattatattcatcccaaaaatntancctnggacaatantttggttacagcatantcccagnaatgaggtcccccaaatngctaagttttacatagggganactgggaaattcaaanaatnggatgganaaaccataggatccaanataatgtcagggggttnaaaatnttgganaggcatggtaccatcattgagttngaatctccttctcacttggagnggaagttgtaggattctgcctctaggaaatgngccntccntntgaataattggncccagnaanaggagngtaactagag

SEQ ID NO: 352 - DNA, 563 bp, Homo sapiens
aaaaaaaactacatctctttattgcagaatttatacttgtttgaaaaatacaaaatgtagcgttgataagattgaagcatgttgaaaggtaagtacagggaaaggtcctttcagaatgactgcaacagtgcagcaaggattcccattccccgcctaaaggacaatacctttttaatagaaataaatgagttagttagttagatttttattacagattgaattaaacagttagttacaaagacattctctgatacattcattcatagaggtcttaacgtataaatacatagtaaatatcctataaaatggtaggcaatctcatcgtgcattatctttttgtgctcagacttgacttcacattcagtctctacatacagcttgattagaatcataaaaacaatatgaagacgattgcataaagggatagtttgacaaagcatattcagatattgtaacatttatggtgggtaaaaatgtatcttttgaaacaatatattagactccatttttagctgaaatgaaatttactgattcaatctttttaagaatttgtggatgtttac

SEQ ID NO: 353 - DNA, 524 bp, Homo sapiens; identical to SEQ ID NO: 209

SEQ ID NO: 354 - DNA, 340 bp, Homo sapiens
  misc_feature (1)...(340): n = g, a, c or t
ctgaagcagaggaacacgctgaaggatggtatcatcatgatccanacgctgctgatcatcctnntcntcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccag

SEQ ID NO: 355 - DNA, 556 bp, Homo sapiens; identical to SEQ ID NO: 211

SEQ ID NO: 356 - DNA, 561 bp, Homo sapiens
ccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgccctggtcttgctgtgtgatgggaacatgcttgtaaactgcgtaacaaatctacttt

SEQ ID NO: 357 - DNA, 353 bp, Homo sapiens; identical to SEQ ID NO: 212

SEQ ID NO: 358 - DNA, 202 bp, Homo sapiens
  misc_feature (1)...(202): n = g, a, c or t
ctgaagcagaggaacacgctgaaggatggtatcatcatgatccanacgctgctgatcatcctattcatcatcgtgcctatcttcctgctgctggacaaggatgacagcaaggctggcatggaggaagatcacncctacgagggcctggacattgaccagacagccacctatgaggacatagtgacgctgcggacaggggaag

SEQ ID NO: 359 - DNA, 463 bp, Homo sapiens
  misc_feature (1)...(463): n = g, a, c or t
ctcctntgtatgactgcaagtcctccaagatgccttctgcatntntnaatactacattcacctgattataaatttccttctcagactctgtaggctgggcattttcanantcaaggaaaaaatttggcccctgctcaaggtctgtgcatgtcaaaactttaagaagattccccatgttaaggtaccttcagccagtgctggtgattctgtccttgtccttctatccttggattggcgttccctctttcctagttcacttgttccagtccttcaacttctgtttcttgctaacaggtgtgcaaatgaattaccaactgggtaaccttgaatgagttaatcaaattccaggccatcgtccacgccaccaacagtcaaaggccaaggaagctgttggctgaaaaggtggtctatgttggcgtntggatccctgccctcctgctgactattnccgacttcatctttg

SEQ ID NO: 360 - DNA, 588 bp, Homo sapiens; identical to SEQ ID NO: 215

SEQ ID NO: 361 - DNA, 396 bp, Homo sapiens; identical to SEQ ID NO: 217
  misc_feature (1)...(396): n = g, a, c or t

SEQ ID NO: 362 - DNA, 253 bp, Homo sapiens
  misc_feature (1)...(253): n = g, a, c or t
gaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggttctgtaggtgangcacccaggccaggagtgagagccaggtcgccccatgacctgggtgcagg

SEQ ID NO: 363 - DNA, 571 bp, Homo sapiens
  misc_feature (1)...(571): n = g, a, c or t
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccgcgcaaagcttcttcatgagggaatctaagactttgggggctgtccagattatgaatgggctcttccacattgccctggggggtcttctgatgattccagcagggatctatgcacccatctgtgtgactgtgtggtaccctctctggggaggcattatgtatattatttccggatcactcctggcagcaacggagaaaaactccaggaagtgttgggtcaaaggaaaaatgataatgaattcattgancctntttgctgccatttctggaatgat

SEQ ID NO: 364 - DNA, 420 bp, Homo sapiens
ctgtagcctctgcaagtgaaaatccaggccgacttgcagtcattggactgatgtccaagtgcaatcaccatacagcagctacaggcagggctggctgatagggagtatgggagaaggacacgctcagatgaaaacatgcatgcaacgattttcaccactgaacacactgttttctgtgatagaaactgtcggccctgctgggggacaagatattcacggcctcactagccagtgagatgccaccagggcggcctgcccctgatgctcctttgttacctgctaaagaaggaccataaggtaaaaggcaccttaccttatggagtgagcccagaccccagggaaaagcttgggtagaacaatccaaggggcagcctgggtgtgagaatccagcccaagctagctgctctagaagcctggagg

SEQ ID NO: 365 - DNA, 374 bp, Homo sapiens
  misc_feature (1)...(374): n = g, a, c or t
agccacttgtttctcatttggtcgaaacagcctgcccacagggatcaccactggctcatatagcttctgcttccagacacactccatcgccttgtcgattttggaatgtctgggctcagacttcatgctcgtgggtgtaatacgatgtacagcaaagcgacccttggtgtcatagatcagacggaaattctctcccgtcttgncaatgctgatgacatccatgaatccagcagnggtaggtnatatcagttcggaccttgccatcnattttaatgaaccgctgcatgcaaatcttctttacttcatctnctgncagggcatacttaagtctgttcctcaggaaaatgatgagggggagacactctctnnacttg

SEQ ID NO: 366 - DNA, 431 bp, Homo sapiens; identical to SEQ ID NO: 219
  misc_feature (1)...(431): n = g, a, c or t

SEQ ID NO: 367 - DNA, 286 bp, Homo sapiens; identical to SEQ ID NO: 220
  misc_feature (1)...(286): n = g, a, c or t

SEQ ID NO: 368 - DNA, 536 bp, Homo sapiens; identical to SEQ ID NO: 221
  misc_feature (1)...(536): n = g, a, c or t

SEQ ID NO: 369 - DNA, 565 bp, Homo sapiens; identical to SEQ ID NO: 222
  misc_feature (1)...(565): n = g, a, c or t

SEQ ID NO: 370 - DNA, 402 bp, Homo sapiens
  misc_feature (1)...(402): n = g, a, c or t
ctgttgactcanattcggcattttaattacattgtttccaagtatgatattctgagagtgtctatagcacttagtgtctgcttcatataaactaccagttattatatatttatgatgcaagtanttttccaaatgtggngaaagtctgagtctttttatccccatgggtaaaatctgaatctggctctctgtgtctctcagtgcttgtttattgctggtcagagagtaaattcttgataaaanctgttgacttggctctcacagtttatgcagacattggagagacaatttggttatttcaaacatcacaggatttgagtaagaagacctggttatgaaacaaggctctcataattactagttatgactgttgacaagntaccttttcttgtttacaantta

SEQ ID NO: 371 - DNA, 346 bp, Homo sapiens
ctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattcaaaaaaaaaaaaaaaaaaaaaaaaaaagcttg

SEQ ID NO: 372 - DNA, 348 bp, Homo sapiens
cctacgacgaggaccggcttttcttcttcgacttttcccagaacactcgggtgccttgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcag

SEQ ID NO: 373 - DNA, 598 bp, Homo sapiens; identical to SEQ ID NO: 226

SEQ ID NO: 374 - DNA, 381 bp, Homo sapiens
cctgacacaatatccctgttcactttgaagtgaattttgactctatattcagaaccttcctttaacacaatggtttcctttttgagggcttccagatctccagtaaggtccatggtgattggtcccggggcactctcacaaaccagggtgagccgggtgacaacgacattgggggctttcggatctgtcaccacaggaccatctcccagcagcgttttcttgtacttaattagactctcatcatctttgtccatttcctgcagctctttcagggacttctgtggtggaggcttataattgagcttgctgtccagctcatcatcgtcatcctcctccacatgtggctctggggctttttcagtcattctgatctatttattc

SEQ ID NO: 375 - DNA, 573 bp, Homo sapiens; identical to SEQ ID NO: 245

SEQ ID NO: 376 - DNA, 612 bp, Homo sapiens; identical to SEQ ID NO: 227
  misc_feature (1)...(612): n = g, a, c or t

SEQ ID NO: 377 - DNA, 288 bp, Homo sapiens; identical to SEQ ID NO: 228
  misc_feature (1)...(288): n = g, a, c or t

SEQ ID NO: 378 - DNA, 584 bp, Homo sapiens; identical to SEQ ID NO: 231
  misc_feature (1)...(584): n = g, a, c or t

SEQ ID NO: 379 - DNA, 457 bp, Homo sapiens; identical to SEQ ID NO: 232

SEQ ID NO: 380 - DNA, 574 bp, Homo sapiens
ctgctgtaaccaggtttccccttgtgggaagtgttgtttcttgctgggcagttgggaagggaatggagaacagagaagagagtggaaatcacatgctcacttgaactttcctggggaacgtctcctcacagcgtacacaagagcctccctttagaaatggagtgttcattttatcatgggaaaagaatctgagtgggacatgattcagaacaggaccggcccaaggaagtgcaggggctgtggagtgggatggagacaagctctgaaaggacacatgggagatctagatgtagaaggtacacaagtagtaggataactcacaggatggatccactggaggttaagacatgtggtaagacagtgtaataggaagctgctcagttggagaaagtaaggaagcaaacattgttaccgtgggggcaatggagaggacagtgaggagccctttatcctgataagggtggctttgaggtaaaggaaggaaagaggatgccttgagaggccccactgtattagagaggacctggaagccaggatgctaattctggggagatggattccccaggcttactct

SEQ ID NO: 381 - DNA, 571 bp, Homo sapiens; identical to SEQ ID NO: 234
  misc_feature (1)...(571): n = g, a, c or t

SEQ ID NO: 382 - DNA, 471 bp, Homo sapiens
ccaccaccaatttcttcgaggatattcagtgtataccttctcattagctgccaaatcaaggccagtgtgagagtgcggtttccttcattgagatcttgtccaccgatgccaaccagggagaacttcgcttgattcttccccaattctaccgcgtagttacaattctcaagcttcttcatattgcctcccagtttggggtatggcggtttgtttactctgttccagtcaacaggaactttgatcttttcatagagctggaagatgaccagggcatctgataagtcactgtacaaatgattgactcgagggttaacacccagggagttcatccagttcctaaatgtccgctcttctctcgtctcaccttcaagagccccccagtcaatgtcctggttctctggtttgtgcagggcagggtatctgttaaagaggttggcaataaaagccaagttcaacttggggttccctcgg

SEQ ID NO: 383 - DNA, 489 bp, Homo sapiens; identical to SEQ ID NO: 235
  misc_feature (1)...(489): n = g, a, c or t

SEQ ID NO: 384 - DNA, 306 bp, Homo sapiens; identical to SEQ ID NO: 236

SEQ ID NO: 385 - DNA, 560 bp, Homo sapiens; identical to SEQ ID NO: 237
  misc_feature (1)...(560): n = g, a, c or t

SEQ ID NO: 386 - DNA, 186 bp, Homo sapiens
ctgtgccaaggtgctgaatcccatgactcgcagctctgtgccgcagccctggtagacctccgaggtgttgttgcacttctgctggcagaagtagatgccattgtcctcaaaccggatgccttggatggtgagggtggcgagagattcgttctgggactcttccatgcggcccttttccagcttcag

SEQ ID NO: 387 - DNA, 439 bp, Homo sapiens; identical to SEQ ID NO: 240
  misc_feature (1)...(439): n = g, a, c or t

SEQ ID NO: 388 - DNA, 320 bp, Homo sapiens
  misc_feature (1)...(320): n = g, a, c or t
ccacacagactcaccaagccacagacttgtcttccacaagcacgttcttacctcagccacgaagggaccaagccacacgtactaaaggttgaactcaaagatatgtacagggtattaaacaaatnccaaggggaacagntaacttgaatacaaggtcaaaatcagcaacaagntctacaatccagtgctgatatcaaatacaagcttcaaggacaatttcttttcgaaggcttattccantttcgngaggctagcatgaggtgtgngcatttgccaggggcaaatttctattctcaattaacccatgcagnaaatgctac

SEQ ID NO: 389 - DNA, 331 bp, Homo sapiens
ctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctacaaaaaaaaaaaaaaaaaaaaaaaaaaagg

SEQ ID NO: 390 - DNA, 391 bp, Homo sapiens
  misc_feature (1)...(391): n = g, a, c or t
ctttttttttttttttttttttttttngagttttnattatttgnggngctaaaaanaagggaacatggttggaggcccagtgaganaaacagtgntttgaatcaaagagcanaatgatagaaactgacttcanagcaacttnttggcagcagtatccaatttggaagttgaaggtctgtcctggagccagatgctaacgaaacacagcaaatgcttttcctaaggcacaatagtcttttcagngagctcaggaaccctgtttatgcanatcctcgnngaactttcttgctcctcctgtgcatgaagatgcccactccacanatgatgagccccagcacnaagcccccagctcccgtcaatgtcttactccgggcanaatcagactgngcct

SEQ ID NO: 391 - DNA, 462 bp, Homo sapiens
  misc_feature (1)...(462): n = g, a, c or t
ccttgcctcanatccaaggtcactcggaagaggccatgtctaccctcaatgacactcatggaggaaatgctganagangcattcagatgcatgacacaaggtaagactgccaaaaatcttgttcttgctctcctcattttgttatttgttttatttttaggagtttngagagcaaaatgacnacacccagaaattcagtaaatgggactttcccggcagaaccaatgaaaggccctattgctatgcaatctggtncaaaaccactcttnangaggatgtcttcactggtgggccccacncaaagcttcttcntgagggaatctaanactttgggggctgnccagattatnaatgggctcttccacattgccctggggggtcttntgatgatcccancngggatctatgcacccatctgtgtgactgtgtggtnccctctctggggaggcattatgtatatta

SEQ ID NO: 392 - DNA, 554 bp, Homo sapiens
  misc_feature (1)...(554): n = g, a, c or t
aaagcgaattcatactataacagcagaaacaaaacttcagatttcagaatttgttattggcaaaatttattctcattatacctgcttcatatgggtatattactattaaaacagaataccatagagtaattgcattatttgaaaattctntcattttacaatgcacttcaccaatgaaacagntaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttcccacattcagagttccagtcattattgttacatcatgtttgcagaaaccttgtcttatttagtgtctatttgcatataaccctgaaaacattattatttgaaaacttttctatatctcaaattaatatacattttcataacctacctttgnattaagacttgcaattttatcaatctattat

SEQ ID NO: 393 - DNA, 555 bp, Homo sapiens
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgttgacttggctcccacagtttatgcagacattggagagacaatttggttatttcaaacatcacaggatttgagtaagaagacctggttatgaaacaaggctctcataattactagttatgactgttgacaagttaccttttcttgtttacaagttatttggcctctttgaattacttgtaaaatagagatagggattctttcttgatcatggaacatcaaatgaagttatttgatgaaatactttgtcatctggaaattataaatataactaaatgttaattattatttgaaatttgggcacctcatgg

SEQ ID NO: 394 - DNA, 340 bp, Homo sapiens; identical to SEQ ID NO: 325

SEQ ID NO: 395 - DNA, 482 bp, Homo sapiens
aaaaaaacagaacatttacaagacaccagttattttgtgccccatatgtcattaaaaaagtttactttacctttattattatttccctaggctagtcaagcagcaaaccattaatcggtcggagaaaccttcatgacatatgcccgactggctcttcgccacccacttgaaggacactacccaatcgatggaagcctttaatcgcacagccctccctattagcggactattggcggatgcagacatgttctactcgagcagttaccaaggaccactttactgcgatcaggattccaacgaccacctaatttcgtatctttcaactcttttcgaccggacctcttattcggaagcgttacaggaagacaggtctcaacttagggatcagatcacgttatcaacgctctgggatcgctgcaacctggcacttcaaggaagtgcaccgataacgtctagaccggcaaacacagatctagaggtgg

SEQ ID NO: 396 - DNA, 448 bp, Homo sapiens
gaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacag

SEQ ID NO: 397 - DNA, 573 bp, Homo sapiens; identical to SEQ ID NO: 245

SEQ ID NO: 398 - DNA, 340 bp, Homo sapiens; identical to SEQ ID NO: 325

SEQ ID NO: 399 - DNA, 593 bp, Homo sapiens; identical to SEQ ID NO: 247

SEQ ID NO: 400 - DNA, 504 bp, Homo sapiens
aaatcctgagtcaagccaaaaaaaaaaaaaaaaaccaaaacaaaacaaaaaaaacaaataaagccatgccaatctcatcttgttttctgcgcaagttaggttttgtcaagaaagggtgtaacgcaactaagtcatagtccgcctagaagcatttgcggtggacgatggaggggccggactcgtcatactcctgcttgctgatcacatctgctggaaggtggacagcgaggccaggatggagccgccgatccacacggagtacttgcgctcaggaggagcaatgatcttgatcttcattgtgctgggtgccagggcagtgatctccttctgcatcctgtcggcaatgccagggtacatggtggtgccgccagacagcactgtgttggcgtacaggtctttgcggatgtccacgtcacacttcatgatggagttgaaggtagtttcgtggatgccacaggactccatgcccaggaaggaaggctggaagagtgcctcagggcagcg

SEQ ID NO: 401 - DNA, 608 bp, Homo sapiens; identical to SEQ ID NO: 249

SEQ ID NO: 402 - DNA, 588 bp, Homo sapiens
ctgggccaggagctgtgcccagtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacatt

SEQ ID NO: 403 - DNA, 425 bp, Homo sapiens; identical to SEQ ID NO: 252

SEQ ID NO: 404 - DNA, 603 bp, Homo sapiens
  misc_feature (1)...(603): n = g, a, c or t
ctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggntgnattagatgttctctatcatttaataatatacttgnggactaaaagatataagtgctgnataaaatcagccaattatgttaaactagcat

SEQ ID NO: 405 - DNA, 603 bp, Homo sapiens; identical to SEQ ID NO: 253

SEQ ID NO: 406 - DNA, 578 bp, Homo sapiens
ctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgcttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccaca

SEQ ID NO: 407 - DNA, 568 bp, Homo sapiens; identical to SEQ ID NO: 255

SEQ ID NO: 408 - DNA, 125 bp, Homo sapiens
  misc_feature (1)...(125): n = g, a, c or t
ctggggggtccaggaaaggggttgggccatgagccaggcagctccgaagcagtcactgaggccagggagcctgcacccagnncatgggncgaccnggctctcactcctggcctgggtgctcacct

SEQ ID NO: 409 - DNA, 291 bp, Homo sapiens
ccagtgcttagacaaatttggggttggggggaacactttggtttgaaagcacagagcagtttgccatgtttcttctgtgcctaccattctcccttggcctcaacttctgtaagatgggggggggacaaaaagagaagtaaagttaagaagaaagtggaaaattaaaaaaaagatgtcaaagtttttacatgcatatatttcagcttatgctgaagacctacctgtatgttgcacattgaatcatactttcagaacccctcagaaaccatccctctctccctaaagaatttt

SEQ ID NO: 410 - DNA, 231 bp, Homo sapiens; identical to SEQ ID NO: 259

SEQ ID NO: 411 - DNA, 406 bp, Homo sapiens
cctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttacctcggccg

SEQ ID NO: 412 - DNA, 278 bp, Homo sapiens; identical to SEQ ID NO: 260

SEQ ID NO: 413 - DNA, 284 bp, Homo sapiens
ccgggcaggtctggaagccttgttggcccctaagcctttgtttcatgctacagtactgaggggtatgtgtccccaatgcacagccacccgcacacaactcaatgagcttcctgggaaacactattcccccacctccaccttaggtggctgcctcagttttccaaccactggaatcagtccctcagctcctgcctctagtctccaccccaaaagttcagtcgtctctgtcttggagggcactgtcggccccctcaggttgaagttcaacactcctcaatgagcag

SEQ ID NO: 414 - DNA, 288 bp, Homo sapiens
aaaaatacagcttttattctgagacattgaccttcactagagtgggacctgtggccccagcctggctggagaagcagtccagggcctgagtgacaccatttccctttcctgaaataggaacaagttattccaaaggagaaaggagagcccagagagatctgtacaggacctctcttgcacatggtgactggaggcagagggtggggagctggagaggagtccagtccctccaacaaatattgagggcttcaaagagctcttcctggacgtttctcttaatctggattt

SEQ ID NO: 415 - DNA, 348 bp, Homo sapiens
  misc_feature (1)...(348): n = g, a, c or t
ccaaaagaagtaagacagcttgctgaagatttcctgaaagactatattcatataaacattggtgcacttgaactgagtgcaaaccacaacattcttcagattgtggatgtgtgtcatgacntanaaaaggatgaaaaacttattngtctaatggaagagatcatgagtgagaaggagaataaaaccattgtttttgtggaaaccaaaagaagatgtgatgagcttaccagaaaaatgaggagagatgggtggcctgccatgggtatccatggngacaagagtcaacaagagcgtgactgggctctaaatgaatccaaacatggaaaagctcctattctgattnctaca

SEQ ID NO: 416 - DNA, 284 bp, Homo sapiens
  misc_feature (1)...(284): n = g, a, c or t
ggcggcaagatggcagtgcaaatatccaagaagaggaagtttgtcgctgatggcatcttcaaagctgaactgaatgagtttcttactcgggagctggctgaagatggctactctggagttgagggtgcgagttacaccaaccaggacagaaatcattatcttanccaccagaacacanaatgttcttggtgagaagggccggcggattcgggaactgactgctgtagttcagaagaggtttggctttccagagggcagtgtagagctttatgctnaaaaggtgg

SEQ ID NO: 417 - DNA, 212 bp, Homo sapiens
ccaatgtggttggtcttcagcttgcagttagccaggttccataccttgaccagcttgtcccagccacaggagacgatgatagggttgctgctgttgggcgagaagcggacacaagacacccactctgagtggctctcatcctggacagtgtatttgcacacacccagggtattccatagcttgatggttttatctcgagatccaaaaacaat

SEQ ID NO: 418 - DNA, 285 bp, Homo sapiens
cctttccttgagctgcacgtgaacctgtgtgggcaggcagcgtttgcaggcgtgtttacgggcaggcagcgtttgcaggcgtgtttaccggcaggcagcgtttgcaggcgtgtttacatgcaggcgtagcaccatgtgagaccactggtccagggtttcagaggtcctgctcaggtgaatcggctgtgttctcacaagttcacggagctgagtgggtgtgcaacatgaaatactagtgctgtgagggacagaaaggacagaaagaggctgaagaccatcatccag

SEQ ID NO: 419 - DNA, 271 bp, Homo sapiens
ggtggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgta

SEQ ID NO: 420 - DNA, 287 bp, Homo sapiens; identical to SEQ ID NO: 263

SEQ ID NO: 421 - DNA, 286 bp, Homo sapiens
ccagagcggtgagtcccaccacctcgaactctgggaattcgagccacagctctgccagtaccccaagactcagcactagtctgatgacctgctaattcactgacagcatagggctgtctgttgtttttgcgcaagttggtgtgaacaaagttcacaatatctggtcgaataggagccttgaatacagcaggcaaagtgacatttttgccagatgactcccccttttcggagtacaccgatatcagtgggcgagcacacgccatggcggagagaggagacagccacg

SEQ ID NO: 422 - DNA, 306 bp, Homo sapiens; identical to SEQ ID NO: 264

SEQ ID NO: 423 - DNA, 242 bp, Homo sapiens; identical to SEQ ID NO: 265

SEQ ID NO: 424 - DNA, 132 bp, Homo sapiens; identical to SEQ ID NO: 266

SEQ ID NO: 425 - DNA, 414 bp, Homo sapiens; identical to SEQ ID NO: 268

SEQ ID NO: 426 - DNA, 101 bp, Homo sapiens
  misc_feature (1)...(101): n = g, a, c or t
ctgtgattctccactgaaattttttttttaagggagctcaaggtcacaagaagaaatgaaaggaacaatcagcagccctgttcanaaggnggtttgaagac

SEQ ID NO: 427 - DNA, 353 bp, Homo sapiens
gtttcagccgaaggactcttctattcggaagtacaccctcactattaggaagattcttaggggtaatttttctgaggaaggaggactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagccgccatcaggtattttaagctaaacttcttcacccctgagagcatgtcag

SEQ ID NO: 428 - DNA, 104 bp, Homo sapiens
  misc_feature (1)...(104): n = g, a, c or t
tatttaaaaactcaacaggacctacactacntgttcaaatctgtaatctttcacaccncactaacaaagttnttaggaaaacaggactacccaaanatgttacc

SEQ ID NO: 429 - DNA, 471 bp, Homo sapiens
  misc_feature (1)...(471): n = g, a, c or t
ccaaaaaanntcaagattnnntttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaagtaaaaagaaattgcatcacactaattacaaaatacaagttctggaaaaaatatttttcttcattttaaaacttttttaactaataatggctttgaaagaagaggcttaatttgggggtggtaactaaaatcaaaagaaatgattgacttgagggtctctgtttggtaaaaatacatcattagcttaaataagcagcagaaggttagttttaattatgtancttctgtnaatattaagtgtt

SEQ ID NO: 430 - DNA, 395 bp, Homo sapiens
  misc_feature (1)...(395): n = g, a, c or t
aggcgacnnggtaggggnnggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttgg

SEQ ID NO: 431 - DNA, 303 bp, Homo sapiens
  misc_feature (1)...(303): n = g, a, c or t
caggcatgaaaaaatgacaagaattttaaaacaagggcatcatttgatctttaaatatgactattttctttaaaaacgatggattttgaccaacctagatgtacaccatagtttatagatcaaataaaagctattaaaaatatcttaacttnttacaaatgttagcagtctttgtgtgcagtattagagatcagagttgtgattgtttctgagcatgtcttgtgggttataactatgttttcaattaaaattataagattgagatactttctggaagatgtatagaaaatgttgntatattca

SEQ ID NO: 432 - DNA, 477 bp, Homo sapiens
  misc_feature (1)...(477): n = g, a, c or t
tttttttnnttttttttnntaaaanaaggattttaggtttntttggngaaacaaaagcagatataaaaagttacaaagattttanattttcattcacaaaaaaagtcattcacattttacactatacacgttatgatataaatacaggaaagtattatgtgcattgtaaagagaaaggaaaaatagaaacctactagatcaacacagngttgttctgtgctctaaaatacctaaaggnggattacatttaatgcaacaaccaagggaacctgcttaaacatactgngtattattgtagctagagtcattccttctaagccaaaggaggttttataaaaaanaatcaatattgggccaatccctttgngccctttttctctttttctatgngcattttattttttgnctactcttcttcaagttgctctaaactgaaattagggaaggagtctcactttccnttanaggtttttcttt

SEQ ID NO: 433 - DNA, 566 bp, Homo sapiens
ccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacc

SEQ ID NO: 434 - DNA, 384 bp, Homo sapiens
  misc_feature (1)...(384): n = g, a, c or t
ccacaggggaaggcaagaggcgatagctgggggtcacttgtcactagatggaagctccttggtccacacagtcccaaagaaaggtctgcctttgggcccacgaaacccatcccagccctcacaggctgaacctcaccctgggttttcccagagaggtgcccaagaagacccaagctgccccaagtcagaggagcagcaggaaacagcctcagaagtccgtcactcttcagtactcctcccttagaatgtccacttcctgtttggtgaccatggcaaccaaaagacaatggcagtgcagtgcgtgtgggatgggggagctccatcttccttgggtacatggggaggagactccagtgaccangagaagcggggagagccatggga

SEQ ID NO: 435 - DNA, 468 bp, Homo sapiens
  misc_feature (1)...(468): n = g, a, c or t
ctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcanaagttgagatttaacaataaaaggtgttactttgataactaaaaggaactttattatcctcttcctaaaa

SEQ ID NO: 436 - DNA, 124 bp, Homo sapiens
  misc_feature (1)...(124): n = g, a, c or t
gtagggttgccagatgcnntacaanatttctggttaaatttgaatttcagtaaacaatgaatagtttttcattgtaccatgaaatatccaaaacatacttatatgtnaagtattatttatttgn

SEQ ID NO: 437 - DNA, 126 bp, Homo sapiens; identical to SEQ ID NO: 348
  misc_feature (1)...(126): n = g, a, c or t

SEQ ID NO: 438 - DNA, 612 bp, Homo sapiens; identical to SEQ ID NO: 227
  misc_feature (1)...(612): n = g, a, c or t

SEQ ID NO: 439 - DNA, 330 bp, Homo sapiens; identical to SEQ ID NO: 2

SEQ ID NO: 440 - DNA, 472 bp, Homo sapiens; identical to SEQ ID NO: 283
  misc_feature (1)...(472): n = g, a, c or t

SEQ ID NO: 441 - DNA, 349 bp, Homo sapiens; identical to SEQ ID NO: 284
  misc_feature (1)...(349): n = g, a, c or t

SEQ ID NO: 442 - DNA, 179 bp, Homo sapiens; identical to SEQ ID NO: 285
  misc_feature (1)...(179): n = g, a, c or t

SEQ ID NO: 443 - DNA, 170 bp, Homo sapiens; identical to SEQ ID NO: 15

SEQ ID NO: 444 - DNA, 342 bp, Homo sapiens
  misc_feature (1)...(342): n = g, a, c or t
ngtctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcaccctnaggacatttaatcngagaacctcctgtngaattttgtgggagacacttg

SEQ ID NO: 445 - DNA, 387 bp, Homo sapiens; identical to SEQ ID NO: 20

SEQ ID NO: 446 - DNA, 279 bp, Homo sapiens; identical to SEQ ID NO: 289
  misc_feature (1)...(279): n = g, a, c or t

SEQ ID NO: 447 - DNA, 235 bp, Homo sapiens; identical to SEQ ID NO: 290
  misc_feature (1)...(235): n = g, a, c or t

SEQ ID NO: 448 - DNA, 292 bp, Homo sapiens; identical to SEQ ID NO: 29

SEQ ID NO: 449 - DNA, 318 bp, Homo sapiens; identical to SEQ ID NO: 291
  misc_feature (1)...(318): n = g, a, c or t

SEQ ID NO: 450 - DNA, 317 bp, Homo sapiens; identical to SEQ ID NO: 294

SEQ ID NO: 451 - DNA, 156 bp, Homo sapiens; identical to SEQ ID NO: 40
  misc_feature (1)...(156): n = g, a, c or t

SEQ ID NO: 452 - DNA, 345 bp, Homo sapiens; identical to SEQ ID NO: 298
  misc_feature (1)...(345): n = g, a, c or t

SEQ ID NO: 453 - DNA, 182 bp, Homo sapiens; identical to SEQ ID NO: 299
  misc_feature (1)...(182): n = g, a, c or t

SEQ ID NO: 454 - DNA, 440 bp, Homo sapiens; identical to SEQ ID NO: 300

SEQ ID NO: 455 - DNA, 396 bp, Homo sapiens; identical to SEQ ID NO: 301
  misc_feature (1)...(396): n = g, a, c or t

SEQ ID NO: 456 - DNA, 232 bp, Homo sapiens; identical to SEQ ID NO: 303

SEQ ID NO: 457 - DNA, 232 bp, Homo sapiens; identical to SEQ ID NO: 57

SEQ ID NO: 458 - DNA, 342 bp, Homo sapiens; identical to SEQ ID NO: 306

SEQ ID NO: 459 - DNA, 545 bp, Homo sapiens; identical to SEQ ID NO: 307

SEQ ID NO: 460 - DNA, 330 bp, Homo sapiens; identical to SEQ ID NO: 308

SEQ ID NO: 461 - DNA, 118 bp, Homo sapiens; identical to SEQ ID NO: 311
  misc_feature (1)...(118): n = g, a, c or t

SEQ ID NO: 462 - DNA, 310 bp, Homo sapiens
  misc_feature (1)...(310): n = g, a, c or t
atgttgggagccatcaatcaggaaagccgggttagtaaagcagttgaagtgatgattcagcacgtanaaaacttgaagaggatgtatgccaaanagcacgcttgaattagaagaactgaaacaggttcttctgcataatgaaaggtctttcaatcctcttgaagatgatgatgactgccaaattaaaaaacgtccagcttctctaaactccaagccatcttctctacgaagagtgactattgcctctttacccanaaatattggaaatgcaggaatggtggctgggatggaaaataatgatccgattcnn

SEQ ID NO: 463 - DNA, 133 bp, Homo sapiens; identical to SEQ ID NO: 312
  misc_feature (1)...(133): n = g, a, c or t

SEQ ID NO: 464 - DNA, 182 bp, Homo sapiens; identical to SEQ ID NO: 317
  misc_feature (1)...(182): n = g, a, c or t

SEQ ID NO: 465 - DNA, 149 bp, Homo sapiens; identical to SEQ ID NO: 80
  misc_feature (1)...(149): n = g, a, c or t

SEQ ID NO: 466 - DNA, 374 bp, Homo sapiens; identical to SEQ ID NO: 83

SEQ ID NO: 467 - DNA, 545 bp, Homo sapiens; identical to SEQ ID NO: 307

SEQ ID NO: 468 - DNA, 285 bp, Homo sapiens; identical to SEQ ID NO: 321

SEQ ID NO: 469 - DNA, 135 bp, Homo sapiens; identical to SEQ ID NO: 322

SEQ ID NO: 470 - DNA, 511 bp, Homo sapiens
ccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctga

SEQ ID NO: 471 - DNA, 562 bp, Homo sapiens
  misc_feature (1)...(562): n = g, a, c or t
ctgagacaaaagtaggcccaaatccttccacagggatggaatgatgctgccagttcactgtcagcatgggtgggaagagattactgacaaaacagaccaaagtgttgggcttgccaaactccaggggcttcagcgtgaacacttcagcgataggaaaccctggtggggggattgaagtgtagggggaaaaagagactagtttagatggtatctctgtgtttggaggggccatggcatatggaggggagggcagagaagaacacagtgggtcaggctttgggagacagagatgagcgaggagctgggctctgaagggaggtcttcttccaggcaaggactgcanctagacgtagaagcagagccagatccaggctactctggacccctccaccatgacttccttcagcacttcctgtctagagctcacattgatgtctaaccatgcactgtcttctcactaagacatagtcacgtcatcagatatttccactcttcccatccatcttgctgggcatagtagcacaagtgttaatattcagtangtatcagttggtacctgttg

SEQ ID NO: 472 - DNA, 487 bp, Homo sapiens; identical to SEQ ID NO: 135
  misc_feature (1)...(487): n = g, a, c or t

SEQ ID NO: 473 - DNA, 340 bp, Homo sapiens; identical to SEQ ID NO: 325

SEQ ID NO: 474 - DNA, 542 bp, Homo sapiens; identical to SEQ ID NO: 331
  misc_feature (1)...(542): n = g, a, c or t

SEQ ID NO: 475 - DNA, 342 bp, Homo sapiens; identical to SEQ ID NO: 306

SEQ ID NO: 476 - DNA, 421 bp, Homo sapiens; identical to SEQ ID NO: 172
  misc_feature (1)...(421): n = g, a, c or t

SEQ ID NO: 477 - DNA, 562 bp, Homo sapiens; identical to SEQ ID NO: 346

SEQ ID NO: 478 - DNA, 294 bp, Homo sapiens; identical to SEQ ID NO: 349

SEQ ID NO: 479 - DNA, 237 bp, Homo sapiens; identical to SEQ ID NO: 206

SEQ ID NO: 480 - DNA, 563 bp, Homo sapiens; identical to SEQ ID NO: 352

SEQ ID NO: 481 - DNA, 340 bp, Homo sapiens; identical to SEQ ID NO: 354
  misc_feature (1)...(340): n = g, a, c or t

SEQ ID NO: 482 - DNA, 353 bp, Homo sapiens; identical to SEQ ID NO: 212

SEQ ID NO: 483 - DNA, 202 bp, Homo sapiens; identical to SEQ ID NO: 358
  misc_feature (1)...(202): n = g, a, c or t

SEQ ID NO: 484 - DNA, 306 bp, Homo sapiens
aaaaacaatctacaggcagttctttacaagtctcatatttacagatagcacaagctatggcatggcgtatggcctccctcctaaatatacgattctttggcatattggaattggtcagcctcaaagaccggctggctacatcgtcgcacgagacagtcccgcttattcctctgcacggactcggagacggtcctcagcgggaggagctcaggtctccctgggccagacacgtgccccagagagtccccagaagcatggacagttctgctctgtttccatcgctcaggcaggggagagagtccgtgg

SEQ ID NO: 485 - DNA, 396 bp, Homo sapiens; identical to SEQ ID NO: 217
  misc_feature (1)...(396): n = g, a, c or t

SEQ ID NO: 486 - DNA, 253 bp, Homo sapiens; identical to SEQ ID NO: 362
  misc_feature (1)...(253): n = g, a, c or t

SEQ ID NO: 487 - DNA, 374 bp, Homo sapiens; identical to SEQ ID NO: 365
  misc_feature (1)...(374): n = g, a, c or t

SEQ ID NO: 488 - DNA, 529 bp, Homo sapiens; identical to SEQ ID NO: 223

SEQ ID NO: 489 - DNA, 402 bp, Homo sapiens; identical to SEQ ID NO: 370
  misc_feature (1)...(402): n = g, a, c or t

SEQ ID NO: 490 - DNA, 556 bp, Homo sapiens
gtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagccttta

SEQ ID NO: 491 - DNA, 381 bp, Homo sapiens; identical to SEQ ID NO: 374

SEQ ID NO: 492 - DNA, 573 bp, Homo sapiens; identical to SEQ ID NO: 245

SEQ ID NO: 493 - DNA, 288 bp, Homo sapiens; identical to SEQ ID NO: 228
  misc_feature (1)...(288): n = g, a, c or t

SEQ ID NO: 494 - DNA, 574 bp, Homo sapiens; identical to SEQ ID NO: 380

SEQ ID NO: 495 - DNA, 471 bp, Homo sapiens; identical to SEQ ID NO: 382

SEQ ID NO: 496 - DNA, 489 bp, Homo sapiens; identical to SEQ ID NO: 235
  misc_feature (1)...(489): n = g, a, c or t

SEQ ID NO: 497 - DNA, 306 bp, Homo sapiens; identical to SEQ ID NO: 236

SEQ ID NO: 498 - DNA, 345 bp, Homo sapiens
  misc_feature (1)...(345): n = g, a, c or t
ccaatgtggttggtcttcagcttgcagttagccaggttccataccttgaccagcttgtcccagccacaggagacgatgatagggttgctgctgttgggcgagaagcggacacaagacacccactctgagtggctctcatcctggacagtgtatttgcacacacccagggtattccatagcttgatggttttatctcgagatccanagacaatctgccggttgtcagaggagaaggccacactcancacatccttggcatggcccacaaatcgnctngtggtggtgcccgttgtgagatcccagaggcgcagggttccatcccaggagcctgagagggcaaactgg

SEQ ID NO: 499 - DNA, 555 bp, Homo sapiens; identical to SEQ ID NO: 393

SEQ ID NO: 500 - DNA, 340 bp, Homo sapiens; identical to SEQ ID NO: 325

SEQ ID NO: 501 - DNA, 482 bp, Homo sapiens; identical to SEQ ID NO: 395

SEQ ID NO: 502 - DNA, 448 bp, Homo sapiens; identical to SEQ ID NO: 396

SEQ ID NO: 503 - DNA, 573 bp, Homo sapiens; identical to SEQ ID NO: 245

SEQ ID NO: 504 - DNA, 340 bp, Homo sapiens; identical to SEQ ID NO: 325

SEQ ID NO: 505 - DNA, 593 bp, Homo sapiens; identical to SEQ ID NO: 247

SEQ ID NO: 506 - DNA, 425 bp, Homo sapiens; identical to SEQ ID NO: 252

SEQ ID NO: 507 - DNA, 603 bp, Homo sapiens; identical to SEQ ID NO: 253

SEQ ID NO: 508 - DNA, 578 bp, Homo sapiens; identical to SEQ ID NO: 406

SEQ ID NO: 509 - DNA, 568 bp, Homo sapiens; identical to SEQ ID NO: 255

SEQ ID NO: 510 - DNA, 125 bp, Homo sapiens; identical to SEQ ID NO: 408
  misc_feature (1)...(125): n = g, a, c or t

SEQ ID NO: 511 - DNA, 231 bp, Homo sapiens; identical to SEQ ID NO: 259

SEQ ID NO: 512 - DNA, 278 bp, Homo sapiens; identical to SEQ ID NO: 260

SEQ ID NO: 513 - DNA, 288 bp, Homo sapiens; identical to SEQ ID NO: 414

SEQ ID NO: 514 - DNA, 284 bp, Homo sapiens; identical to SEQ ID NO: 416
  misc_feature (1)...(284): n = g, a, c or t

SEQ ID NO: 515 - DNA, 211 bp, Homo sapiens
  misc_feature (1)...(211): n = g, a, c or t
ctgtctcacactttacaagctgtgagagacacatcagagccctgggcactgtcactgcttgcagcctgagagtagctccctccttttctatctgagctgttcctcctccacatcacagcagcgaccacagctccagtgatcacagctccaaggagaaccaggccagcaatgatgcccacgatggggacggtgggctgggaaganggctccn

SEQ ID NO: 516 - DNA, 212 bp, Homo sapiens; identical to SEQ ID NO: 417

SEQ ID NO: 517 - DNA, 272 bp, Homo sapiens; identical to SEQ ID NO: 261

SEQ ID NO: 518 - DNA, 285 bp, Homo sapiens; identical to SEQ ID NO: 418

SEQ ID NO: 519 - DNA, 287 bp, Homo sapiens; identical to SEQ ID NO: 263

SEQ ID NO: 520 - DNA, 286 bp, Homo sapiens; identical to SEQ ID NO: 421

SEQ ID NO: 521 - DNA, 242 bp, Homo sapiens; identical to SEQ ID NO: 265

SEQ ID NO: 522 - DNA, 132 bp, Homo sapiens; identical to SEQ ID NO: 266

SEQ ID NO: 523 - DNA, 414 bp, Homo sapiens; identical to SEQ ID NO: 268

SEQ ID NO: 524 - DNA, 104 bp, Homo sapiens; identical to SEQ ID NO: 428
  misc_feature (1)...(104): n = g, a, c or t

SEQ ID NO: 525 - DNA, 423 bp, Homo sapiens; identical to SEQ ID NO: 275

SEQ ID NO: 526 - DNA, 478 bp, Homo sapiens; identical to SEQ ID NO: 277

SEQ ID NO: 527 - DNA, 384 bp, Homo sapiens
cctgacacaatatccctgttcactttgaagtgaattttgactctatattcagaaccttcctttaacacaatggtttcctttttgagggcttccagatctccagtaaggtccatggtgattggtcccggggcactctcacaaaccagggtgagccgggtgacaacgacattgggggctttcggatctgtcaccacaggaccatctcccagcagcgttttcttgtacttaattagactctcatcatctttgtccatttcctgcagctctttcagggacttctgtggtggaggcttataattgagcttgctgtccagctcatcatcgtcatcctcctccacatgtggctctggggctttttcagtcattctgatctatttattcagt

SEQ ID NO: 528 - DNA, 208 bp, Homo sapiens; identical to SEQ ID NO: 278

SEQ ID NO: 529 - DNA, 330 bp, Homo sapiens; identical to SEQ ID NO: 2

SEQ ID NO: 530 - DNA, 294 bp, Homo sapiens; identical to SEQ ID NO: 280

SEQ ID NO: 531 - DNA, 269 bp, Homo sapiens; identical to SEQ ID NO: 4

SEQ ID NO: 532 - DNA, 197 bp, Homo sapiens
cctgaacaaggacctctgccctccctattcagacccttcgttgcctcacctggtcaatacaaccacttcacctctgaccgcaggggcaggggactagatagaatgacctactgagcctcgtctgtctgtctgtctgtctgtctctctctctctgtttgtctctttgtgtgtccgacaagaacccagactgagggggc

SEQ ID NO: 533 - DNA, 364 bp, Homo sapiens; identical to SEQ ID NO: 9
  misc_feature (1)...(364): n = g, a, c or t

SEQ ID NO: 534 - DNA, 382 bp, Homo sapiens; identical to SEQ ID NO: 10
  misc_feature (1)...(382): n = g, a, c or t

SEQ ID NO: 535 - DNA, 349 bp, Homo sapiens; identical to SEQ ID NO: 284
  misc_feature (1)...(349): n = g, a, c or t

SEQ ID NO: 536 - DNA, 170 bp, Homo sapiens; identical to SEQ ID NO: 15

SEQ ID NO: 537 - DNA, 387 bp, Homo sapiens; identical to SEQ ID NO: 20

SEQ ID NO: 538 - DNA, 533 bp, Homo sapiens; identical to SEQ ID NO: 43
  misc_feature (1)...(533): n = g, a, c or t

SEQ ID NO: 539 - DNA, 332 bp, Homo sapiens; identical to SEQ ID NO: 44

SEQ ID NO: 540 - DNA, 375 bp, Homo sapiens; identical to SEQ ID NO: 50

SEQ ID NO: 541 - DNA, 443 bp, Homo sapiens
ccatttgactaaccagtcctacaaatttcacatatccgtcactcagatgagcatataccaagtcagaggaaacaaaacatgcacatatacaaaagtagaaagagaaaacactcatgccttcagaagttcacaaattaaaagccctttaataatataaaacagttgaacactggaatgtttttttctaggtcatgaaaaaagtgaattccaaatctatgtaataaatctaaaataatacagcatcactgtcttctgttctggtgtttatcaaacctgcacatgagtttttagaaggtgaattggggatgcttcagaatgtattttctccaaacagatggagcctgaaaactgtgtgattttccaaaccaagtggagaaaagcaggaagaaattggtgtttagctggtcagcagacggggatccccgggatgcaatcagccttgg

SEQ ID NO: 542 - DNA, 232 bp, Homo sapiens; identical to SEQ ID NO: 57

SEQ ID NO: 543 - DNA, 392 bp, Homo sapiens; identical to SEQ ID NO: 67
  misc_feature (1)...(392): n = g, a, c or t

SEQ ID NO: 544 - DNA, 371 bp, Homo sapiens; identical to SEQ ID NO: 74

SEQ ID NO: 545 - DNA, 187 bp, Homo sapiens
  misc_feature (1)...(187): n = g, a, c or t
gacctgctcggaggaatggcgccgccgggttcaagcactgtcttcctgttggccctgacaatcatagccagcacctgggctctgacgcccactcactacctcaccaagcatgacgnggagagactaaaagcctcgctggatccgccctttcacaaagttggaagtctngtcttctactccatcntgg

SEQ ID NO: 546 - DNA, 558 bp, Homo sapiens
  misc_feature (1)...(558): n = g, a, c or t
ccatgggatggctcttctgaccattgggggccaggccaggccaggccaggcttagggcagcaaggaccaggccaaaggggcagggcctcctttggaggggttgaggggtacatcctcggctggtgtttgcatccaggggtccagcaggatctcttccagtgagggtcgggaagaaggtttgggggccaggcaccggcggattagggcacagcaatcttggggaaaacatgggcttgggaagtggagctcagcttccagaatctcctggtccctctcaaagggaatgtccccacacaccatgtcatagaggaggatgcccagtgaccagacagtggccgggagtgcatggtactggtgtcgagagatccactctggggggctgtacacccttgtcccatcaaagtcagtgtagggttcatcatgaagcagggcaccagaaccaaaatcaatgagtttggcacagccacggcgtaggtctatcaggatgntctcatccttgatgtcacgatggacaactncacgggaaatggcagtgctggatggctgccactactttgg

SEQ ID NO: 547 - DNA, 357 bp, Homo sapiens; identical to SEQ ID NO: 84

SEQ ID NO: 548 - DNA, 260 bp, Homo sapiens
  misc_feature (1)...(260): n = g, a, c or t
ccaagtagtggcanccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctnctctatgacatgg

SEQ ID NO: 549 - DNA, 366 bp, Homo sapiens; identical to SEQ ID NO: 105
  misc_feature (1)...(366): n = g, a, c or t

SEQ ID NO: 550 - DNA, 368 bp, Homo sapiens; identical to SEQ ID NO: 136

SEQ ID NO: 551 - DNA, 539 bp, Homo sapiens
ccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccgg

SEQ ID NO: 552 - DNA, 529 bp, Homo sapiens
  misc_feature (1)...(529): n = g, a, c or t
aaatcctgagtcaagccaaaaaaaaaaaaaccaaaacaaaacaaaaaaaacaaataaagccatgccaatctcatcttgttttctgcgcaagttaggttttgtcaagaaagggtgtaacgcaactaagtcatagtccgcctagaagcatttgcggtggacgatggaggggccggactcgtcatactcctgcttgctgatccacatctgctggaaggtggacagcgaggccaggatggagccgccgatccacacggagtacttgcgctcaggaggagcaatgatcttgatcttcattgngctgggtgccagggcagngatctccttctgcatcctgtcggnaatgccagggtacatggtggtgccgccagacagcactgngttggcgtacaggtctttgcggatgtccacgtcacacttcatgatggagttgaaggtagtttcgtggatgccacaggactccatgcccaggaaggaaggctgnaanagtgcctcagggcagcggaaccgctcattgccaatggtgatgacc

SEQ ID NO: 553 - DNA, 375 bp, Homo sapiens; identical to SEQ ID NO: 161

SEQ ID NO: 554 - DNA, 193 bp, Homo sapiens; identical to SEQ ID NO: 166
  misc_feature (1)...(193): n = g, a, c or t

SEQ ID NO: 555 - DNA, 421 bp, Homo sapiens; identical to SEQ ID NO: 172
  misc_feature (1)...(421): n = g, a, c or t

SEQ ID NO: 556 - DNA, 372 bp, Homo sapiens; identical to SEQ ID NO: 175

SEQ ID NO: 557 - DNA, 119 bp, Homo sapiens; identical to SEQ ID NO: 185
  misc_feature (1)...(119): n = g, a, c or t

SEQ ID NO: 558 - DNA, 375 bp, Homo sapiens; identical to SEQ ID NO: 50

SEQ ID NO: 559 - DNA, 130 bp, Homo sapiens; identical to SEQ ID NO: 197
  misc_feature (1)...(130): n = g, a, c or t

SEQ ID NO: 560 - DNA, 464 bp, Homo sapiens; identical to SEQ ID NO: 200
  misc_feature (1)...(464): n = g, a, c or t

SEQ ID NO: 561 - DNA, 332 bp, Homo sapiens; identical to SEQ ID NO: 347

SEQ ID NO: 562 - DNA, 237 bp, Homo sapiens; identical to SEQ ID NO: 206

SEQ ID NO: 563 - DNA, 443 bp, Homo sapiens
aaactcattgattaaataatgattaatgcattctccacattttaatattgcaaaggcccattggagtttctgaagtggctccacagaattgaaataatttcaaataactgtaaaggaactgaaaatcttcacagagatgaagtggggtttccattaggtgctttgaaatttgataacaaatcatcaacttccactggtcaatatatagattttgggtgtctgaggccccaagattagatgccactaatctccaaagattccctccaattatgaaatattttaatgtctacttttagagagcactagccagtatatgaccatgtgattaatttcttttcacactagataaaattacctggttcaaaagtggtttttgtttattaaatttggtaataaatatatataatacacagacaggatagtttttatgctgaagtttttgg

SEQ ID NO: 564 - DNA, 524 bp, Homo sapiens; identical to SEQ ID NO: 209

SEQ ID NO: 565 - DNA, 556 bp, Homo sapiens; identical to SEQ ID NO: 211

SEQ ID NO: 566 - DNA, 353 bp, Homo sapiens; identical to SEQ ID NO: 212

SEQ ID NO: 567 - DNA, 286 bp, Homo sapiens; identical to SEQ ID NO: 220
  misc_feature (1)...(286): n = g, a, c or t

SEQ ID NO: 568 - DNA, 529 bp, Homo sapiens; identical to SEQ ID NO: 223

SEQ ID NO: 569 - DNA, 556 bp, Homo sapiens; identical to SEQ ID NO: 490

SEQ ID NO: 570 - DNA, 598 bp, Homo sapiens; identical to SEQ ID NO: 226

SEQ ID NO: 571 - DNA, 647 bp, Homo sapiens
  misc_feature (1)...(647): n = g, a, c or t
ctgagggaggggtcagggtgggtgcgcggtgacggggagggcaaaggtggtgtcagtatcttcattttgaggattggggttcagagcacttctggggtgtcagctcctccttgtccccccgtggggctccgtaggactggaaagaggacatgaagagctctgacagagagcagcagaaactctggaactgtttccagagggcctgcactgcatggaccagggccaccaccttctccttcacccaggccagaaccccgtgccaccaggtctgcagccgctgcagcatggcctggaaccatctcatgaccttgtcacaaaagctctccccaggctcctcggttgcgggatcctcaacatccgggacaggggatctgttgcctcggcaccgtaatccatctctttctttttcaagtagaggagtgagctctaggtgctgctcctcataataagccgccactgtctccaggtagccctctttgaagtcgtcctccagctctgccaggctcgacatcacctgtccacgtcctgattctgcattttgcattttatcataaaatctttctatggcctggtgcattcgggccttcagcttcttcatgtcatcagagaggaccttcgggaagcacatggcggccaaangttcaagg

SEQ ID NO: 572 - DNA, 360 bp, Homo sapiens
cctgacacaatatccctgttcactttgaagtgaattttgactctatattcagaaccttcctttaacacaatggtttcctttttgagggcttccagatctccagtaaggtccatggtgattggtcccggggcactctcacaaaccagggtgagccgggtgacaacgacattgggggctttcggatctgtcaccacaggaccatctcccagcagcgttttcttgtacttaattagactctcatcatctttgtccatttcctgcagctctttcagggacttctgtggtggaggcttataattgagcttgctgtccagctcatcatcgtcatcctcctccacatgtggctctggggctttttca

SEQ ID NO: 573 - DNA, 457 bp, Homo sapiens; identical to SEQ ID NO: 232

SEQ ID NO: 574 - DNA, 388 bp, Homo sapiens
  misc_feature (1)...(388): n = g, a, c or t
aaaaacaaaacaaaacgatccttttgattgtgtggtgcagacgcaggactgaagccacaggcttttggggtgctgtgagcccagggctttgctcagctcacagctagcgcggcgggcagagcaacccttcggcccaagccatcctcgcagcttgtacagaagcttcctgaacctaagggatccgttcccagctctccttaaattcccagtccccaccctgggcctctctccctaacgatcttgtcgctttgggagcctctgaagtgaaccctgaaatactccctccgtcaactctgggctcagacctttgcccttctctgngtcacaaggaaatttcggtcaaganggtgggaacaggtggtttcagaccgtgcagcaaagccactgc

SEQ ID NO: 575 - DNA, 571 bp, Homo sapiens; identical to SEQ ID NO: 234
  misc_feature (1)...(571): n = g, a, c or t

SEQ ID NO: 576 - DNA, 306 bp, Homo sapiens; identical to SEQ ID NO: 236

SEQ ID NO: 577 - DNA, 342 bp, Homo sapiens
  misc_feature (1)...(342): n = g, a, c or t
aaaaacaaaacaaaacgatccttttgaatgtgtggngcagacgcaggactgaagccacaggcttttggggtgctgtgagcccagggctttgctcagctcacagctagcgcggcgggcagagcaacccttcggcccaagccatcctcgcagcttgcacagaagcttcctgaacctaagggatccgttcccagctctccttaaattcccagtccccaccctgggcctctctccctaacgatcttgtcgctttgggagcccctgaagngaaccctgaaatactccctccgtcaactctgggctcagacctttgcccttctctgtgtcacaaggaaatttcggtca

SEQ ID NO: 578 - DNA, 560 bp, Homo sapiens; identical to SEQ ID NO: 237
  misc_feature (1)...(560): n = g, a, c or t

SEQ ID NO: 579 - DNA, 504 bp, Homo sapiens; identical to SEQ ID NO: 400

SEQ ID NO: 580 - DNA, 303 bp, Homo sapiens
ctggagatggcagccgttgtttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggctgcctggaggcagtggctgagccagaaagtaacacagagctcatgcttggagagagagagtcttgg

SEQ ID NO: 581 - DNA, 363 bp, Homo sapiens
  misc_feature (1)...(363): n = g, a, c or t
tctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaantttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctgg

SEQ ID NO: 582 - DNA, 584 bp, Homo sapiens
  misc_feature (1)...(584): n = g, a, c or t
aaataatccaggcaggagaagagaggagggcacacttggaactcccctccccacaatacgtgattatttacattttagtaattggacaatcccggctcaggaggaggttgcaagaatctgcaaaagttggagggagcgccccaggagaacaaacagcaagccttatttcccctagcccatcccccaaaaaaccatccatcccatcctagtgtctggtggtgtccggtggtgtccatcttccattccttcccaaattatggaagtaaggttcttctcaccagaataagagcacttgggataacagagtagggtcccctcacccaaaaaaaaaaaaaaaaangaagccttggggtaacaacagggcattacctcccccagaataaagaatcctgggctgaggcaggtaagcagcttgacccaatatgggaccctaggctaggggaaagggtccctttactaaaataaaagctactggggtattggaaggaaagcacccttgcccaagtaagagcatatgaactaagtttgngtggnggtagtaggaggngccaatgtggggtgacacatcatcagaataagagtcc

SEQ ID NO: 583 - DNA, 547 bp, Homo sapiens
  misc_feature (1)...(547): n = g, a, c or t
ctgattgnncacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggnaattgnatttgccttctccactttgggaggc

SEQ ID NO: 584 - DNA, 400 bp, Homo sapiens; identical to SEQ ID NO: 250

SEQ ID NO: 585 - DNA, 393 bp, Homo sapiens; identical to SEQ ID NO: 251

SEQ ID NO: 586 - DNA, 425 bp, Homo sapiens; identical to SEQ ID NO: 252

SEQ ID NO: 587 - DNA, 595 bp, Homo sapiens
ctgagggaggggtcagggtgggtgcgcggtgacggggagggcaaaggtggtgtcagtatcttcattttgaggattggggttcagagcacttctggggtgtcagctcctccttgtccccccgtggggctccgtaggactggaaagaggacatgaagagctctgacagagagcagcagaaactctggaactgtttccagagggcctgcactgcatggaccagggccaccaccttctccttcacccaggccagaaccccgtgccaccaggcctgcagccgctgcagcatggcctggaaccatctcatgaccttgtcacaaaagctctccccaggctcctcggttgcgggatcctcaacatccgggacaggggatctgttgcctcggcaccgtaatccatctctttctttttcaagtagaggagtgagctctgggtgctgctcctcataataagccgccactgtctccaggtagccctctttgaagtcgtcctccagctctgccaggctcgacatcaccattcgggccttcagctttttcatgtcatcagagaggaccttcgggaagcacatggcggccaaaagttcaaggagccaagg

SEQ ID NO: 588 - DNA, 278 bp, Homo sapiens; identical to SEQ ID NO: 260

SEQ ID NO: 589 - DNA, 284 bp, Homo sapiens; identical to SEQ ID NO: 416
  misc_feature (1)...(284): n = g, a, c or t

SEQ ID NO: 590 - DNA, 211 bp, Homo sapiens; identical to SEQ ID NO: 515
  misc_feature (1)...(211): n = g, a, c or t

SEQ ID NO: 591 - DNA, 286 bp, Homo sapiens; identical to SEQ ID NO: 421

SEQ ID NO: 592 - DNA, 242 bp, Homo sapiens; identical to SEQ ID NO: 265

SEQ ID NO: 593 - DNA, 132 bp, Homo sapiens; identical to SEQ ID NO: 266

SEQ ID NO: 594 - DNA, 108 bp, Homo sapiens; identical to SEQ ID NO: 267

SEQ ID NO: 595 - DNA, 206 bp, Homo sapiens; identical to SEQ ID NO: 270

SEQ ID NO: 596 - DNA, 322 bp, Homo sapiens
  misc_feature (1)...(322): n = g, a, c or t
ttctgccacctatggggnccaggcaggtgtggtgccttggctaagtccacanacttctgagaggcccacgctttcttcttctccanaaataaaccctgaaactcaagcagctttaatcagagggcaggattccacgatagcagcatcagaacagcaagtggcanccnagaattcttgattccnatgatcangcaacagtaaaccctgtggaatttaatactgaggttgcaacaccaccattttcccttctgganacttctaatgaaacanatttcctgattggcattaatgaagagncactggaaggcacngcaatctattt

SEQ ID NO: 597 - DNA, 500 bp, Homo sapiens; identical to SEQ ID NO: 271
  misc_feature (1)...(500): n = g, a, c or t

SEQ ID NO: 598 - DNA, 511 bp, Homo sapiens; identical to SEQ ID NO: 272
  misc_feature (1)...(511): n = g, a, c or t

SEQ ID NO: 599 - DNA, 101 bp, Homo sapiens; identical to SEQ ID NO: 273
  misc_feature (1)...(101): n = g, a, c or t

SEQ ID NO: 600 - DNA, 414 bp, Homo sapiens
gcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatacgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatgg

SEQ ID NO: 601 - DNA, 525 bp, Homo sapiens
  misc_feature (1)...(525): n = g, a, c or t
ctggtgtcaagacctgggttagaggtttgtcaaacagaggcagggcccagtcacctctttggaggggagtgatgagaaggggattttggtcacctgagagggttgagtaaacttggatcagggcacaggcttctctcaccatactcagctttttgcactcactccctagttgagcctactggcatcaagctctagatgccaaggctgggatggctgtggagcaggagctatggcccaagtagctctgagaggggaagagacctaaaacccctagcagggaaaatactgacgctaggtgtgaacatatcctctcttttcacaagagtcctgatggggctggctgagcttttgggtactcatccctactgttatagctggagaggatttgggtattgaagcagggaggggcagatcccacgaagtgactgcagatctggaataataagtaaggggtagatctgcccatagagctcactttagaccggcctatactcctacaaggaattggggtangatcttctactc

SEQ ID NO: 602 - DNA, 433 bp, Homo sapiens; identical to SEQ ID NO: 276
  misc_feature (1)...(433): n = g, a, c or t

SEQ ID NO: 603 - DNA, 510 bp, Homo sapiens
  misc_feature (1)...(510): n = g, a, c or t
gaggaagaaacagctccctaatgacaaatgcatctgtgggcgggaggggacttgggattgtgctggaactggatttctgaattgctactacatcttttttcctctcatccaggtctcttcagagctgctgtgcccagtggtgcttcaactggtatctatgaggccctagagctccgggacaatgataagactcgctatatggggaagggtgtctcaaaggctgttgagcacatnaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggntctcatgctggcaac

SEQ ID NO: 604 - DNA, 478 bp, Homo sapiens; identical to SEQ ID NO: 277

SEQ ID NO: 605 - DNA, 384 bp, Homo sapiens; identical to SEQ ID NO: 527

SEQ ID NO: 606 - DNA, 208 bp, Homo sapiens; identical to SEQ ID NO: 278

SEQ ID NO: 607 - DNA, 550 bp, Homo sapiens
  misc_feature (1)...(550): n = g, a, c or t
gcagaagctactcaaatgcngtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttggg

SEQ ID NO: 608 - DNA, 564 bp, Homo sapiens
ccagaggatcagtgtccgatgaggaaatgatggagctcagagaagcttttgccaaagttgcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctct

SEQ ID NO: 609 - DNA, 564 bp, Homo sapiens
tgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggacctgc

SEQ ID NO: 610 - DNA, 550 bp, Homo sapiens
ccagatgccaagtgacaagaccattgggggaggagatgattccttcaacaccttcttcagtgaaacgggtgctggcaagcatgtaccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacaggagaggagaccagagtctgcctggagtgcagactgggagggggcagatgactggggtggagcatgaagaaatttctggggtgattatcctatcttatttggggtgatatttac

SEQ ID NO: 611 - DNA, 349 bp, Homo sapiens; identical to SEQ ID NO: 284
  misc_feature (1)...(349): n = g, a, c or t

SEQ ID NO: 612 - DNA, 342 bp, Homo sapiens; identical to SEQ ID NO: 444
  misc_feature (1)...(342): n = g, a, c or t

SEQ ID NO: 613 - DNA, 246 bp, Homo sapiens; identical to SEQ ID NO: 34

SEQ ID NO: 614 - DNA, 178 bp, Homo sapiens; identical to SEQ ID NO: 39
  misc_feature (1)...(178): n = g, a, c or t

SEQ ID NO: 615 - DNA, 406 bp, Homo sapiens
  misc_feature (1)...(406): n = g, a, c or t
ncgaggtcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgcggccacatctntnaaaagcccctcacagccccaggcaccaaaanacanaaaggtccccaccagga

SEQ ID NO: 616 - DNA, 445 bp, Homo sapiens
ctgccgccgtggaatccaaaatttcgggagctgtgaccctttcctcatgtaaaacgagtagtcttggacgatctgggcataggaaccaatcagaaacaatcgcttcagcaatcaagaccattgttcatcatggaggaacccgtggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatgggaagaacaaaactaaaatgctgtatgg

SEQ ID NO: 617 - DNA, 240 bp, Homo sapiens
cctaagccgcctaaggggctgcctcggctgtccatcagttacctcgtttcctgagcagagtaattgggtgagattgttcatggaggcattgctggctctctagtcctggaacctacagttggtccaattcattatgccaaagggtccgtctaggaggttcttgttccaagtattgagattcccgagagaagtaggtccccttagatagaagcagagtttctcagaggtatttagcagcag

SEQ ID NO: 618 - DNA, 268 bp, Homo sapiens
aaaatttattttattttacaatacttttagatttatagaaaagttgggaagatggtacaaagagttcccatatataccatacccagtttcccctaataacatcttacattggtatattatggttgtcacaattaaatgggctaatattgatacattagtattaactaaagtccatactttgttcagatttcattagtttttatgtaatgtcttttgtctgttctaggatcccgttgaagataccacattacacttaggctcctgttgg

SEQ ID NO: 619 - DNA, 277 bp, Homo sapiens
  misc_feature (1)...(277): n = g, a, c or t
cgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttanaatttctcattgggagagtaaggtacccccatcccagaatgataactgcacagtggcagaacaaactccaccctaatgtgggtggaccccatccagtctgttgaagg

SEQ ID NO: 620 - DNA, 233 bp, Homo sapiens
ctgtgcgtgctcacgggctcctcctgctggaagagagagagatgtgcacgccactcctatggcatgtctagcaggtctgagcagtgttcatagaagaaaaatgttttaacagtctcagattttgggaggtagggggaaaaaaatcattgaaatctgggaaagacatttttaagctgctgacttcacctgcaaaatctaacaggttggattagtttttttttttttttttacct

SEQ ID NO: 621 - DNA, 311 bp, Homo sapiens
  misc_feature (1)...(311): n = g, a, c or t
ctgcaagacagcagagaanctgccaatatccagttagcagatgactttgctggcaagcagaggaagncggtaaaagcttgtctcccagccaggaaacttgacaccaagntaagatttggagctaggaaacaaacccaaaaggctcacagcaagcggagaaaaaaaccccaaaatctgtaacctgtatcacaaagcgttcatatccttcagatataaagagttattagatatcaataagaaaaatgcaaacactcctgaaaagtagaaaaaagctatgaacaggcaattcactgaaattaaaaaaaaaaaaa

SEQ ID NO: 622 - DNA, 243 bp, Homo sapiens
ctgtggcttagctggctttgctggtcgtaatggaggacaaaagtgccttctggtgaaactcagcttccatagtgatggaacctaagggtagcagagtttatggtgaccctgtagtgtatctccagaaatggtgattgtttgaatgcatgtaagacattccctagggactccaagaaatattgattagaggaagatgtggtgctttgaaagggacttggtgttcctacatgaaccaagtgaagg

SEQ ID NO: 623 - DNA, 388 bp, Homo sapiens; identical to SEQ ID NO: 287

SEQ ID NO: 624 - DNA, 529 bp, Homo sapiens; identical to SEQ ID NO: 297
  misc_feature (1)...(529): n = g, a, c or t

SEQ ID NO: 625 - DNA, 571 bp, Homo sapiens
ctgagctcctctggttcttctctagacctgctccctctctgaaatgcaaggccgtgcctttaatgggcttttggcattctgtctccagacctcccttctcatctgaagggctctcaggagaacagagaaaaaaccagcctgtctccaaactggcccgtctcagggactgggggcctttacccccagtgaaagatgcagactttacagcgctgcagtacagtagagttaagtgactccttcagatagttggatgggtctctcgatcattcctgataataacattttgcctatgttaagtgctttccacctatcatgttaccttctaactactcccttggttggatacaggtattagccccatttcacaattaagaaattgaggcttaaaaggattaaagagttttttagaggagaaacagctcttccttacagaaggatcccaagtaataaatgtgaatgctccctctccagaaggtggcacttaattcccctgtcctggagtttgacctcgcttagtgactggcttctgatgaataaaatggggaaaaggaaaaatagtaactccacagtg

SEQ ID NO: 626 - DNA, 449 bp, Homo sapiens; identical to SEQ ID NO: 52
  misc_feature (1)...(449): n = g, a, c or t

SEQ ID NO: 627 - DNA, 410 bp, Homo sapiens; identical to SEQ ID NO: 60

SEQ ID NO: 628 - DNA, 343 bp, Homo sapiens; identical to SEQ ID NO: 48
  misc_feature (1)...(343): n = g, a, c or t

SEQ ID NO: 629 - DNA, 117 bp, Homo sapiens; identical to SEQ ID NO: 71
  misc_feature (1)...(117): n = g, a, c or t

SEQ ID NO: 630 - DNA, 111 bp, Homo sapiens
  misc_feature (1)...(111): n = g, a, c or t
agcactggtggtgctcaccatggctggacgtctctctcggctctctctcactgacagactctggactctatgtntactcaacaccctagtgcagtggccacgaaaacagca

SEQ ID NO: 631 - DNA, 303 bp, Homo sapiens
  misc_feature (1)...(303): n = g, a, c or t
ctggacgangaangntnctgacactcactaggactgtgactagatgttccagtggcagaaagtcctcctggtttccttcgggccctggcgtaatgcagcagagcagcagcanctacnannacnaagatgttgaccaccagccccntgattcccgcagtggtaaggcctgttctgttcctggaagttcctgtaacattgagtgtcaccactttactgtgctgggcccccaggccattgtcaagcctcacatgagtagtttccagaatgntctgtagtcagagagaggttgaaggatgcccctcc

SEQ ID NO: 632 - DNA, 246 bp, Homo sapiens
  misc_feature (1)...(246): n = g, a, c or t
ncgangtctgaagcccactaaggaatccaggagatgtgctgggccctggagtgggagcaccttgccactggattagaaaacctgccagtcagggctttaactgggaaacaggtgacagtccagcagggccctgcattctggtcagactgagaatgaggacatgtgaaacaaaggccagtagatatggtctggggcagnctaaatcttccacttcaatgctgcttctccccaaggggaactttgcgg

SEQ ID NO: 633 - DNA, 544 bp, Homo sapiens
  misc_feature (1)...(544): n = g, a, c or t
aaatgcgcatgtaatttatttatgataatgtaaatacttcttaaatgtctgtaactcttcaaaagtgatgcttcaggataaatgagctgctaagcattttaagaatttaccgtaactctaatatactggaggggaagggatggatctgaaaggctaccatcagtaagaggaataaaacttgctctgtgtcctccagaagtctggacagtgatcagcaggtaatagacacagaggaactgatttcaacttttgaaaaagagttttccactaattaacactgtcccacggcggaataggttccctgaagatgttgagtgctgaaagtgatcaagcagaggctagagggcttcttgcctgggagcaggggagggttgggggagaaggacaagaggacagtggggtaggtgacctctagcatcattgtcactgctaatattctatcttgtgcattcatttgctcattcacacagcttcccaagatggcccccaatgatccttgccagtggngtattcatgcccttgggcaattccttnccagactgaa

SEQ ID NO: 634 - DNA, 220 bp, Homo sapiens
ccacctgggggcaggtagccccggcttgcttgttctctctttcctagcccaggaatcgggtccttgggtctaaagcacagggccaagttctcaaggatcaacatcccagacagctcccatggtctggggcttggagctggtatgaagggtgaaccaggttccatcctggactgtttatggttggagggcctgggcccctggcaccaagaccttcacttcc

SEQ ID NO: 635 - DNA, 224 bp, Homo sapiens
  misc_feature (1)...(224): n = g, a, c or t
cctaaaaaagcggcctcggtgggaatgcatttctcttgctccacgtctattttagttgcatatctgtagtgatgacaaatgcctccagccttgtcctctgcaaggctgcactgggctgcatacaggctcctgtctcaggtgtctggtttcctccttgaaaggttggggcagcggagtcagccctgtctatctgggcaaggncctgacacttggaancatgaaaa

SEQ ID NO: 636 - DNA, 453 bp, Homo sapiens
ctgtcatgaggtctcttctatagccatcaggtcttctcacagggatattcaccaccttgctctggataggcacatggccgttgtcagctctacagtaatatttgccggcatcactctctttcacagctgggatctccagctctgctgacagggaacgctgggttttctttcccatactggttcctgtggcctctctgtaccaggagaatgtgacatttcctgtacccccagccactgagcagagcaggatcagtttttgtccttcagtcacctgtcccccgggggcccggatctccaagcttacattagagatggggattcctagatggatataagacaacaggtgagaactctaagggaaactctgggaacagggtttgactgattccattctctaatgcaaaatgtgggaatgtggagattgtatagataatccattataagcattcctat

SEQ ID NO: 637 - DNA, 215 bp, Homo sapiens
ccgcccgggcaggtccacccaggaactcctgactgctttccttcccctgcttgctatacattgtctggaactggctaagaaatggggaacatttgtgaaaaccaagaaatgtaatggttttggatgaataaaatagaccaaagttaaggtaagtgcacaaatatcagtgtcaggctatggaagaaagataaagagatacttcttttttttttttt

SEQ ID NO: 638 - DNA, 497 bp, Homo sapiens
  misc_feature (1)...(497): n = g, a, c or t
gttcggggagagggtggtancacagggcttgggatatcggcagtgtgggaaatgcgaagcatttctcatcatcatcatctctgctacagncatgtttctgcatgtcagcgagcgacactgtccctgcctcaggttggaggttttatcanccaaagtgtttttttcatgtatcgttcgttccattcatccactctgnnccttgncagcctttgaaaggcttggttgctcccaggctgctgttctcagggaccttaaaagggacctggttagtcttggggcagagagtatctacttgggcactctcttccaagaaagaccttgtctccattttcattaggacaatgcttcttgtgtgtgttctggaagatcttctaaatggaatgcttgttgcactgntcccangcgagtggntgccatgagacctgangaccacacttgggggaccaatcatgtncttnaccactgngccttagaatcgcccctggacagagttcctg

SEQ ID NO: 639 - DNA, 591 bp, Homo sapiens
ctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacccgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctggggcccagcacagtaaagt

SEQ ID NO: 640 - DNA, 349 bp, Homo sapiens
ccagagtgcaggatacatcattggcaccaagggtctttttcaattcttggtcaatcctctgcagcaagcacccccggatgacgtcctcatagatgccctcagtggtcagagcctggctgcccacggcaaggacatccccctcgaactcaggcagctcctttttgcagcctggctcgagttggctcagcacaaaaggtaaaaagatgcagagaccccagcctcggatgaacctcctctgcgccaacccgctgtccgatttgaatttcttcagcacgcgccccctgactctctccagcctctgggcagcctggtcacagttgagggccgtcgtcagacactggtcagccag

SEQ ID NO: 641 - DNA, 555 bp, Homo sapiens
aaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtacttaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaatctctgg

SEQ ID NO: 642 - DNA, 179 bp, Homo sapiens; identical to SEQ ID NO: 191
  misc_feature (1)...(179): n = g, a, c or t

SEQ ID NO: 643 - DNA, 582 bp, Homo sapiens
  misc_feature (1)...(582): n = g, a, c or t
ccattggatggctggggattcaccagagaaacggacacaccaggttctattctaaaaacattaagtggtttcccaggacagcagtcttccctgattttatcttctgcttcggaggcaaacttgacttctatgtgttctagctcaagcgaattagtcagatagactatattctccataagcacagccttttcatcaaattctaattgcaaatccagaatacgaggccccatcttctccagattttccttaatcatggcaacaaatggcatgactttcttcatgtatttcttcagttctggcatactgcttagttcactagcaatgactttgttgtcaggcagttttccgttattggcctcaaagtgtttacgtagaacagacagggtggtatgttgccaaggtggatagttctttgccacatagatggtgcaatgtgagggcttctgcaggggttgtttgtcagtcttcttccctttagctggcatcatatagttcttgagtcgtagtctaaggtcatgtgttacttccataagatactgngaggagtgtattaaaacttcattaacaggacctgccacaggc

SEQ ID NO: 644 - DNA, 420 bp, Homo sapiens
  misc_feature (1)...(420): n = g, a, c or t
ctggggcacacagaggaggggcctgggtaccccttttggggaaactgagacgaagctatttagaacagcttgaaaataagagacttttctagaatggggtggcagctaaagtagcttctttttctttctttcagaatgctcagatgcatcagttccttaatatacacgtgaaatttgaaaactgtacattcggtgagattaaattttatatacaactagcaattgtccagctttgttgctcattttcaattaaggctaaagtgttcaacatgagaaaatgtgatacatttgatacagtgtggggtgggagtggatgggcagctcttggtggtactggaccttncacaaggctgtgtccacccagaatccatgctggcaggagggaggcagaggtatcaaaccanacctctcaccaagcgg

SEQ ID NO: 645 - DNA, 505 bp, Homo sapiens
  misc_feature (1)...(505): n = g, a, c or t
aaagacagaatccctgagtgctgagcagattctcaaaacacatttanaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtgg

SEQ ID NO: 646 - DNA, 474 bp, Homo sapiens; identical to SEQ ID NO: 205
  misc_feature (1)...(474): n = g, a, c or t

SEQ ID NO: 647 - DNA, 478 bp, Homo sapiens
ccagcatcaccacagcctggggcccagaaggagccataacctgttgctgcctgatggagggcccagcatgggacacaagccagatcatcatcaccgggagtcaagacggcatggtccgggtttggaagactgaggatgtgaagatgtctgttcctggacggccagcaggagaggagcccctggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaaccccc

SEQ ID NO: 648 - DNA, 443 bp, Homo sapiens; identical to SEQ ID NO: 563

SEQ ID NO: 649 - DNA, 563 bp, Homo sapiens; identical to SEQ ID NO: 352

SEQ ID NO: 650 - DNA, 306 bp, Homo sapiens; identical to SEQ ID NO: 484

SEQ ID NO: 651 - DNA, 561 bp, Homo sapiens; identical to SEQ ID NO: 356

SEQ ID NO: 652 - DNA, 420 bp, Homo sapiens; identical to SEQ ID NO: 364

SEQ ID NO: 653 - DNA, 196 bp, Homo sapiens
tcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaactttt

SEQ ID NO: 654 - DNA, 581 bp, Homo sapiens
  misc_feature (1)...(581): n = g, a, c or t
ctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagtttgtagggcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgngaaaaagactgttcaacatgccttatgataacaccgatttgngtctatt

SEQ ID NO: 655 - DNA, 482 bp, Homo sapiens; identical to SEQ ID NO: 395

SEQ ID NO: 656 - DNA, 252 bp, Homo sapiens
  misc_feature (1)...(252): n = g, a, c or t
aaaatacttttataaaattataaattgataataatccccncaaactgaagngaaatacttttaatactacttgaaattaaagtacagttgnttatacaacaatgaataaggacaagatatnaaactgaaaattcaaaaataaacagaagaaatgtaaacagttctaaaatatcagtatttataaatgttgcttagaggaaggctattcaaagcatggtccattaactatttgtgagctgtccagaatgaaag

SEQ ID NO: 657 - DNA, 379 bp, Homo sapiens
  misc_feature (1)...(379): n = g, a, c or t
aaaataagctatggtttttccagtagccaaaatgatcctgcaccanagctcatanactgagaacctgancatgcaaanccacagtctgggtgaagggatgtctgctttgtaaatgacctgctaattctttgcaacccacagtaatttggtttctgtgaacccacagaagcaggcccaccaaaaagggccttgtctgctagcctggagtatacatgantcactggcggtgggatcagtcattttttaggctgccccattttcctaacatgttaaaatgtgtgttctcagtcttttcaagagaggaagaagcaaagcggcacttacagagtgtgtgatangacacagatctgtggcgagggattggggaaggtgggtggca

SEQ ID NO: 658 - DNA, 551 bp, Homo sapiens; identical to SEQ ID NO: 258
  misc_feature (1)...(551): n = g, a, c or t

SEQ ID NO: 659 - DNA, 278 bp, Homo sapiens; identical to SEQ ID NO: 260

SEQ ID NO: 660 - DNA, 414 bp, Homo sapiens; identical to SEQ ID NO: 268

SEQ ID NO: 661 - DNA, 353 bp, Homo sapiens; identical to SEQ ID NO: 427

SEQ ID NO: 662 - DNA, 101 bp, Homo sapiens
  misc_feature (1)...(101): n = g, a, c or t
agggggntggtggctgncntnatnaggacctggacggcctggnctgagctgaccnatgccngatntactggtnctncactgaangtacacaanatcnttaa

SEQ ID NO: 663 - DNA, 442 bp, Homo sapiens
cctccaattccacagagcacaatttaaaactacagcatatgaaaatagcaaatgcaaaaaaacaaaaacaaaaacacaacacaaaatgccacatgtaaatggtggagtatgtatttatacataacatccccacatacatacatacactcaaaacaatactatataatttttctatgtgaacatacaatgtccttctggaagaacatacaaaaactggtaacagtagctaactttaggggagaatccttgattagggttggtagatgaaaagacttcagccctttctgtaaggtgggcagcacatatttacaaaaggaatgtatctctgtattgtgtgtgaatataccattaatttctaaaaggttccatgagaaaattttcgaagaattgcacaaacatcctttgctatgtagacaaagatggtgactcggcacaaagccag

SEQ ID NO: 664 - DNA, 317 bp, Homo sapiens
  misc_feature (1)...(317): n = g, a, c or t
ctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtgactgaccttatttaattcctgggatgagagttttcgatgcagtgctcgctgttgntgaataggcnatcacnacgtgcattgtgcttctttctttggnaatattt

SEQ ID NO: 665 - DNA, 1324 bp, Homo sapiens
cttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttcccccctttatagatggtcacgcacctgggtgttacaaagttgtatgtggcatgaatactttttgtaatgattgattaaatgcaagatagtttatctaacttcgtgcgcaatcagcttctatccttgacttagattctggtggagagaagtgagaataggcagcccccaaataaaaaatattcatggaaaaaaaaaaaaaaa

SEQ ID NO: 666 - protein, 114 aa, Homo sapiens
MAECPTLGEAVTDHPDRLWAWEKFVYLDEKQHAWLPLTIEIKDRLQLRVLLRREDVVLGRPMTPTQIGPSLLPIMWQLYPDGRYRSSDSSFWRLVYHIKIDGVEDMLLELLPDD

SEQ ID NO: 667 - DNA, 1659 bp, Homo sapiens
tcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtaaaaaaaaaaaaaaaaaaaaaaaaaaaaaaaaaaaaaaaaaaaaaaaaaaagggggggggga

SEQ ID NO: 668 - protein, 461 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 669 - protein, 79 aa, Homo sapiens
GKHPDPSAWHRPSDTEPLNKGTPTPHHILRSGAPQVDTRTLTPCPSSTPQVSPRLPPRSLCSRPPLRSFKPTRPHWCVS

SEQ ID NO: 670 - protein, 124 aa, Homo sapiens
TFRHRAPEQGHPNTSSYTEVRGSPGGHQDSDPLPLIHPAGQPKAAPSVTLFPPSSEELQANKATLVCLISDFYPGAVTVAWKADSSPVKAGVETTTPSKQSNNKYAASSYLSLTPEQWKSHKSY

SEQ ID NO: 671 - protein, 50 aa, Homo sapiens
PAGWMRGRGSESWCPPGEPLTSVYDEVLGCPCSGALCLKVYARQRGQGVF

SEQ ID NO: 672 - protein, 108 aa, Homo sapiens
VAFVGLPLLRRQAQVAAGRVLVVALFGGCGGLHSRLDGAAICLPGHCHGSRVEVTYETHQCGLVGLKLLRGGREQSDRGGSLGLTCGVDEGQGVRVLVSTWGAPDLSI

SEQ ID NO: 673 - protein, 58 aa, Homo sapiens [sequence omitted]

SEQ ID NO: 674 - protein, 109 aa, Homo sapiens
HTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDG

SEQ ID NO: 675 - protein, 100 aa, Homo sapiens
IVSGCTSGPSVSMAAPVPTSHTMITLSQPALSSTFWAVVCQATMPTRLVWPSRVTTGSRRGSIRPPSGISHTMTVQSSEPLAMTLSLCGHQAMSSTGAVW

SEQ ID NO: 676 - protein, 103 aa, Homo sapiens [sequence omitted]

SEQ ID NO: 677 - protein, 89 aa, Homo sapiens
TGFYPDHVELSWWVNGKEVHSGVSTDPQPLKEQPALNDSRYCLSSRLRVSATFWQNPRNHFRCQVQFYGLSENDEWTQDRAKPVTQIVS

SEQ ID NO: 678 - protein, 89 aa, Homo sapiens
ADDLGDRFGPILGPLVILREPVELDLTAEVVAGVLPEGGRDPQAAAQAVSGVIEGGLLLEGLRVCADPTVHLLPIHPPAQLHVVGVEAC

SEQ ID NO: 679 - protein, 59 aa, Homo sapiens
QRKWLRGFCQKVAETLRRLLRQYLESLRAGCSLRGCGSVLTPLCTSFPFTHQLSSTWSG

SEQ ID NO: 680 - protein, 123 aa, Homo sapiens
  variant (1)...(123): Xaa = Any amino acid
TXXINRXEAGDEADYYCQVWDRNNDHVVFGGGTKLAVLGQPKAAPSVTLFPPSSEELQANKATLVCLISDFYPGAVTVAWKAXSSPVKAGVETTTPSKQSNNKYAASSYLSLTPEQWKSHXTT

SEQ ID NO: 681 - protein, 85 aa, Homo sapiens
  variant (1)...(85): Xaa = Any amino acid
CSXVGLPLLRRQAQIAAGRVLVVALFGGCGGLHSRLDGAAXCLPGHCHGSRVEVTYETHQCGLVGLKLLRGGREQSDRGGSLGLT

SEQ ID NO: 682 - protein, 85 aa, Homo sapiens
VASVGLPLLRRQAQIAAGRVLVVALFGGCGGLHSRLDGAAICLPGHCHGSRVEVTYETHQCGLVGLKLLRGGREQSDRGGSLGLT

SEQ ID NO: 683 - protein, 123 aa, Homo sapiens
TLTINRVEAGDEADYYCQVWDRNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 684 - protein, 161 aa, Homo sapiens
  variant (1)...(161): Xaa = Any amino acid
PCLRSKVTRKRPCLPSMTLMEEMLREAFRCMTQEPMKGPIAMQSGPKPLFRRMSSLVGPTQSFFMRESKTLGAVQIMNGLFHIALGGLLMIPAGIYAPICVTGVVPSLGRHYVYYFRITPGSNRKKNSRKCLVKGKNDNEFIXPSLLAFSGKNSFQIMGPY

SEQ ID NO: 685 - protein, 60 aa, Homo sapiens
  variant (1)...(60): Xaa = Any amino acid
LGWYPLWGGIMYIISGSLLAATGKKTPGSVWSKEKMIMNSLXPLCLPFLERILFKSWDHT

SEQ ID NO: 686 - protein, 67 aa, Homo sapiens
LPQIQGHSEEAMSTLNDTHGGNAERSIQMHDTRANERPYCYAIWSKTTLQEDVFTGGPHAKLLHEGI

SEQ ID NO: 687 - protein, 68 aa, Homo sapiens
DFGGCPDYEWALPHCPGGSSDDPSRDLCTHLCDWGGTLSGEALCILFPDHSWQQPEKKLQEVFGQRKK

SEQ ID NO: 688 - protein, 106 aa, Homo sapiens
  variant (1)...(106): Xaa = Any amino acid
VWSHDLKRILSRKGKQRGXNEFIIIFSFDQTLPGVFFPVAARSDPEIIYIMPPQRGYHPSHTDGCIDPCWDHQKTPQGNVEEPIHNLDSPQSLRFPHEEALRGAHQ

SEQ ID NO: 689 - protein, 94 aa, Homo sapiens
IPAGIIRRPPRAMWKSPFIIWTAPKVLDSLMKKLCVGPTSEDILLKSGFGPDCIAIGPFIGSCVMHLNASLSISSMSVIEGRHGLFRVTLDLRQ

SEQ ID NO: 690 - protein, 151 aa, Homo sapiens
  variant (1)...(151): Xaa = Any amino acid
PGGQHGGDWSWRVTVEPQDSGTSALPLVSLFFYVVTDGKEVLLPEVGAKGQLKFISGHTSELGNFRFTLLPPTSPGDTAPKYGSYNVFWTSNPGLPLLTEMVKSRLNSWFQHRPPGASPERYLGLPGSLKWEDRXPSGQGXGAVLDTAGDP

SEQ ID NO: 691 - protein, 59 aa, Homo sapiens
WGSARRGLELESDCRASGLRYFCPPFGLPVLLCGDRWQGSPTTRGWGQGAVEVYQWAHQ

SEQ ID NO: 692 - protein, 85 aa, Homo sapiens
  variant (1)...(85): Xaa = Any amino acid
FKGHLLYQELPXALAHLDXCPPTSGILASRGSVQGRPLGADAETSYLGDSLPSLSAGAVLGWRSRRHCSCHTWGLYPLDWLVAKV

SEQ ID NO: 693 - protein, 53 aa, Homo sapiens
TSTAPWPQPLVVGLPCHLSPHRRTGRPKGGQKYLSPEALQSLSSSSPLRADPQ

SEQ ID NO: 694 - protein, 62 aa, Homo sapiens
ATLYHLCQQGQSWVGGPEDIVAAILGGCIPWTGWWQKCKAEVTKFTGVPTDKLQLPLGPNLW

SEQ ID NO: 695 - protein, 51 aa, Homo sapiens
LPYLGAVSPGLVGGKSVKRKLPSSLVCPLINFNCPLAPTSGSRTSLPSVTT

SEQ ID NO: 696 - protein, 71 aa, Homo sapiens
  variant (1)...(71): Xaa = Any amino acid
IRSKSHPGLGPSTHSRIGSADTEGGHGTRRLHGRLLSRLYPGHQRXVLTCINCXWNSPHHRGYPWPXXLKC

SEQ ID NO: 697 - protein, 97 aa, Homo sapiens
  variant (1)...(97): Xaa = Any amino acid
ASYSYXXEKPSAIQQRAILPCIKGYDVIAQAQSGTGKTATFAISILXQIELDLKATQALVLAPTRELAQQIQKVVMALGDYMGASCHACIRGTNVXC

SEQ ID NO: 698 - protein, 52 aa, Homo sapiens
  variant (1)...(52): Xaa = Any amino acid
PPSVSAEPILEWVLGPRPGWLLDLIQSXAESIWQMWPFSQSQIGLEQSHHNP

SEQ ID NO: 699 - protein, 70 aa, Homo sapiens
SGHSMDMRVPAQLLGLLLLWLPGAKCDIQMTQSPSTLSASVGDTSYNKLSGLSEYRSVVGLASTETRQSP

SEQ ID NO: 700 - protein, 97 aa, Homo sapiens
  variant (1)...(97): Xaa = Any amino acid
PNLLPPCLHLSEIQVTISCRASQNIDRWLAWHQQKPGKAPNVLIYATSSLEEGVSLRFTGSGSGTQFNLTITSLQPDDSATYYXQHYSASLRSFWTS

SEQ ID NO: 701 - protein, 72 aa, Homo sapiens [sequence omitted]

SEQ ID NO: 702 - protein, 51 aa, Homo sapiens
EARQLIVTCISDRCRQGGRRLGHLDVTFGTWEPEQQEPQELSGDPHVHAVS

SEQ ID NO: 703 - protein, 61 aa, Homo sapiens
  variant (1)...(61): Xaa = Any amino acid
LLAAYLLLLCLEGVVXSTPALTGLAICLPGHCHXSRVEVTYETHQXGLVGLKLLXGGRETE

SEQ ID NO: 704 - protein, 56 aa, Homo sapiens
  variant (1)...(56): Xaa = Any amino acid
VAAVGLPLLRRQAQIAAGRVLVVALFGGCGXLHSRLDGACYLPSRPLSXLPGRSHL

SEQ ID NO: 705 - protein, 76 aa, Homo sapiens
  variant (1)...(76): Xaa = Any amino acid
VSPXLPPRSFCFPPSXEELQANKAXLVCLISDFYPGXVTVAWKADSKPRQGGSGXHHTLQTKQQQVRGQQLSEPDA

SEQ ID NO: 706 - protein, 154 aa, Homo sapiens
  variant (1)...(154): Xaa = Any amino acid
TLTINRVEAGDEADYYCQVWDRNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSYRPARAAKGEFQHTWRRYYGSXSVPTWRNHXH

SEQ ID NO: 707 - protein, 67 aa, Homo sapiens
  variant (1)...(67): Xaa = Any amino acid
YXHDYAKLVPSXIHSNGAKCAGIRPWPPGQVCSFCGTSTAQASGSDSCWPRTCCCFVWRVWWSPLPP

SEQ ID NO: 708 - protein, 116 aa, Homo sapiens
  variant (1)...(116): Xaa = Any amino acid
MXMITPSWYRXGSIVTAPSVLEFALGRPGRSVASVGLPLLRRQAQIAAGRVLVVALFGGCGGLHSRLDGAAICLPGHCHGSRVEVTYETHQCGLVGLKLLRGGREQSDRGGSLGLT

SEQ ID NO: 709 - protein, 125 aa, Homo sapiens
  variant (1)...(125): Xaa = Any amino acid
TLTINRVEAGDEADYYCQVWDRNNDHVVFGGGTKLAVLGQPKAAPSVTLFPPSSEELQANKATLVCLISDFYPGAVTVAWKADSSPVKAGVETTTPSKQSNNKYAXQQLSEALTPEQVESPTEAT

SEQ ID NO: 710 - protein, 70 aa, Homo sapiens
  variant (1)...(70): Xaa = Any amino acid
LLXRVLVVALFGGCGGLHSRLDGAAICLPGHCHGSRVEVTYETHQCGLVGLKLLRGGREQSDRGGSLGLT

SEQ ID NO: 711 - protein, 53 aa, Homo sapiens
  variant (1)...(53): Xaa = Any amino acid
VASVGLSTCSGVKASDSCXAAYLLLLCLEGVVVSTPALTGLLSAFQATVTAPG

SEQ ID NO: 712 - protein, 56 aa, Homo sapiens
PPRVRAPSVPGPRPSRQRSFHSAWDDGEEKNPDLPHPGPKESAGDVHQAEVRADEE

SEQ ID NO: 713 - protein, 56 aa, Homo sapiens
RRGSVRPASQGPGRADKDHSTQPGTMGRKKIQISRILDQRNRQVTFTKRKFGLMKK

SEQ ID NO: 714 - protein, 56 aa, Homo sapiens
LLHQPELPLGERHLPIPLVQDAGDLDFFPPHRPRLSGMIFVCSAWALGRWAHGPAA

SEQ ID NO: 715 - protein, 120 aa, Homo sapiens
  variant (1)...(120): Xaa = Any amino acid
PAICTDKYRCLKHNLNSLIKRSNSTAATNEXPEVTVFSKSPVTLGQPNILICLVDNIFPPVXNITWLSNGHSVTEXVSETSFLSKSDHSFFKISTSPSSLLXEESYDCKXXHWGLGQASS

SEQ ID NO: 716 - protein, 52 aa, Homo sapiens
  variant (1)...(52): Xaa = Any amino acid
AMGTQSQXVFLRPASSPRVIIPSSRSVPHPPPFWXRRVMTARXXTGDWDKPL

SEQ ID NO: 717 - protein, 60 aa, Homo sapiens
  variant (1)...(60): Xaa = Any amino acid
VPIAQPCDVXHRRKDVVHKTDEDVGLTQCHGRLGKHCDLRXLIGSSGRVGAFNQTVQVMF

SEQ ID NO: 718 - protein, 52 aa, Homo sapiens [sequence omitted]

SEQ ID NO: 719 - protein, 53 aa, Homo sapiens [sequence omitted]

SEQ ID NO: 720 - protein, 59 aa, Homo sapiens [sequence omitted]

SEQ ID NO: 721 - protein, 68 aa, Homo sapiens
  variant (1)...(68): Xaa = Any amino acid
QVLGWLTWAPWAWGRCVTRFGLCREKIGSYGDLGWRWMRQHPAGACPWTRATLGLLSRLELEGEDLXR

SEQ ID NO: 722 - protein, 51 aa, Homo sapiens
  variant (1)...(51): Xaa = Any amino acid
XGXGPRPPAQGGTRALEWPESRDRPQQGADASTSIPDPRNSQSSLCRAQIL

SEQ ID NO: 723 - protein, 52 aa, Homo sapiens
SGPSPGTGPSRVLTHPPPSQIPVTPNLLSAEPKSCDTPPPCPRCPGKPAQDL

SEQ ID NO: 724 - protein, 57 aa, Homo sapiens
RKQHWWCLSHGLDRSPPRPPLSLHRLCDLLCVDSDTLSVSGPRKDGQDYLWGKQYWE

SEQ ID NO: 725 - protein, 97 aa, Homo sapiens
GSSTGGASAMAWTVLLLGLLSHCTDSVTSYVLTQTPSVSVAPGKTAKITCGGNNIGSNNVHWYYQKPGQAPVLIISFDNDRPSGISERFSGFNSGDM

SEQ ID NO: 726 - protein, 65 aa, Homo sapiens
  variant (1)...(65): Xaa = Any amino acid
QAXDEADYYCQXWDRNNDHVVFGGGTKLAXLXXPNAAPSXTLFPPSSEELQANXATXVCLIXDFY

SEQ ID NO: 727 - protein, 60 aa, Homo sapiens
  variant (1)...(60): Xaa = Any amino acid
KXAMRPTITVKXGIVIMTMSSSAEGPNWXSXVXPTLPPQXLCSRPPLRSFKPTXPHXCVS

SEQ ID NO: 728 - protein, 59 aa, Homo sapiens
  variant (1)...(59): Xaa = Any amino acid
DTXVWXCWLEAPQRRAGTEXLRGQRWXDXGXPVWSLRRRRHGHYYDPXLDSNSRPHRXL

SEQ ID NO: 729 - protein, 56 aa, Homo sapiens
GVFLHTFTSSALSIYTHTQHPQYLTSNRLYHLYLTMTPGRRSKFFFTISNSSLSLF

SEQ ID NO: 730 - protein, 50 aa, Homo sapiens
ISQITKSSLRQQFKTVPGIKIYSHLRSLPSHLHLLSLKYIHTHPTPSILD

SEQ ID NO: 731 - protein, 70 aa, Homo sapiens
RSAYAARWVAKSLVKGGLCRRVLVQVSYAIGVSHPLSISIFHYGTSQKSERELLEIVKKNFDLRPGVIVR

SEQ ID NO: 732 - protein, 53 aa, Homo sapiens
GLLMLLVGWQNPLLKEVCAGGFLFRSLMLLEFLIHYLSPFSIMVPLRRVRESY

SEQ ID NO: 733 - protein, 76 aa, Homo sapiens
  variant (1)...(76): Xaa = Any amino acid
KQHWWCLSHGLDRSPPRPPLSLHRLCDLLCVDSDTLSVSGPXKDGQDYLWGKQYWELQCTLVLPKARPGPCPNHLF

SEQ ID NO: 734 - protein, 96 aa, Homo sapiens
  variant (1)...(96): Xaa = Any amino acid
SSTGGASAMAWTVLLLGLLSHCTDSVTSYVLTQTPSVSVAPXKTAKITCGGNNIGSYSVHWYYQKPGQAPVLIISFDDXRPSXISERFSGLQFWGT

SEQ ID NO: 735 - protein, 85 aa, Homo sapiens
  variant (1)...(85): Xaa = Any amino acid
VASVGLPLLRRQAQIAAGRVLVVALFGGCXGLHSRLDGAAICLPGHCHGSRVEVTYETHQCGLVGLKLLTGGREQSDRGGSLGLT

SEQ ID NO: 736 - protein, 87 aa, Homo sapiens
  variant (1)...(87): Xaa = Any amino acid
VLGQPKAAPSVTLFPPSCEELQANKATLVCLISDFYPGAVTVAWKADSSPVKAGVETXTPSKQSNNKYAASSYLSLTPEQWKSHRSY

SEQ ID NO: 737 - protein, 125 aa, Homo sapiens
RSTLTINRVEAGDEADYYCQVWDRNNDHVVFGGGTKLAVLSQPKAAPSVTLFPPSSEELQANKATLVCLISDFYPGAVTVAWKADSSPVKAGVETTTPSKQSNNKYAASSYLSLTPEHWKSHKSY

SEQ ID NO: 738 - protein, 85 aa, Homo sapiens
VAFVGLPMLRGQAQIAAGRVLVVALFGGCGGLHSRLDGAAICLPGHCHGSRVEVTYETHQCGLVGLKLLRGGREQSDRGGSLGLT

SEQ ID NO: 739 - protein, 67 aa, Homo sapiens [sequence omitted]

SEQ ID NO: 740 - protein, 97 aa, Homo sapiens; identical to SEQ ID NO: 725

SEQ ID NO: 741 - protein, 57 aa, Homo sapiens
SWPSFLGPLTLRVSESTHRRSQSLCSERGGRGGERSRPWLRHHQCCFLRPRLSRFLP

SEQ ID NO: 742 - protein, 143 aa, Homo sapiens
  variant (1)...(143): Xaa = Any amino acid
TLTINRVEAGDEADYYCQVWDRNNDHVVFGGGTKLAVLGQPKAAPSVTLFPPSSEELQANKATLVCLISDFYPGAVTVAWKADSSPVKAGVETTTPSKQSNNKYAASSYLXLTPEQWKSHRSYSLGLAYLGHPWGNGGXCVTK

SEQ ID NO: 743 - protein, 53 aa, Homo sapiens
  variant (1)...(53): Xaa = Any amino acid
HXFPHCPTGAQGKPSPGCSFCGTSTAQASXSDSCWPRTCCCFVWRVWWSPLPP

SEQ ID NO: 744 - protein, 105 aa, Homo sapiens
  variant (1)...(105): Xaa = Any amino acid
FCDTXSPIAPRVPKVSQAQAVASVGLPLLRRQXQIAAGRVLVVALFGGCGGLHSRLDGAAICLPGHCHGSRVEVTYETHQCGLVGLKLLRGGREQSDRGGSLGLT

SEQ ID NO: 745 - protein, 59 aa, Homo sapiens
  variant (1)...(59): Xaa = Any amino acid
XGXGPEHTFGWNSLRDQKAPVSHRAEEPGQKSNPRVRCAGETQSSLYLSGWQEGTGSGR

SEQ ID NO: 746 - protein, 78 aa, Homo sapiens
  variant (1)...(78): Xaa = Any amino acid
GTKRPQYPTELRSQARKVTPEFAVQGRHRALFICQDGRRGQGQGAEGXMSVLGAKAPRDLRTGGQVSKVKQLPVQIRA

SEQ ID NO: 747 - protein, 50 aa, Homo sapiens
  variant (1)...(50): Xaa = Any amino acid
PQSSLCRGDTELSLSVRMAGGDRVRALRVXCRCWGPRPREISGQVVRCLR

SEQ ID NO: 748 - protein, 56 aa, Homo sapiens
  variant (1)...(56): Xaa = Any amino acid
NSSPCRSGHSGKHPDPSAWHRPSDTEPLNXGTPTPHHILRAGAPQVDTRTLTPLPL

SEQ ID NO: 749 - protein, 118 aa, Homo sapiens
  variant (1)...(118): Xaa = Any amino acid
GVGVXLFRGSVSEGLCQAEGSGCFPLCPDLHGELFYLRHLTTCPEISRGLGPQHRHXTLSALTLSPPAILTDKESSVSPLHSELWGYFSGLAPQLCGILGPFGPSGCSSQMCVLDXGR

SEQ ID NO: 750 - protein, 60 aa, Homo sapiens
  variant (1)...(60): Xaa = Any amino acid
GARGSESWCPPGEPLPSVYDEVLGCXCSGALCLKVYARQRGQGVFHYALICTGSCFTLDT

SEQ ID NO: 751 - protein, 67 aa, Homo sapiens
  variant (1)...(67): Xaa = Any amino acid
AAPSVTLFPPSSEELQANKATLVCLISDFYPGAVTVAWXADSTPXKAGVETTTPXKQSNNKYPASSY

SEQ ID NO: 752 - protein, 67 aa, Homo sapiens
  variant (1)...(67): Xaa = Any amino acid
IAAGRVLVVALFXGCGGLHSRLXGGAICXPGHCHGSRVEVTYETHQCGLVGLKLLRGGREQSDRGGS

SEQ ID NO: 753 - protein, 97 aa, Homo sapiens; identical to SEQ ID NO: 725

SEQ ID NO: 754 - protein, 56 aa, Homo sapiens
KQHWWCLSHGLDRSPPRPPLSLHRLCDLLCVDSDTLSVSGPRKDGQDYLWGKQYWE

SEQ ID NO: 755 - protein, 139 aa, Homo sapiens
  variant (1)...(139): Xaa = Any amino acid
XPXXRSKVTRKRPCLPSMTLMEEMLREAFRCMTQGKTAKKSCSCSPHFVICFIFXSFESKMTTPRNSVNGTFPAEPMKXPIAMQSGPKPLFRRMSSLVGPTQSFFMRESKTLGAVQIMNGLFHIALGXLLMIPXGXYAP

SEQ ID NO: 756 - protein, 51 aa, Homo sapiens
  variant (1)...(51): Xaa = Any amino acid
EQNDNTQKFSKWDFPGRANERXYCYAIWSKTTLQEDVFTGGPHAKLLHEGI

SEQ ID NO: 757 - protein, 92 aa, Homo sapiens
  variant (1)...(92): Xaa = Any amino acid
GAXIPXGIIRXPPRAMWKSPFIIWTAPKVLDSLMKKLCVGPTSEDILLKSGFGPDCIAIXPFIGSAGKVPFTEFLGVVILLSKLXKIKQITK

SEQ ID NO: 758 - protein, 53 aa, Homo sapiens
  variant (1)...(53): Xaa = Any amino acid
PAGWMRGRGSKSWCPPGEPLTSVYDEVLGCPCSGALCLKVYARQRGXGVFTMP

SEQ ID NO: 759 - protein, 108 aa, Homo sapiens
  variant (1)...(108): Xaa = Any amino acid
VAFVGLPLLRRQAQVAAGRVLVVALFGGCGGLHSRLDGAAICLPGHCHGSRVEVTYETHQCGLVGLKLLXGGREQSDRGGSLGLTCGVDEGQGVKVLVSTWGAPDLSI

SEQ ID NO: 760 - protein, 78 aa, Homo sapiens
  variant (1)...(78): Xaa = Any amino acid
KHXXPSAWHRPSDTEPLNKGTPTPHHILRSGAPQVDTRTLTPCPSSTPQVSPRLPPRSLCSRPPXRSFKPTRPHWCVS

SEQ ID NO: 761 - protein, 124 aa, Homo sapiens
  variant (1)...(124): Xaa = Any amino acid
TFRHRAPEQGHPNTSSYTEVRGSPGGHQDFDPLPLIHPAGQPKAAPSVTLFPPSXEELQANKATLVCLISDFYPGAVTVAWKADSSPVKAGVETTTPSKQSNNKYAASSYLSLTPEQWKSHKSY

SEQ ID NO: 762 - protein, 62 aa, Homo sapiens
NGQVVGEKKVPGSLEKNVKRCSRPMRRIRQEIHRCARLLRSTCQQQLPSLSLGEQDSGVWDF

SEQ ID NO: 763 - protein, 59 aa, Homo sapiens
KSQTPESCSPKLKEGSCCWQVLLRSLAHLCISCLILLIGLEHLFTFFSREPGTFFSPTT

SEQ ID NO: 764 - protein, 87 aa, Homo sapiens
  variant (1)...(87): Xaa = Any amino acid
VSPKAAPSVTLFPPSSEELQANKATLVCLISDFYPGAVTVAWKADSSPVKAGVETTTPSKQXNNKYXASSYLSLTPEQWKXHISYXP

SEQ ID NO: 765 - protein, 55 aa, Homo sapiens
  variant (1)...(55): Xaa = Any amino acid
STLTINRXEAGDEADYYCQVWDRNNDHVVFGGGTKLAVLGQPQGCPLGHSVPALL

SEQ ID NO: 766 - protein, 121 aa, Homo sapiens
  variant (1)...(121): Xaa = Any amino acid
RXVAYVXLPLLRRQAQIAAGXVLVVXLFGGCGGLHSRLDGAAICLPGHCHGSRVEVTYETHQCGLVGLKLLRGGREQSDRGGSLGADLGRPVWSLRRRRHGHYYDPTLDSNSRPHRRLXPC

SEQ ID NO: 767 - protein, 60 aa, Homo sapiens
NSVMMVFKDSRKGVMSQNLPECPSIVRRKRTSLVDVHVLIPWRLGHQTMRFGNICYQDEP

SEQ ID NO: 768 - protein, 73 aa, Homo sapiens
  variant (1)...(73): Xaa = Any amino acid
ARSXWLSDPPRPLPHTRAPEHTFGWNSLRDQKAPVSHRAEEPGQKSNPRVRCAGETQSSLYLSGWQEGTGSGH

SEQ ID NO: 769 - protein, 74 aa, Homo sapiens
  variant (1)...(74): Xaa = Any amino acid
GTKRPQYPTELRSQARKVTPEFAVQERHRALFICQDGRRGQGQGTEGXMSVWGAKAPRDLRTXXHVSXVKXLPR

SEQ ID NO: 770 - protein, 50 aa, Homo sapiens
  variant (1)...(50): Xaa = Any amino acid
PQSSLCRRDTELSLSVRMAGGDRVRALRVXCRCGGPRPREISGXVXMCLX

SEQ ID NO: 771 - protein, 62 aa, Homo sapiens
  variant (1)...(62): Xaa = Any amino acid
QIKRALCLSCTANSGVTFLAWLLSSVGYWGLLVPQAVPAKCVFWSPCMGQGPGGIGEPXRPR

SEQ ID NO: 772 - protein, 59 aa, Homo sapiens
  variant (1)...(59): Xaa = Any amino acid
RELCVSPAQRTLGLLFWPGSSALWDTGAFWSLRLFQPNVCSGARVWGKGLGGSESHXDR

SEQ ID NO: 773 - protein, 102 aa, Homo sapiens
  variant (1)...(102): Xaa = Any amino acid
TGKXFYXRHMXXCPEISRGLGPPHRHXTLSALTLSPPAILTDKESSVSLLHSELWGYFSGLAPQLCGILGPFGPSGCSSQMCVLEPVYGARAWGDRRAXSTA

SEQ ID NO: 774 - protein, 102 aa, Homo sapiens
  variant (1)...(102): Xaa = Any amino acid
MDMRVPAQLLGLLLLWLPGAKCDIQMTQSPSTLSASVGDTVTISCRASQNIDRWLAWHQQKPGKAPNVLIYATSSLEEGVSLRFTGSGSGTQFNLTXTRSAA

SEQ ID NO: 775 - protein, 54 aa, Homo sapiens
  variant (1)...(54): Xaa = Any amino acid
CPNLCDFQFRRRGLIKIYWQWIWDTIQFNHXQVCSLTIXQLIIXNIILHXXXVL

SEQ ID NO: 776 - protein, 68 aa, Homo sapiens
DIRGFAWFLLMPGQPPIYILRGPTTYCNCISDRCRQGGRRLGHLDVTFGTWEPEQQEPQELSGDPHVH

SEQ ID NO: 777 - protein, 50 aa, Homo sapiens
  variant (1)...(50): Xaa = Any amino acid
QNXXXMQNNVXNNKLXNRQAADLXMVKLNCVPDPLPVNLNETPSSKLEVA

SEQ ID NO: 778 - protein, 138 aa, Homo sapiens
  variant (1)...(138): Xaa = Any amino acid
QYTHEFDGDEQFYVDLGRKETAWCLPVLRQFRFDPQFALTNIAVLKHNLNSLIKRSNSTAATNEVPEVTVFSKSPVTLGQPNILICLVDNIFPPVXNITWLSNGHSVTXXVSETSFLSKSDHXFFXIXYPTLLPSSEE

SEQ ID NO: 779 - protein, 60 aa, Homo sapiens
  variant (1)...(60): Xaa = Any amino acid
VPIAQPCDVXHRRKDVVHKTDEDVGLTQCHGRLGKHCDLRNLIGSSGRVGAFNQTVQVMF

SEQ ID NO: 780 - protein, 66 aa, Homo sapiens
PSVTGDLENTVTSGTSLVAAVELERLIRLFKLCFRTAMFVSANCGSNLNCLRTGKHQAVSFLPRST

SEQ ID NO: 781 - protein, 84 aa, Homo sapiens
  variant (1)...(84): Xaa = Any amino acid
SVASVGLPLLRRQAQIAAGRVLVVALFGGCGXLHSRLDGXAIXLPGHCHGSRVEVTYETHQCGLVGLXLLIXGREQSDRXGSLG

SEQ ID NO: 782 - protein, 84 aa, Homo sapiens
  variant (1)...(84): Xaa = Any amino acid
PKAAXSVTLFPPXYEEXQANKATLVCLISDFYPGAVTVAWKXDSXPVKAGVEXTTPSKQSNNKYAASSYLSLTPEQWKSHRSYR

SEQ ID NO: 783 - protein, 51 aa, Homo sapiens
  variant (1)...(51): Xaa = Any amino acid
DTFKWAQCQPTGLLTGTTSQMPFSAHTLQAEARGXHPSGDGXCXCVXVCSA

SEQ ID NO: 784 - protein, 59 aa, Homo sapiens
  variant (1)...(59): Xaa = Any amino acid
PXXVQMSETPSNGPSASQLGSSLAPRPRCPSLPTPCRLRPEEXTPPEMGXVXVCXYVLX

SEQ ID NO: 785 - protein, 59 aa, Homo sapiens
  variant (1)...(59): Xaa = Any amino acid
RRTYXHTXTXPISGGVXSSGLSLQGVGREGHLGRGASEEPSWLALGPFEGVSDIWTXXG

SEQ ID NO: 786 - protein, 58 aa, Homo sapiens
  variant (1)...(58): Xaa = Any amino acid
AEHXHTHXHXPSPEGXPPLASACRVWAEKGIWDVVPVRSPVGWHWAHLKVSQTFGPXX

SEQ ID NO: 787 - protein, 52 aa, Homo sapiens
  variant (1)...(52): Xaa = Any amino acid
PKEVRQLAEDFLKDYIHINIGALELXANHNILXXVDVCHDXXKDEKLIRLME

SEQ ID NO: 788 - protein, 55 aa, Homo sapiens
  variant (1)...(55): Xaa = Any amino acid
QHWWXXSHGXGRSPLRPPLSLHXLCXLLCVDSDTLSVSGPRKGGQDYLWGKQYWE

SEQ ID NO: 789 - protein, 95 aa, Homo sapiens
  variant (1)...(95): Xaa = Any amino acid
STGXXSAMXWAVLLFGLLSHCTXSVXSYVLTQTPSVSVAPGKAAKITCGGNNIGSNNVXWYYQKPGQAPVLIISFDNDRPSGISERFSGFNSGDM

SEQ ID NO: 790 - protein, 90 aa, Homo sapiens
VLTVINYRPHNMRPEDRMFHIRAVILRALSLAFLLSLRGAGAIKADHVSTYAAFVQTHRPTGEFMFEFDEDEMFYVDLDKKETVWHLEEF

SEQ ID NO: 791 - protein, 55 aa, Homo sapiens
VSEELGPSRRTMCQLMPRLYRRIDQQGSLCLNLMKMRCSMWIWTRRRPSGIWRSL

SEQ ID NO: 792 - protein, 56 aa, Homo sapiens
LACCSGPWSCPVLQHGVSEAPWRLLHGSSDSDTDGAELPTGFGWGHQTTFLGVLYV

SEQ ID NO: 793 - protein, 177 aa, Homo sapiens
  variant (1)...(177): Xaa = Any amino acid
LPAALAPGPVLFSSMVCLRLPGGSCMAVLTVTLMVLSSPLALAGDTRPRFLEYSTSECHFFNGTERVRFLDRYFYNQEEYVRFDSDVGEFRAVTELGRPDEEYWNSQKDFLEDRRAAVDTYCRHNYGVGESFTVQRRVHPKVTVYPSKTHPCSTTTSWSVLXVVSIQAALNXVVPEW

SEQ ID NO: 794 - protein, 56 aa, Homo sapiens
APHWLWLGTPDHVSWSTLRLSVISSMGRSGCGSWTDTSITKRSTCASTATWGSSGR

SEQ ID NO: 795 - protein, 70 aa, Homo sapiens [sequence omitted]

SEQ ID NO: 796 - protein, 53 aa, Homo sapiens
STPRNVVWCPQPKPVGSSAPSVSLSELPCRSLQGASDTPCWRTGQDQGPEQQA

SEQ ID NO: 797 - protein, 146 aa, Homo sapiens [sequence omitted]

SEQ ID NO: 798 - protein, 58 aa, Homo sapiens
HSDVEYSKKRGLVSPAKASGELSTISVTVRTAMQEPPGSLRHTMLENRTGPGARAAGK

SEQ ID NO: 799 - protein, 110 aa, Homo sapiens
ALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETR

SEQ ID NO: 800 - protein, 110 aa, Homo sapiens
PGLHELRVLGLVLPIPLPGQCDLRRVEAQGPAPQGGLMVRDGVVGHMCLGGVRALQRLLPVLQVSAEPLHARAIQVGSQLLRLMGRLPLALGDLSRHVRRGPRAQVLVQG

SEQ ID NO: 801 - protein, 70 aa, Homo sapiens
SPQGRSPGPSTSGWPHGQRWGGGSYVSWGGPCAAASPSRSPGICGATPRTCHPGRLSTAPPHGPPPTCAW

SEQ ID NO: 802 - protein, 53 aa, Homo sapiens
  variant (1)...(53): Xaa = Any amino acid
PRGQXWADLGRPVWSLRRRRHGYYYXPXLDSNSXPSSPASDPFDGXGXDLWPX

SEQ ID NO: 803 - protein, 85 aa, Homo sapiens
  variant (1)...(85): Xaa = Any amino acid
XAXVGLPLLRRQAXIAAGRVLVVALFGGCGGLHSRLDGAAICLPGHCHGSRVEVTYETHQCGLVGLKLLRGGREQSDRGGXLGLT

SEQ ID NO: 804 - protein, 129 aa, Homo sapiens
  variant (1)...(129): Xaa = Any amino acid
RAKGPXLXHQKGQKPAMKXDYYCQVXDXNNNHVVFGGGTILAVLSQPKXAPSVTLFPPSSEELQANKATLVCLISDFYPGAVTVAWKADSSPVKAGVETTTPSKQSNNKYAASSYXSLTPEQWKSHXSX

SEQ ID NO: 805 - protein, 140 aa, Homo sapiens
  variant (1)...(140): Xaa = Any amino acid
TLTINRVEAGDEADYYCQVWDLNNDHVVFGGGTKLAVLGQPKAAPSVTLFPPSSEELQANKATLVCLISDFYPGAVTVAWKADSSPVKXGVETTTPXKQSNNKYAASSYXSLTPEQWKSHRXYRPARAXXGEFQHTGGRY

SEQ ID NO: 806 - protein, 71 aa, Homo sapiens
  variant (1)...(71): Xaa = Any amino acid
ETSYXHDXAKLGTELXSTSNAPQCAGIRXXPPGQVCXFCGTSTAQASGXDSCWPRTCCCFVXRVWWSPLXP

SEQ ID NO: 807 - protein, 120 aa, Homo sapiens
  variant (1)...(120): Xaa = Any amino acid
KPAMXMIXPSLVPSSXPLVTPPSVLEFAXXRPGRSVXSVGLPLLRRQAXIAAGRVLVVALFXGCGGLHSXLDGAAICLPGHCHGSRVEVTYETHQCGLVGLKLLRGGREQSDRGGSLGLT

SEQ ID NO: 808 - protein, 80 aa, Homo sapiens
  variant (1)...(80): Xaa = Any amino acid
TXXXNRGEAGDEADYYCQVWDLNNDHVVFGGGTKLXVLGQPKAAPSVTLFPPSSEELQANKATLVCLISDXYPXAVTVAW

SEQ ID NO: 809 - protein, 63 aa, Homo sapiens
  variant (1)...(63): Xaa = Any amino acid
KKIKIYXVYXLTSYTQRIXDFSLKIIIKPPISPVEKEILRFXCFFFQHNSVTYGWEKICREII

SEQ ID NO: 810 - protein, 123 aa, Homo sapiens
  variant (1)...(123): Xaa = Any amino acid
TLTINRVEAGDEADYYCQVWDRNNDHVVFGGGTKLAVLGQPKAAPSVTLFPPSSEELQANKATLVCLISDXYPGAVTVAWKADSSPVKAGVETTTPSKQSNNKYAASSYLSLTPEQWKSHRSY

SEQ ID NO: 811 - protein, 50 aa, Homo sapiens
  variant (1)...(50): Xaa = Any amino acid
LLAAYLLLLCLEGVVVSTPALTGLLSAFQATVTAPGXKSLMRHTSVALLA

SEQ ID NO: 812 - protein, 85 aa, Homo sapiens
  variant (1)...(85): Xaa = Any amino acid
VASVGLPLLRRQAQIAAGRVLVVALFGGCGGLHSRLDGAAICLPGHCHGSRVXVTYETHQCGLVGLKLLRGGREQSDRGGSLGLT

SEQ ID NO: 813 - protein, 71 aa, Homo sapiens
DIRGFAWFLLMPGQPPIYILRGPTTYCNCISDRCRQGGRRLGHLDVTFGTWEPEQQEPQELSGDPHVHAVS

SEQ ID NO: 814 - protein, 124 aa, Homo sapiens
SGHSMDMRVPAQLLGLLLLWLPGAKCDIQMTQSPSTLSASVGDTVTISCRASQNIDRWLAWHQQKPGKAPNVLIYATSSLEEGVSLRFTGSGSGTQFNLTITSLQPDDSATYYCQHYSASLRSF

SEQ ID NO: 815 - protein, 114 aa, Homo sapiens
  variant (1)...(114): Xaa = Any amino acid
TLTINRVEAGDEADYYCQVWDRNNDHVVFGGGTKLAVLGQPKAAPSVTLFPPSSEELQANKATLVCLISDFYPGAVTVAWKXDSSPVKAGVETTTPSKQSNNKYRGQQLSEPDA

SEQ ID NO: 816 - protein, 70 aa, Homo sapiens
  variant (1)...(70): Xaa = Any amino acid
LLPAVLVVALFGGCGGLHSRLDGAAIXLPGHCHGSRVEVTYETHQCGLVGLKLLRGGREQSDRGGSLGLT

SEQ ID NO: 817 - protein, 61 aa, Homo sapiens
TCISRFLGQLFIISLKSHDINSGPHTWGLKKSGTYNRNHIMSLISKPVSCLWTVCVRHAYL

SEQ ID NO: 818 - protein, 65 aa, Homo sapiens
  variant (1)...(65): Xaa = Any amino acid
TLTINRVEAGDGADYYCQVWDRNNDHVVFGGGTKLAVLSQPKAAPSXTLFPPXSXELXANKXTLV

SEQ ID NO: 819 - protein, 61 aa, Homo sapiens
  variant (1)...(61): Xaa = Any amino acid
TPVXPCWLXAXQXRAGTEXPRGQPWADLGRPVWSLRRRRHGHYYDPTLDNNSRPHRRLRPC

SEQ ID NO: 820 - protein, 141 aa, Homo sapiens
  variant (1)...(141): Xaa = Any amino acid
EPXNPSEKNSPSTQYCYSIQSLFLGILSVMLIFAFFQELVIAGIVENEWKXXCSXPKSNIVLLSXEEKKEQTIEIKEEVVGLTETSSQPKNEEDIEIIPIQEEEEEETETNFXEPPQDQESSPIENDSSPXVISSXFXXLF

SEQ ID NO: 821 - protein, 101 aa, Homo sapiens
  variant (1)...(101): Xaa = Any amino acid
SWGGSXKFVSVSSSSSSWIGIISMSSSFFGWEDVSVSPTTSSFISIVCSFFSSXDRRTMLDLGXEHXLFHSFSTMPAITSSWKKAKISITDKMPKNRDCML

SEQ ID NO: 822 - protein, 66 aa, Homo sapiens
DHLKSCYQDSHEDPTKMKRFLFLLLTISLLVMVQIQTGLSGQNDTSQTSSPSASSSMSGGIFLFFV

SEQ ID NO: 823 - protein, 75 aa, Homo sapiens
TKRSLQTALRSPKKLLPRQPRRSYQNEALPLPPTHHQPPGYGTDTNWTLRTKRHQPNQQPLSIQQHERRHFPFLR

SEQ ID NO: 824 - protein, 59 aa, Homo sapiens
TKKRKMPPLMLLDAEGLLVWLVSFCPESPVCICTITRRLMVSRRKRKRFILVGSSWLSW

SEQ ID NO: 825 - protein, 59 aa, Homo sapiens
  variant (1)...(59): Xaa = Any amino acid
PCLRSXXTXKRPCLPXMTLMEEMLREAFXCMTQGKTAKNLVLALLILLFVLFLGVLRAK

SEQ ID NO: 826 - protein, 63 aa, Homo sapiens
  variant (1)...(63): Xaa = Any amino acid
SGCCHFALKTPKNKTNNKMRRARTRFLAVLPCVMHXNASLSISSMSVIXGRHGLXRVXLDLRQ

SEQ ID NO: 827 - protein, 85 aa, Homo sapiens
  variant (1)...(85): Xaa = Any amino acid
VASVGLPLLRRQAQIAAGRVLVVALFGGCGGLHSRLDGAAICLXGHCHXXRVEVTYETHQCXLVGLKLXXGGREXSDRGGSLGLT

SEQ ID NO: 828 - protein, 85 aa, Homo sapiens
  variant (1)...(85): Xaa = Any amino acid
GQPKAAPSVTXFPPSXXELQANKXTLVCLISDFYPXXVTVAXKADSSPVKAGVETTTPSKQSNNKYAASSYLSLTPEQWKSHRSY

SEQ ID NO: 829 - protein, 61 aa, Homo sapiens
ALDRKSLDCPEEVVSRNMDVKGAPAEVLGGNEGHDIGREDGGGDCSDASTDLGDQDAAAIT

SEQ ID NO: 830 - protein, 103 aa, Homo sapiens
VMAAASWSPRSVDASLQSPPPSSRPMSCPSFPPRTSAGAPLTSIFLLTTSSGQSRLFLSSAHCPILSIPQAISPFLGICYGSTPLPGTKTSHMIMTAPHCSGL

SEQ ID NO: 831 - protein, 83 aa, Homo sapiens
  variant (1)...(83): Xaa = Any amino acid
SVXLPLLTRXAQIAAGRVLVVALXGGCGGLHPRLDGAAICLPGHCHGSRVEVTYETHQCGLVGLKLLXGGREQSDRGGSLGLT

SEQ ID NO: 832 - protein, 119 aa, Homo sapiens
  variant (1)...(119): Xaa = Any amino acid
TINRVEAGDEADYYCQVWDRNNDHVXFGGGTKLAVLGQPKAAPSVTLFPPSXEELQANKATLVCLISDFYPGAVTVAWKADSSPVKAGVETTTPSXQSNNKYAASSYLSXTREQWKXHR

SEQ ID NO: 833 - protein, 85 aa, Homo sapiens
  variant (1)...(85): Xaa = Any amino acid
VASVGLPLLRRQAQIAAGRVLVVALFGGCGGLHSRLDGAAICLPGHCHGSRVEVTYETHQCGLVGLKLLXGGREQSDRGGXLGLT

SEQ ID NO: 834 - protein, 121 aa, Homo sapiens
  variant (1)...(121): Xaa = Any amino acid
PSTGSXPXMRXTXNCXVWDRNNDHVVFGGGTKLAVLGQPKXAPSVTLFPPSXEELQANKATLVCLISDFYPGAVTVAWKADSSPVKAGVETTTPSKQSNNKYAASSYLSLTPEQWKSHRSY

SEQ ID NO: 835 - protein, 127 aa, Homo sapiens
  variant (1)...(127): Xaa = Any amino acid
VASVGLPLLRRQAQIAAGRVLVVALFGGCGGLHSRLDGAAICLPGHCHGSRVEVTYETHQCGLVGLKLLRGGREQSDRGGSLGLTXDGQFGPSAEDDMVIITIPHLTVIVGLIAGFDPVDGQGGPRP

SEQ ID NO: 836 - protein, 127 aa, Homo sapiens
  variant (1)...(127): Xaa = Any amino acid
RPRSTLTINRVEAGDEADYYCQVWDRNNDHVVFGGGTKLAVXGQPKAAPSVTLFPPSSEELQANKATLVCLISDFYPGAVTVAWKADSSPVKAGVETTTPSKQSNNKYAASSYLSLTPEQWKSHRSY

SEQ ID NO: 837 - protein, 85 aa, Homo sapiens; identical to SEQ ID NO: 682

SEQ ID NO: 838 - protein, 123 aa, Homo sapiens; identical to SEQ ID NO: 683

SEQ ID NO: 839 - protein, 85 aa, Homo sapiens
  variant (1)...(85): Xaa = Any amino acid
VASVGLPLLGRQAQVAAGRVLVVALFGGFGGLHSRLDGAAICLPGHCHSSRVEVTYETHQXGLXGLXLLXGGREXXDXGGXLGLT

SEQ ID NO: 840 - protein, 54 aa, Homo sapiens
LLPGSCDSGLEGRWQPRQGGSGDHQTLQTEQQQVRGQQLPEPDARAVEVPQKLQ

SEQ ID NO: 841 - protein, 110 aa, Homo sapiens
  variant (1)...(110): Xaa = Any amino acid
DYYCQVXDRNNDHVVFGGGTKLAVLGQPKXAPXVXXFPPSXEEXQAXKAXLVCLISDFYPGAVTVAWKADGSPVKAGVETTKPSKQSNNKYAASSYLSLTPEQWKSHRSY

SEQ ID NO: 842 - protein, 85 aa, Homo sapiens; identical to SEQ ID NO: 682

SEQ ID NO: 843 - protein, 125 aa, Homo sapiens
  variant (1)...(125): Xaa = Any amino acid
RSTLTINRVEADDEXDYYCQVWDRNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 844 - protein, 94 aa, Homo sapiens
  variant (1)...(94): Xaa = Any amino acid
XLACCSGPWSCPVLQHGVSEAPWRLLHGSSDSDTDGAELPTCFGLGTPDHVSWSTLRLSVISSMGRSGCGSWTDTSITKRSTCASTATWGSSGR

SEQ ID NO: 845 - protein, 57 aa, Homo sapiens
VLPAALAPGPVLFSSMVCLRLPGGSCMAVLTVTLMVLSSPLALGWGHQTTFLGVLYV

SEQ ID NO: 846 - protein, 93 aa, Homo sapiens
  variant (1)...(93): Xaa = Any amino acid
APHLLWAGDTRPRFLEYSTSECHFFNGTERVRFLDRYFYNQEEYVRFDSDVGEFRAVXELGRADEEYWNSXXGLPGXQAXRGGHLLXTQLRGW

SEQ ID NO: 847 - protein, 121 aa, Homo sapiens
  variant (1)...(121): Xaa = Any amino acid
VSTAXRLXSRKSXXAVPVLLISPPQLXHRPELPHVAVEAHVLLLVIEVSVQEPHPLRPIEEMTLRRRVLQETWSGVPSPKQVGSSAPSVSLSELPCRSLQGASDTPCWRTGQDQGPEQQAR

SEQ ID NO: 848 - protein, 54 aa, Homo sapiens
  variant (1)...(54): Xaa = Any amino acid
QPRSCXCSRCPPXPACXPGSPXWLFQYSSSARPSXVTARNSPTSLSKRTYSSWL

SEQ ID NO: 849 - protein, 59 aa, Homo sapiens
HSDVEYSKKRGLVSPAQSKWGAQHHQCHCQNCHAGASREPQTHHAGEQDRTRGQSSRQD

SEQ ID NO: 850 - protein, 67 aa, Homo sapiens
  variant (1)...(67): Xaa = Any amino acid
NPVVVXAVGVHRXPPXFQEVLXGCSSTPHQPAPAXSPPGTPPRRCRSARTPLGYRSICPGTAPAPSH

SEQ ID NO: 851 - protein, 55 aa, Homo sapiens
  variant (1)...(55): Xaa = Any amino acid
STPRNVVWCPQPKASGELSTISVTVRTAMQEPPGSLRHTMLENRTGPGARAAGKX

SEQ ID NO: 852 - protein, 146 aa, Homo sapiens
  variant (1)...(146): Xaa = Any amino acid
KMESLNFIRAHTPYINIYNCEPPNPSEKNSPSTQYXYSIQSLFLGILSVMLIFAFFQELVIXGIVDNEWKRTCSRPKSNIVLLSAEEKKEXTIEIKEEVVGLTETSSQPKNEEXIEIIPXQEEEEERNXRRTFQNXPRSGILTNRK

SEQ ID NO: 853 - protein, 137 aa, Homo sapiens
  variant (1)...(137): Xaa = Any amino acid
CHFLLVRIPDLXRFWKVRLXFLSSSSSXIGIISMXSSFFGWEDVSVSPTTSSFISIXCSFFSSADRRTMLDLGLEHVLFHSLSTMPXITSSWKKAKISITDKMPKNRDCMLXQYWVDGEFFSEGLGGSQLYMLIYGV

SEQ ID NO: 854 - protein, 59 aa, Homo sapiens
  variant (1)...(59): Xaa = Any amino acid
AATASIAGAPTQYPPGRGGPPPPMGRRTPPPGMMGPPPXFXTSYGCPQWGIPXGRXLQW

SEQ ID NO: 855 - protein, 59 aa, Homo sapiens
  variant (1)...(59): Xaa = Any amino acid
PLEXSSXGDPPLGAPIGGXKXGRWAHHAWRGCSSAHRWGRTPTARWVLGWSPGNTGCGS

SEQ ID NO: 856 - protein, 50 aa, Homo sapiens
KLLEGTCYNGRLIWKVTDYKMKKREAVDGHTVSIFSQSFYTNPLWLPALC

SEQ ID NO: 857 - protein, 61 aa, Homo sapiens
RRERRWMGTQCPSSASPSTPTRCGYRLCARAYLNGDGSGRGSHLSLYFVVMRGEFDSLLQW

SEQ ID NO: 858 - protein, 85 aa, Homo sapiens; identical to SEQ ID NO: 682

SEQ ID NO: 859 - protein, 123 aa, Homo sapiens; identical to SEQ ID NO: 683

SEQ ID NO: 860 - protein, 123 aa, Homo sapiens
GHSMDMRVPAQLLGLLLLWLPGAKCDIQMTQSPSTLSASAGNTVTISCRASQNIDRWLAWHQQKPGKAPNVLIYATSSLEEGVSLRFTGSGSGTQFNLTITSLQPDDSATYYCQHYSASLRSF

SEQ ID NO: 861 - protein, 71 aa, Homo sapiens
DIRGFAWFLLMPGQPPIYILRGPTTYCNCISGRCRQGGRRLGHLDVTFGTWEPEQQEPQELSGDPHVHAVS

SEQ ID NO: 862 - protein, 57 aa, Homo sapiens
GSSTGGASAMAWTVLLLGLLSHCTDSVTSYVLTQTPSVSVAPGKDGQDYLWGKQYWE

SEQ ID NO: 863 - protein, 65 aa, Homo sapiens
LRHPQCQWPQEKTAKITCGGNNIGSNNVHWYYQKPGQAPVLIISFDNDRPSGISERFSGFNSGDM

SEQ ID NO: 864 - protein, 72 aa, Homo sapiens
KQHWWCLSHGLDRSPPRPPLSLHRLCDLLCVDSDTLSVSGPRKRRPRLPVGETILGVTMYTGITRSQARPLS

SEQ ID NO: 865 - protein, 72 aa, Homo sapiens
DRGLAWLLVIPVYIVTPNIVSPTGNLGRLFLGPLTLRVSESTHRRSQSLCSERGGRGGERSRPWLRHHQCCF

SEQ ID NO: 866 - protein, 69 aa, Homo sapiens
SSTGGASAMAWTVLLLGLLSHCTGDPPRVSPTCPAQGFWVQRVLNSELRRALPVVGRMLMTLVQGGKVG

SEQ ID NO: 867 - protein, 59 aa, Homo sapiens
AALVVPQPWPGPFSSSASSLTAQVIPPGSHQPAQPKASGSSVSLILSSGGPFLWWAGCS

SEQ ID NO: 868 - protein, 115 aa, Homo sapiens
  variant (1)...(115): Xaa = Any amino acid
VASVGLPLLRRQAQIAAGRVLVVALFGGCGGLHSRLDGAAICLPGHCHGSRVEVTYETHQRGLVGLKLLXXRRETEXPRGXLGLTRTAVWSSAKHMALLRSTLDSNSXLIXGFTL

SEQ ID NO: 869 - protein, 97 aa, Homo sapiens
  variant (1)...(97): Xaa = Any amino acid
CHVFGGGPNCRPSQPKXAPRXFCFPPXXEEFQANKATLVCLISDFYPGAVTVAWKADSSPVKAGVETTTPSKQSNNKYAASSYLSLTPEQWKSHRSY

SEQ ID NO: 870 - protein, 75 aa, Homo sapiens
  variant (1)...(75): Xaa = Any amino acid
XGFALRCRGRVHPDHHRVKPXMSXLLLSSVDRNNAMCLAEDQTAVLVSPRXPLGXSVSRLXXRSFKPTRPRWCVS

SEQ ID NO: 871 - protein, 67 aa, Homo sapiens
  variant (1)...(67): Xaa = Any amino acid
PRMMKTVPTTMPTRPTDNPRAQTTVSVSSDIGAGISGSQCFRRGLSSPQCSTLQSXLSSXEGRRVRX

SEQ ID NO: 872 - protein, 66 aa, Homo sapiens
  variant (1)...(66): Xaa = Any amino acid
XLTLLPSXEEXYDCKVEHWGLDKPLLKHWEPEIPAPMSELTETVVCALGLSVGLVGIVVGTVFIIR

SEQ ID NO: 873 - protein, 63 aa, Homo sapiens
  variant (1)...(63): Xaa = Any amino acid
GLCLVSVDARPTTDLYSERPRQLIVTGISDRCRQGGRRLGHLDVTFGTWEPEQQEPXELSGDP

SEQ ID NO: 874 - protein, 77 aa, Homo sapiens
VVGASQNIDRWLAWHQQKPGKAPNVLIYATSSLEEGVSLRFTGSGSGTQFNLTITSLQPDDSATYYCQHYSASLRSF

SEQ ID NO: 875 - protein, 97 aa, Homo sapiens
  variant (1)...(97): Xaa = Any amino acid
GSSTGGASAMAWTVLLLGLLSHCTDSVTSYVLTQTPSVSVAPGKTAKITCGGNNIGSHNVHWYYQKPGQAPVLIISFDNDRXSXISERFSGFNSGDM

SEQ ID NO: 876 - protein, 76 aa, Homo sapiens
KQHWWCLSHGLDRSPPRPPLSLHRFCDFLCVDSDTLSVSGPRKDGQDYLWGKQYWESQCTLVLPEARPGPCPNHLF

SEQ ID NO: 877 - protein, 94 aa, Homo sapiens
  variant (1)...(94): Xaa = Any amino acid
NEKALLLCNLVQNHSSGRMSSLVGPTQSFFMRESKTLGAVQIMNGLFHIALGGLLMIPAGIYAPICVTVWYPLWGGIMYIISGSLLXQRKKLQE

SEQ ID NO: 878 - protein, 60 aa, Homo sapiens
  variant (1)...(60): Xaa = Any amino acid
DFGGCPDYEWALPHCPGGSSDDPSRDLCTHLCDCVVPSLGRHYVYYFRITPAXTEKTPGS

SEQ ID NO: 879 - protein, 60 aa, Homo sapiens
IPAGIIRRPPRAMWKSPFIIWTAPKVLDSLMKKLCVGPTSEDILPEEWFWTRLHSNRAFS

SEQ ID NO: 880 - protein, 62 aa, Homo sapiens
SGNNIHNASPERVPHSHTDGCIDPCWDHQKTPQGNVEEPIHNLDSPQSLRFPHEEALRGAHQ

SEQ ID NO: 881 - protein, 71 aa, Homo sapiens [sequence omitted]

SEQ ID NO: 882 - protein, 73 aa, Homo sapiens
TKISLNIEVWNYFFDISANSLKLKDPQITVNSLKQGCTMASHAKDGTRRNTTAVNCEDNFHFFPRREQFTGQR

SEQ ID NO: 883 - protein, 118 aa, Homo sapiens
MRVPAQLLGLLLLWLPGAKCDIQMTQSPSTLSASVGDTVTISCRASQNIDRWLAWHQQKPGKAPNVLIYATSSLEEGVSLRFTGSGSGTQFNLTITSLQPDDSATYYCQHYSASLRSF

SEQ ID NO: 884 - protein, 66 aa, Homo sapiens
DIRGFAWFLLMPGQPPIYILRGPTTYCNCISDRCRQGGRRLGHLDVTFGTWEPEQQEPQELSGDPH

SEQ ID NO: 885 - protein, 109 aa, Homo sapiens
TLTINRIEAGDEADYYCQVWDLNNDHVVFGGGTKLAVLGQPKAAPSVTLFPPSSEELQANKATLVCLISDFYPGAVTVAWKADSSPVKAGVETTTPSKQSNNKYAAAAI

SEQ ID NO: 886 - protein, 85 aa, Homo sapiens
CSFCGTSTAQASGSDSCCRVLVVALFGGCGGLHSRLDGAAICLPGHCHGSRVEVTYETHQCGLVGLKLLRGGREQSDRGGSLGLT

SEQ ID NO: 887 - protein, 51 aa, Homo sapiens
VASVGLPLLRRQAQIAAAAYLLLLCLEGVVVSTPALTGLLSAFQATVTAPG

SEQ ID NO: 888 - protein, 118 aa, Homo sapiens
  variant (1)...(118): Xaa = Any amino acid
TLTINRVEAGDEADYYCQVWDLNNDHVVFGGGTKLAVLGQPKAAPSVTLFPPSSEELQANKATLVCLISDFYPGAXTVAWKADSSPVKAGVETTTPXKQSNNKYAASSYLSLTPEQWK

SEQ ID NO: 889 - protein, 80 aa, Homo sapiens
  variant (1)...(80): Xaa = Any amino acid
LPLLRRQAQIAAGRVLVVALFXGCGGLHSRLDGAAICLPGHCXGSRVEVTYETHQCGLVGLKLLRGGREQSDRGGSLGLT

SEQ ID NO: 890 - protein, 62 aa, Homo sapiens
LSLGLRKQHWWCLSHGLDRSPPRPPLSLHRLCDLLCVDSDTLSVSGPRKDGQDYLWGKQYWE

SEQ ID NO: 891 - protein, 97 aa, Homo sapiens; identical to SEQ ID NO: 725

SEQ ID NO: 892 - protein, 52 aa, Homo sapiens
SWPSFLGPLTLRVSESTHRRSQSLCSERGGRGGERSRPWLRHHQCCFLRPRL

SEQ ID NO: 893 - protein, 68 aa, Homo sapiens
  variant (1)...(68): Xaa = Any amino acid
TLTINRVEAGDEADYYCQVWDRNNDHVVFGGGTKLAVLGQPKAAPSXTLFPPSSEELQANKATLVCLI

SEQ ID NO: 894 - protein, 62 aa, Homo sapiens
  variant (1)...(62): Xaa = Any amino acid
DTPVWPCWLEAPQRRAGTEXPRGQPWADLGRPVWSLRRRRHGHYYDPTLDSNSRPHRRLRPC

SEQ ID NO: 895 - protein, 85 aa, Homo sapiens; identical to SEQ ID NO: 682

SEQ ID NO: 896 - protein, 123 aa, Homo sapiens
TLTINRVEAGDEADYYCQVWDHNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 897 - protein, 115 aa, Homo sapiens
PAQLLGLLLLWLPGAKCDIQMTQSPSTLSASVGDTVTISCRASQNIDRWLAWHQQKPGKAPNVLIYATSSLEEGVSLRFTGSGSGTQFNLTITSLQPDDSATYYCQHYSASLRSF

SEQ ID NO: 898 - protein, 63 aa, Homo sapiens
DIRGFARFLLMPGQPPIYILRGPTTYCNCISDRCRQGGRRLGHLDVTFGTWEPEQQEPQELSG

SEQ ID NO: 899 - protein, 85 aa, Homo sapiens; identical to SEQ ID NO: 682

SEQ ID NO: 900 - protein, 53 aa, Homo sapiens
DGQFGPSAEDDMVIITIPHLTVIVGLIAGFDPVDGQGGHVPRIEARPGPCPNH

SEQ ID NO: 901 - protein, 139 aa, Homo sapiens
MIRTGAWPGFNSGDMATLTINRVEAGDEADYYCQVWDRNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 902 - protein, 85 aa, Homo sapiens
  variant (1)...(85): Xaa = Any amino acid
VASVXLPLLRRQAQIAAGRVLVVALFGGCGGLHSRLDGAAICLPGHCHGSRVEVTYETHXXGLXGLKLXRGGREQSDRGGSLGLT

SEQ ID NO: 903 - protein, 107 aa, Homo sapiens
  variant (1)...(107): Xaa = Any amino acid
VKCGIXNNDXVXXGXGTKLAVLGQPKAAPSVTLFPPSSXELQAXKAXXVCLISDFYPGAVTVAWKADSSPVKAGVETTTPSKQSNNKYAASSYLSLTPEQWKXHRSY

SEQ ID NO: 904 - protein, 55 aa, Homo sapiens
  variant (1)...(55): Xaa = Any amino acid
VASXGLPLLRRQAQIAAGRVLVXALFGGCGXLHSXLDGAXICLPGHCHXSRXEVT

SEQ ID NO: 905 - protein, 55 aa, Homo sapiens
  variant (1)...(55): Xaa = Any amino acid
SDFXPGXVTVAWKADXSPVKXGVEXTTPSKQSXNKYAASSYLSLTPEQWKSXRSY

SEQ ID NO: 906 - protein, 101 aa, Homo sapiens
  variant (1)...(101): Xaa = Any amino acid
VASVXLPLLRRQAQIAAGRVLVVALFGGCGGLHSRLDGAAICLPXHCHGSRVEVTYETHQCGLVGLKLLXGXRXQSDRXGXLGLTXDGQXGPSAEXDMVII

SEQ ID NO: 907 - protein, 101 aa, Homo sapiens
  variant (1)...(101): Xaa = Any amino acid
NNDHVXFGGGTXLAVXGQPKXAXSVTLXPXSXEELQANKATLVCLISDFYPGAVTVXWKADSSPVKAGVETTTPSKQSNNKYAASSYLSLTPEQWKXHRSY

SEQ ID NO: 908 - protein, 57 aa, Homo sapiens
  variant (1)...(57): Xaa = Any amino acid
PRGQPWADLNLGLDPGSGSQLCDSRASAPRALGPSKVSXEVPPSDPLFPIPQEMEPT

SEQ ID NO: 909 - protein, 189 aa, Homo sapiens
  variant (1)...(189): Xaa = Any amino acid
VASVGLPLLRRQAQIAAGRVLVVALFGGCGGLHSRLDGAAICLPGHCHGSRVEVTYETHQCGLVGLKLLRGGREQSDRGGSLGLTSIWVWILALGPSSVIPEHQPRGHWVLLKSPXRCLPQTPCSQFPRRWNPRNPRVNLFRQEPRLRGPEQNKAXRPSLRLSDTQRDKQRERDRQTDXQTRLSRSFYL

SEQ ID NO: 910 - protein, 113 aa, Homo sapiens
  variant (1)...(113): Xaa = Any amino acid
ASSVXLSVCLSLSVCLFVCLTGADWVXKPCSVLAPSVWVLVGTGLPLGYVGSISWGIGNKGSEGGTXWETLEGPSALGADARESQSWDPEPGSRPRLRSAQGCPLGHSVPALL

SEQ ID NO: 911 - protein, 50 aa, Homo sapiens
  variant (1)...(50): Xaa = Any amino acid
QAQTGSXSLVLFWPPQSGFLSEQVYPWVTWVPSPGELGTRGLREAPXGRL

SEQ ID NO: 912 - protein, 85 aa, Homo sapiens
GQPKAAPSVTLFPPSSEELQANKATLVCLISDFYPGAVTVAWKADSSPVKAGVETTTPSKQSNNKYAASSYLSLTPEQWKSHRSY

SEQ ID NO: 913 - protein, 85 aa, Homo sapiens
  variant (1)...(85): Xaa = Any amino acid
VASVXLPLLRRQAQIAAGRVLVVALFGGCGGLHSRLDGAAICLPGHCHGSRVEVTYETHQCGLVGLKLLRGGREQSDRGGSLGLT

SEQ ID NO: 914 - protein, 111 aa, Homo sapiens
  variant (1)...(111): Xaa = Any amino acid
ADYYCXVWDXNNDHVVFGGGTKLAVLGQPKAAPSVTLFPPSSEELQANKATLVCLISDFYPGAVTVAWKADSSPVKAGVETTTPSKQSNNKYAASSYLSLTPEQWKXHRSY

SEQ ID NO: 915 - protein, 75 aa, Homo sapiens
  variant (1)...(75): Xaa = Any amino acid
VSPXLPPXXLMXXPSSEELQANKATLVCLIXDFYPGAVTVAWKAXSXPVKAXVXTXTXSKQSNNKYAXXSYLSPD

SEQ ID NO: 916 - protein, 54 aa, Homo sapiens
  variant (1)...(54): Xaa = Any amino acid
TLTINRVEAGDEADYYCQVWDRNNDHVVFGGXTKLAXLGQPXXAPXXTHXXALL

SEQ ID NO: 917 - protein, 109 aa, Homo sapiens
  variant (1)...(109): Xaa = Any amino acid
VRTQIAXXRVLVVALFGXCXGXHXRLDGXAXCLPGHCHGSRVEVXYETHQCGLVGLKLLRGGXXHEXXRGQXWADLXRPVWXXRRRRHGHYYDPTLDSNSRPHRRLRPC

SEQ ID NO: 918 - protein, 85 aa, Homo sapiens; identical to SEQ ID NO: 682

SEQ ID NO: 919 - protein, 52 aa, Homo sapiens
  variant (1)...(52): Xaa = Any amino acid
TINRXEAGDEXXYYCQVWDRNNDHXVFDGGTKTGRPRSAQGCPLGHSVPALL

SEQ ID NO: 920 - protein, 121 aa, Homo sapiens
  variant (1)...(121): Xaa = Any amino acid
PSTGXKPAMXPXITVKCGIVIMTMXSSTEGPKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 921 - protein, 109 aa, Homo sapiens
  variant (1)...(109): Xaa = Any amino acid
VASVXLPLLRRXAQIAAGRVLVVALFGGCGGLHSRLDGAAICLPGHCHGSRVEVTYETHQCGLVGLKLLRGGREXSDRGGXLXLTXDGQFGPSAEDDMVIITIPHLTVI

SEQ ID NO: 922 - protein, 109 aa, Homo sapiens
  variant (1)...(109): Xaa = Any amino acid
YYCQVWDRNNDHVVFGGGTKLAVXGQXKXAPSVTXFPPSSEELQANKATLVCLISDFYPGAVTVAWKADSSPVKAGVETTTPSKQSNNKYAASSYLSXTPEQWKXHRSY

SEQ ID NO: 923 - protein, 83 aa, Homo sapiens
  variant (1)...(83): Xaa = Any amino acid
SVGLPLLRRXAXIAAGRVLVVAXXGGCGGXHSRLDGAAICLPGHCHGSRVEVTYETHXCGLVGLKLLXGGREQSDRGGSLGLT

SEQ ID NO: 924 - protein, 122 aa, Homo sapiens
  variant (1)...(122): Xaa = Any amino acid
ATLTINRVEAGDEADYYCQVWDRNNDHVVFGGGTKLAVLGQPKAAPSVTLFPPSXEELQANKATXVCLISDFYPGAVTVAWKADSSPVKAGVXTTTPSXXSNNKYAASSYXSXTPEQWKSHR

SEQ ID NO: 925 - protein, 84 aa, Homo sapiens
  variant (1)...(84): Xaa = Any amino acid
TLTINRVEAGDEADYYCQVWDRNNDHVXFXGGTKLAVLGQPKAAPSVTLFPPSSEELQANKATLVCLISDFYPGAVTVAWKADS

SEQ ID NO: 926 - protein, 121 aa, Homo sapiens
  variant (1)...(121): Xaa = Any amino acid
GHSMDMRVPAQLLGLLLLWLPGAKCDIQMTQSPSTLSASVGDTVTISXRASXNIDRWLAWHQQKPGKAPNVLIYATSSLEEGVSLRFTGSGSGTQFNLTITSLQPDDSATYYCQHYXASLX

SEQ ID NO: 927 - protein, 71 aa, Homo sapiens
  variant (1)...(71): Xaa = Any amino acid
DIRGFAWFLLMPGQPPIYIXRGPXTYCNCISDRCRQGGRRLGHLDVTFGTWEPEQQEPQELSGDPHVHAVS

SEQ ID NO: 928 - protein, 150 aa, Homo sapiens
KMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 929 - protein, 53 aa, Homo sapiens [sequence omitted]

SEQ ID NO: 930 - protein, 101 aa, Homo sapiens
SWGGSGKFVSVSSSSSSWIGIISMSSSFFGWEDVSVSPTTSSFISIVCSFFSSADRRTMLDLGLEHVLFHSFSTMPAITSSWKKAKISITDKMPKNRDCML

SEQ ID NO: 931 - protein, 123 aa, Homo sapiens
TLTINRVEAGDEADYYCQVWDRNYDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 932 - protein, 85 aa, Homo sapiens; identical to SEQ ID NO: 682

SEQ ID NO: 933 - protein, 150 aa, Homo sapiens; identical to SEQ ID NO: 928

SEQ ID NO: 934 - protein, 101 aa, Homo sapiens; identical to SEQ ID NO: 930

SEQ ID NO: 935 - protein, 61 aa, Homo sapiens [sequence omitted]

SEQ ID NO: 936 - protein, 114 aa, Homo sapiens
  variant (1)...(114): Xaa = Any amino acid
IPPKLCSRTCENLRDCTCQEKVVSFQFEVSIQQDICGPLGLRLIAGDTLRVYRLSGFCLGQQDKGFQKEYLSLGRQPLXHLFFXLFIYFFIYSYLCRLCDLLCVDSDTLSVSGP

SEQ ID NO: 937 - protein, 64 aa, Homo sapiens
  variant (1)...(64): Xaa = Any amino acid
GFTDSLDFVWDSRTRDFKRNTFHLEGNLSXIYSFXYLFIFLFILIFADSVTSYVLTQTPSVSVA

SEQ ID NO: 938 - protein, 82 aa, Homo sapiens [sequence omitted]

SEQ ID NO: 939 - protein, 88 aa, Homo sapiens
  variant (1)...(88): Xaa = Any amino acid
EPEGLHLPRESSEFSVRSLHTTGHLWATGATADCRGYPEGLQTLWILSGTAGQGISKGIPFTWKATSLXFILLXIYLFFYLFLSLQTL

SEQ ID NO: 940 - protein, 66 aa, Homo sapiens
KLTTFSWQVQSLRFSQVLEHSLGGIQPHQPPTLHQGHEHPAHHRKGPPELRIKDTLDPEALGWAGW

SEQ ID NO: 941 - protein, 136 aa, Homo sapiens
  variant (1)...(136): Xaa = Any amino acid
IXKRINXREVAFQVKGIPFEIPCPAVPDKIQRVCKPSGYPLQSAVAPVAHKCPVVWRLRTENSLLSLGRCSPSGSHKSLSTVWGEFSPTSLPPCTRVMSILPTTGRALLSSELRTRWTQKPWAGQVGETLGGSPVQ

SEQ ID NO: 942 - protein, 84 aa, Homo sapiens
  variant (1)...(84): Xaa = Any amino acid
TLTINRVEAGDEADYYCQVWDRNNDHVVFGGGTKLAVLGQPKAAPSVTLFPPSSEELQANKATLVCLISDFYPXAVTVAWKAXS

SEQ ID NO: 943 - protein, 85 aa, Homo sapiens
  variant (1)...(85): Xaa = Any amino acid
VASVGLPLLXRXAQIAAGRVLVVALFGGCGGLHSRLDGAAICLPGHCHGSRVEVTYETHQCGLVGLKLLIGGRXQXDRXGSLXLT

SEQ ID NO: 944 - protein, 121 aa, Homo sapiens
  variant (1)...(121): Xaa = Any amino acid
TINRVEAGXEADYYCQVWDRNNDHVVFGGGTKLAVLGQXKAAXSVXLXPPSYEELQANKATLVCLISDFYPGAVTVAWKADSSPVKAGVETTTPSKQSNNKYAASSYLSXTXEQWKSHRSY

SEQ ID NO: 945 - protein, 119 aa, Homo sapiens
  variant (1)...(119): Xaa = Any amino acid
VASVGLPLLRRQAQIAAGRVLVVALFGGCGGLHSRLDGAAICLPGHCHGSRVEVTYETHQCGLVGLKLLRGGREQSDRGGSLGLTXXGQFGPSAXDDMVHYYDPTLDSNSRPHRRLXPC

SEQ ID NO: 946 - protein, 121 aa, Homo sapiens
  variant (1)...(121): Xaa = Any amino acid
PSTGXKPAMRPTITVKCGIVIMNHVVXGGGTKLAXXGQPKAAPSVTLFPPSSEELQANKATLVCLISDFYPGAVTVAWKADSSPVKAGVETTTPSKQSNNKYAASSYLSLTPEQWKSHRSY

SEQ ID NO: 947 - protein, 56 aa, Homo sapiens
  variant (1)...(56): Xaa = Any amino acid
TATLTINRXEAGDEADYYCQVWDRNNEPCRLXRRDQTGRXRSAQGCPLGHSVPALL

SEQ ID NO: 948 - protein, 62 aa, Homo sapiens
  variant (1)...(62): Xaa = Any amino acid
TLTINRVEAGDEADYYCQVWDRNNDHVVFXGGTKLAVLGXPKAAPSVTLFPPSSXELQXNKA

SEQ ID NO: 949 - protein, 101 aa, Homo sapiens
  variant (1)...(101): Xaa = Any amino acid
VASVXLPLLXRQAQIAAGRVLVVALFGGCGGLHSRLDGAAICLPGHCHGSRVEVTYETHXCGLVGLKLLRGGREXXDRXGSLGLTXDGQFGSSAXXDMVNY

SEQ ID NO: 950 - protein, 102 aa, Homo sapiens
  variant (1)...(102): Xaa = Any amino acid
LIIDHVXXGGGTKLAVXGQPKAAXSVXXFPPSSEELQANKATXVCLISDFYPGAVTVAWKADSSPVKAGVETTTPSKQSNNKYAASSYLSLTXEQWKXHRSY

SEQ ID NO: 951 - protein, 67 aa, Homo sapiens
  variant (1)...(67): Xaa = Any amino acid
VASVXLPLLRRQAQIAAGRVLVVALFGGCGGLHSRLDGAAICLPGHCHGSRVEVTYETHQCGLXGLK

SEQ ID NO: 952 - protein, 67 aa, Homo sapiens
  variant (1)...(67): Xaa = Any amino acid
LQAXKATLVCLISDFYPGAVTVAWKADSSPVKAGVETTTPSKQSNNKYAASSYLSLTPEQWKXHRSY

SEQ ID NO: 953 - protein, 83 aa, Homo sapiens
  variant (1)...(83): Xaa = Any amino acid
TLTINRVEAGDEADYYCQVWDRNNDHVVFGGGTKLAVLGQPKAAPSVTLFPPSSEELQANKATLVCLISDFLPGSRDXGLXGX

SEQ ID NO: 954 - protein, 58 aa, Homo sapiens
  variant (1)...(58): Xaa = Any amino acid
LRKQHWWCLSHGLDRSPPRPPLSLHRLCDLLCVDSDTLSVSGPXKDGQDYLWGKQYWE

SEQ ID NO: 955 - protein, 77 aa, Homo sapiens
  variant (1)...(77): Xaa = Any amino acid
GSSTGGASAMAWTVLLLGLLSHCTDSVTSYVLTQTPSVSVAPXKTAKITCGGNNIGSNNVHWYYQKXGXAPVPNHLF

SEQ ID NO: 956 - protein, 55 aa, Homo sapiens
  variant (1)...(55): Xaa = Any amino acid
LRHPQCQWPXERRPRLPVGETILGVTMYTGITRSXAXPLFLIISFDNDRXSGISE

SEQ ID NO: 957 - protein, 69 aa, Homo sapiens
  variant (1)...(69): Xaa = Any amino acid
VASXGLPLLRRQAQIAAGRVLVVTLFGGCGGLHSRLDGAAICLPGHCHGSRVEVTYETHXCGLVGLKLL

SEQ ID NO: 958 - protein, 69 aa, Homo sapiens
  variant (1)...(69): Xaa = Any amino acid
EELQANKATXVCLISDFYPGAVTVAWKADSSPVKAGVETTTPSKQSNNKYAASSYLSLTPEQWKSXRSY

SEQ ID NO: 959 - protein, 97 aa, Homo sapiens; identical to SEQ ID NO: 725

SEQ ID NO: 960 - protein, 56 aa, Homo sapiens
KQHWWCLGHGLDRSPPRPPLSLHRLCDLLCVDSDTLSVSGPRKDGQDYLWGKQYWE

SEQ ID NO: 961 - protein, 87 aa, Homo sapiens
GSSTGGASAMAWTVLLPGLLSHCTDSVTSYVLTQTPSVSVAPGKTAKITCGGNNIGSYSVHWYYQKPGQAPVLIISFDNDRPPGQVQ

SEQ ID NO: 962 - protein, 63 aa, Homo sapiens
  variant (1)...(63): Xaa = Any amino acid
SSLLITTGRPGRSNEDTPQLYVACGRGPRSSLRVLRHGLEVSEMAVSELPGXPKRCLDSASTH

SEQ ID NO: 963 - protein, 76 aa, Homo sapiens
KQHWWCLSHGLDRSPPRPPLSLHRLCDLLCVDSDTLSVSGPRKDGQDYLWGKQYWELQCTLVLPKARPGPCPNHLF

SEQ ID NO: 964 - protein, 71 aa, Homo sapiens
  variant (1)...(71): Xaa = Any amino acid
CRHQTHLQCVDALSRQRLGXPGSSETAISDTSSPCLRTLRDDRGPLPQATYNCGVSSLDLPGRPVVIKRDD

SEQ ID NO: 965 - protein, 89 aa, Homo sapiens
  variant (1)...(89): Xaa = Any amino acid
GGIHERHNDVGIKLIFNVSTHCPDSVWGXQVAQKQPFLTPQVHVLGLSEMIGVPYHRPHTTVEYLHWTCPGGRSLSKEMIRTGAWPGFW

SEQ ID NO: 966 - protein, 66 aa, Homo sapiens
  variant (1)...(66): Xaa = Any amino acid
TLTINRVEAGDEADYYCQVWDRNNDHVVFGGXTKLAVLGQPKAAPSVTLFPPSSEELQANKATLVC

SEQ ID NO: 967 - protein, 51 aa, Homo sapiens
  variant (1)...(51): Xaa = Any amino acid
VAXAGLPLLRRQAQIAAGRVLVVALFGGCGGLHSRLDGAAICLPGHCHGSR

SEQ ID NO: 968 - protein, 51 aa, Homo sapiens
  variant (1)...(51): Xaa = Any amino acid
PGAVTVAWKADSSPVKAGVETTTPSKQSNNKYAASSYLSLTPEQWKSGXSY

SEQ ID NO: 969 - protein, 52 aa, Homo sapiens
  variant (1)...(52): Xaa = Any amino acid
TLTINRVEAGDEADYYCQVWDLNDDHVVFGGXTKLAVLGQPKAAPSVTLXPP

SEQ ID NO: 970 - protein, 66 aa, Homo sapiens
  variant (1)...(66): Xaa = Any amino acid
TLTINRVEAGDEADYYCQVWDRNNDHVVFGGXTKLAVLGQXKAXPSVTLFPPSXXELQANKATLVC

SEQ ID NO: 971 - protein, 56 aa, Homo sapiens
  variant (1)...(56): Xaa = Any amino acid
VASXXLPLLRRQAXIAAGRVLVVALFGGCGGLHSRLDGAAICLPGHCHGSRVEVTL

SEQ ID NO: 972 - protein, 55 aa, Homo sapiens
  variant (1)...(55): Xaa = Any amino acid
SDFYPGAVTVAWKADSSPVKAGVETTTPSKQSNNKYAASSYXSLTPEQWKXXRSY

SEQ ID NO: 973 - protein, 101 aa, Homo sapiens; identical to SEQ ID NO: 930

SEQ ID NO: 974 - protein, 150 aa, Homo sapiens; identical to SEQ ID NO: 928

SEQ ID NO: 975 - protein, 53 aa, Homo sapiens
  variant (1)...(53): Xaa = Any amino acid
VASXGLPLLRRQAQIAAGRVLVVALFGGCGGLHSRLDGAAICLPGHCHGSRVE

SEQ ID NO: 976 - protein, 53 aa, Homo sapiens
  variant (1)...(53): Xaa = Any amino acid
FYPGAVTVAWKADSSPVKAGVETTTPSKQSNNKYAASSYLSLTPEQWKSXRSY

SEQ ID NO: 977 - protein, 97 aa, Homo sapiens
  variant (1)...(97): Xaa = Any amino acid
TLTINRVEAGDEADYYCQVWDHNNDHVVFGGGTKLAVLGQPKAAPSVTLFPPSSEELQANKATLVCLISDFYPGAVTXXWKAXXSPVXAGVXTTTPS

SEQ ID NO: 978 - protein, 59 aa, Homo sapiens
  variant (1)...(59): Xaa = Any amino acid
GGCGGXHSRXDGAXXCLPXXCHGSRVEVTYETHQCGLVGLKLLRGGREQSDRGGSLGLT

SEQ ID NO: 979 - protein, 83 aa, Homo sapiens
  variant (1)...(83): Xaa = Any amino acid
TLTINRVXAGDEADYYCQVWDRNNDHVVFGGGTKLAVLGQPKAAPSVTLXPXSXXELQANKATLVCLISDFYPGAVTVAWKAX

SEQ ID NO: 980 - protein, 60 aa, Homo sapiens
  variant (1)...(60): Xaa = Any amino acid
LEGVVVSTPALTGLLXCLPGHCHGSRVEVTYETHQCGLVGLKLXXGXRXQSDRGGSLGLT

SEQ ID NO: 981 - protein, 123 aa, Homo sapiens
  variant (1)...(123): Xaa = Any amino acid
VASVGLPLFRRQAQIAAGRVLVVALFGGCGGLHSRLDGAAICLPGHCHGSRVEVTYETHQCGLVGLKLLRGGREQSDRGGSLGLTXDGQFGPSTEDDMVIITIPHLTVIVGLIAGFDPVDGQG

SEQ ID NO: 982 - protein, 123 aa, Homo sapiens
  variant (1)...(123): Xaa = Any amino acid
TLTINRVEAGDEADYYCQVWDRNNDHVVFGGGTKLAVXGQPKAAPSVTLFPPSSEELQANKATLVCLISDFYPGAVTVAWKADSSPVKAGVETTTPSKQSNNKYAASSYLSLTPEQWKSHRSY

SEQ ID NO: 983 - protein, 150 aa, Homo sapiens
  variant (1)...(150): Xaa = Any amino acid
KMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSXIENDSSP

SEQ ID NO: 984 - protein, 101 aa, Homo sapiens; identical to SEQ ID NO: 930

SEQ ID NO: 985 - protein, 122 aa, Homo sapiens
SMDMRVPAQLLGLLLLWLPGAKCDIQMTQSPSTLSASVGDTVTISCRASQNIDRWLAWHQQKPGKAPNVLIYATSSLEEGVSLRFTGSGSGTQFNLTITSLQPDDSATYYCATLFCISSQFW

SEQ ID NO: 986 - protein, 69 aa, Homo sapiens
DIRGFAWFLLMPGQPPIYILRGPTTYCNCISDRCRQGGRRLGHLDVTFGTWEPEQQEPQELSGDPHVHA

SEQ ID NO: 987 - protein, 118 aa, Homo sapiens
  variant (1)...(118): Xaa = Any amino acid
TLTINRVEAGDEADYYCQVWDRNNDHVVFGGGTKLAVLGQPKAAPSVTLFPPSSXXLXANKATLVCLISDFYPGAVTVAWKADSSPVKAGVETTTPSKQSNNKYXASXYLSLTPEQWK

SEQ ID NO: 988 - protein, 80 aa, Homo sapiens
  variant (1)...(80): Xaa = Any amino acid
LPLLRRQAQIXAGXVLVVALFGGCGGLHSRLDGAAICLPGHCHGSRVEVTYETHQCGLVGXKXXRGGREQSDRGGSLGLT

SEQ ID NO: 989 - protein, 63 aa, Homo sapiens
  variant (1)...(63): Xaa = Any amino acid
LLAAYLLLLCXEGVXVSTPALXGLLXXFQSHXHGSRVEVTYETHXCGLVXXKLLRGGREQSDR

SEQ ID NO: 990 - protein, 56 aa, Homo sapiens
  variant (1)...(56): Xaa = Any amino acid
VASVGLPLLRRQAQIAAGRVLVVALXXGCXXLHSRLXXAAIXLPEPXSRLPGRSHL

SEQ ID NO: 991 - protein, 123 aa, Homo sapiens
TLTINRVEAGDEANYYCQVWDRNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 992 - protein, 85 aa, Homo sapiens
VASVGLPLLRRQAQIAAGRVLVVALFGGCGGLHSRLDGAAICLPGHCHGSRVEVTYEAHQCGLVGLKLLRGGREQSDRGGSLGLT

SEQ ID NO: 993 - protein, 123 aa, Homo sapiens; identical to SEQ ID NO: 683

SEQ ID NO: 994 - protein, 85 aa, Homo sapiens; identical to SEQ ID NO: 682

SEQ ID NO: 995 - protein, 88 aa, Homo sapiens
TVINYRPHNMRPEDRMFHIRAVILRALSLAFLLSLRGAGAIKADHVSTYAAFVQTHRPTGEFMFEFDEDEMFYVDLDKKETVWHLEEF

SEQ ID NO: 996 - protein, 55 aa, Homo sapiens; identical to SEQ ID NO: 791

SEQ ID NO: 997 - protein, 83 aa, Homo sapiens
SVGLPLLRRQAQIAAGRVLVVALFGGCGGLHSRLDGAAICLPGHCHGSRVEVTYETHQCGLVGLKLLRGGREQSDRGGSLGLT

SEQ ID NO: 998 - protein, 121 aa, Homo sapiens
TLTINRVEAGDKADYYCQVWDLNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHR

SEQ ID NO: 999 - protein, 56 aa, Homo sapiens; identical to SEQ ID NO: 754

SEQ ID NO: 1000 - protein, 96 aa, Homo sapiens
SSTGGASAMAWTVLLLGLLSHCTDSVTSYVLTQTPSVSVAPGKTAKITCGGNNIGSNNVHWYYQKPGQAPVLIISFDNDRPSGISERFSGFNSGDM

SEQ ID NO: 1001 - protein, 81 aa, Homo sapiens
LGLLSHCTDSVTSYVLTQTPSVSVAPGKTAKITCGGNNIGSNNVHWYYQKPGRAPVLIISFDNDWPSGISERFSGFNSGDM

SEQ ID NO: 1002 - protein, 170 aa, Homo sapiens
QAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRS

SEQ ID NO: 1003 - protein, 61 aa, Homo sapiens
PCFPRSLWSWASPTPSSATLTSSSHQCSTSRGCATGSWSLRVSLRASSCPEQITASTSSIT

SEQ ID NO: 1004 - protein, 51 aa, Homo sapiens [sequence omitted]

SEQ ID NO: 1005 - protein, 59 aa, Homo sapiens
PERRDFMMRTVPTMMPTRPSTRPRAQSTVSVVSGIWIGSWASQCLRSGWSKPQCSTLQS

SEQ ID NO: 1006 - protein, 61 aa, Homo sapiens
SVLGRKRLSATPSVTSSPLHSHVTLSTGGKNLSMWQMRVLGWPSSTGSLGNTVTSGGSLVA

SEQ ID NO: 1007 - protein, 106 aa, Homo sapiens
GHKGQVMELVEAVICSGQEEALSDTLSDQLPVAQPRDVEHWWEELVNVADEGVGLAQLHRLLGKHGHLRGIVGGLSVVGTLDQGIQVVVQYSNVSQPALSLKGKGL

SEQ ID NO: 1008 - protein, 59 aa, Homo sapiens
SVGLPLLRRQAQIAAGRVLVVALFGGCGGLHSRLDGAAICLPGHCHGSRVEVTYETHQC

SEQ ID NO: 1009 - protein, 59 aa, Homo sapiens
TLVCLISDFYPGAVTVAWKADSSPVKAGVETTTPSKQSNNKYAASSYLSLTPEQWKSHR

SEQ ID NO: 1010 - protein, 85 aa, Homo sapiens; identical to SEQ ID NO: 682

SEQ ID NO: 1011 - protein, 123 aa, Homo sapiens; identical to SEQ ID NO: 683

SEQ ID NO: 1012 - protein, 83 aa, Homo sapiens; identical to SEQ ID NO: 997

SEQ ID NO: 1013 - protein, 83 aa, Homo sapiens
GQPKAAPSVTLFPPSSEELQANKATLVCLISDFYPGAVTVAWKADSSPVKAGVETTTPSKQSNNKYAASSYLSLTPEQWKSHR

SEQ ID NO: 1014 - protein, 55 aa, Homo sapiens
PRMMKTVPTTMPTRPTDNPRAQTTVSVSSDIGAGISGSQCFRRGLSSPQCSTLQS

SEQ ID NO: 1015 - protein, 50 aa, Homo sapiens
  variant (1)...(50): Xaa = Any amino acid
PSVTGDLENTVTSGTSLVAAVELERLIRLFKLCFXTAMFVSANCGSNLNC

SEQ ID NO: 1016 - protein, 59 aa, Homo sapiens
  variant (1)...(59): Xaa = Any amino acid
HRGWNLRLPVFQKRLVQSPVLHLAVITLLSRREEGEVTDLEEGMITLGEEAGLXNTFCD

SEQ ID NO: 1017 - protein, 76 aa, Homo sapiens
  variant (1)...(76): Xaa = Any amino acid
VPIAXPCDVDHRRKDVVHKTDEDVGLTQCHGRLGKHCDLRNLIGSSGRVGAFNQTVQVMFXDSDVCQCKLRVKSKL

SEQ ID NO: 1018 - protein, 52 aa, Homo sapiens
  variant (1)...(52): Xaa = Any amino acid
AMGTQSQKVFXRPASSPRVIIPSSRSVTSPSSLLLRRVMTARWSTGDWTSLF

SEQ ID NO: 1019 - protein, 165 aa, Homo sapiens
  variant (1)...(165): Xaa = Any amino acid
QFRFDPQFALTNIAVXKHNLNSLIKRSNSTAATNEVPEVTVFSKSPVTLGQPNILICLVDNIFPPVVNITWXSNGHSVTEGVXETSFLSKSDHSFFKISYLTLLPSAEESYDCKVEHWGLDKPLLKHWEPEIPAPMSELTETVVCALGLSVGLVGIVVGTVFIIR

SEQ ID NO: 1020 - protein, 85 aa, Homo sapiens; identical to SEQ ID NO: 682

SEQ ID NO: 1021 - protein, 123 aa, Homo sapiens; identical to SEQ ID NO: 896

SEQ ID NO: 1022 - protein, 50 aa, Homo sapiens
  variant (1)...(50): Xaa = Any amino acid
LLAAYLLLLCLEGVXVSTPALTGLLSAFQATVXAPGXKSLXRHTXVALXA

SEQ ID NO: 1023 - protein, 80 aa, Homo sapiens
  variant (1)...(80): Xaa = Any amino acid
VASXGLPLLRRQAQIAAGRVLVVALFGGCXGLHSRLDGAAICLPGHCHXSRVXVTXETHXCGLXGLXLLIGGREQXDRGG

SEQ ID NO: 1024 - protein, 80 aa, Homo sapiens
  variant (1)...(80): Xaa = Any amino acid
APSVXLFPPSYEEXQAXKATXVCLXSDXYPGXVTVAWKADSSPVKAGVETXTPSKQSNNKYAASSYLSLTPEQWKSXRSY

SEQ ID NO: 1025 - protein, 101 aa, Homo sapiens
  variant (1)...(101): Xaa = Any amino acid
TLTINRVEAGDEADYYCQVWDRNNDHVVFGGGTKLAVLGQPKAAPSVTLFPPSSEELQANKATLVCLISDFYPGAVTVAWKADSXPVKAGVETTTPSKQXN

SEQ ID NO: 1026 - protein, 63 aa, Homo sapiens
  variant (1)...(63): Xaa = Any amino acid
VXLFGGCGGLHSRLDGXAICLPGHCHGSRVEVTYETHQCGLVGLKLLRGGREQSDRGGSLGLT

SEQ ID NO: 1027 - protein, 75 aa, Homo sapiens
GCLSQHIGGHRVTFSWQVQSLRFSQVLEHSLGGIQPHQPPTLHQGHEHPAHHRKGPPELRIKDTLDPEALGWAGW

SEQ ID NO: 1028 - protein, 77 aa, Homo sapiens
EVTELLSLGRCSPSGSHKSLSTVWGEFSPTSLPPCTRVMSILPTTGRALLSSELRTRWTQKPWAGQVGETLGGSPVQ

SEQ ID NO: 1029 - protein, 82 aa, Homo sapiens [sequence omitted]

SEQ ID NO: 1030 - protein, 84 aa, Homo sapiens
EPEGLHLPRESNSVTSYVLTQTPSVSVAPGKTAKITCGGNNIGSNNVHWYYQKPGQAPVLIISFDNDRPSGISERFSGFNSGDM

SEQ ID NO: 1031 - protein, 60 aa, Homo sapiens
EAALVVPQPWPGPFSSSASSLTAQVIPPGSHQPAQPKASGSSVSLILSSGGPFLWWAGCS

SEQ ID NO: 1032 - protein, 71 aa, Homo sapiens
GEVSRSAARGGCPEPQGWSWGLSVLPQAFQVQKALWGLGLCQGKESCLGGGREVREVTHVALEPAKSNVSM

SEQ ID NO: 1033 - protein, 77 aa, Homo sapiens
CPKRASPGALGLGLREERSVGQRPGVAALSPRAGPGVCQSFPRLSRSRRLCGVWGCVRVRKAALVEEEKSERSHMWP

SEQ ID NO: 1034 - protein, 54 aa, Homo sapiens
  variant (1)...(54): Xaa = Any amino acid
PESSRYPSLLASGSGSRGGGSSQSXVSSMPWGLCRTGRLEEPLCLDRFCRLPHL

SEQ ID NO: 1035 - protein, 50 aa, Homo sapiens
LLFLHQGSFPYPDTAPDPTKPSGPGKPGEGLTDPRTSPGAQGSHPGPLTD

SEQ ID NO: 1036 - protein, 69 aa, Homo sapiens
LEPPPRLPLPEARREGYLEDSGHLLLAQGLKDAGPPNLTLRLPATFSPGFCRLASLPLLSHADVGLSRF

SEQ ID NO: 1037 - protein, 61 aa, Homo sapiens
  variant (1)...(61): Xaa = Any amino acid
SGGACRTCPGTVAPQACLSCRVPMAWSLHXTDWSPLPDSHFQKLGGRDTWKTPVTSFLLRA

SEQ ID NO: 1038 - protein, 59 aa, Homo sapiens
KMLVLPTSLSDSLPPFPLGSAVLPHFPSCHMLTLDLAGSKATCVTSLTSLPPPRQLSLP

SEQ ID NO: 1039 - protein, 56 aa, Homo sapiens
HSPRPHKAFWTWKAWGRTDRPQDQPWGSGQPPRAADRLTSPHGGPAPKPQGWPVWD

SEQ ID NO: 1040 - protein, 85 aa, Homo sapiens; identical to SEQ ID NO: 682

SEQ ID NO: 1041 - protein, 123 aa, Homo sapiens; identical to SEQ ID NO: 683

SEQ ID NO: 1042 - protein, 96 aa, Homo sapiens
  variant (1)...(96): Xaa = Any amino acid
VASVGLPLLRRQAQIAAGRVLVVALFGGCGGLHSRLDGAAICLPGHCHGSRVEVTYETHQCGLVGLKLLRGGREQSDRGGSLGLTXDGQFXPSAED

SEQ ID NO: 1043 - protein, 96 aa, Homo sapiens
  variant (1)...(96): Xaa = Any amino acid
VFGGGXKLAVXGQPKAAPSVTLFPPSSEELQANKATLVCLISDFYPGAVTVAWKADSSPVKAGVETTTPSKQSNNKYAASSYLSLTPEQWKSHRSY

SEQ ID NO: 1044 - protein, 85 aa, Homo sapiens
  variant (1)...(85): Xaa = Any amino acid
VASVGLPLLRRQAQIAAGRVLVVALFGGCGGLHSRLDGAAICLPGHCHGSRVEVTYETHXCGLVGLKLLXGGREQSDRGGSLGLT

SEQ ID NO: 1045 - protein, 90 aa, Homo sapiens
  variant (1)...(90): Xaa = Any amino acid
KLAVLGQPKAAPSVTLFPPSXEELQANKATXVCLISDFYPGAVTVAWKADSSPVKAGVETTTPSKQSNNKYAASSYLSLTPEQWKSHRSY

SEQ ID NO: 1046 - protein, 124 aa, Homo sapiens; identical to SEQ ID NO: 814

SEQ ID NO: 1047 - protein, 71 aa, Homo sapiens [sequence omitted]

SEQ ID NO: 1048 - protein, 95 aa, Homo sapiens
  variant (1)...(95): Xaa = Any amino acid
TLTINRVEAGDEADYYCQVWDRNNDHVVFGGGTKLAVLGQPKAAPSVTLFPPSSEELQANKATLVCLISDFYPGAVTVAWKAXSXPXKAGVETTT

SEQ ID NO: 1049 - protein, 57 aa, Homo sapiens
  variant (1)...(57): Xaa = Any amino acid
CGGLHSRLXGXAXCLPGHCHGSRVEVTYETHQCGLVGLKLLRGGREQSDRGGSLGLT

SEQ ID NO: 1050 - protein, 98 aa, Homo sapiens
TLTINRVEAGDEADYYCQVWDRNNDHVVFGGGTKLAVLGQPKAAPSVTLFPPSSEELQANKATLACLISDFYPGAVTVAWKADSSPVKAGVETTTPSK

SEQ ID NO: 1051 - protein, 60 aa, Homo sapiens
FGGCGGLHSRLDGAAICLPGHCHGSRVEVTYETRQCGLVGLKLLRGGREQSDRGGSLGLT

SEQ ID NO: 1052 - protein, 60 aa, Homo sapiens
SWPSFLGPLTLRVSESTHRRSQTLCSERGGRGGERSRPWLRHHQCCFLRQSYPCLKWYLL

SEQ ID NO: 1053 - protein, 80 aa, Homo sapiens
LCLRKQHWWCLSHGLDRSPPRPPLSLHRVCDLLCVDSDTLSVSGPRKDGQDYLWGKQYWELQCTLVLPKARPGPCPNHLF

SEQ ID NO: 1054 - protein, 97 aa, Homo sapiens
GSSTGGASAMAWTVLLLGLLSHCTESVTSYVLTQTPSVSVAPGKTAKITCGGNNIGSYSVHWYYQKPGQAPVLIISFDNDRPSGISERFSGFNSGDM

SEQ ID NO: 1055 - protein, 97 aa, Homo sapiens; identical to SEQ ID NO: 725

SEQ ID NO: 1056 - protein, 56 aa, Homo sapiens; identical to SEQ ID NO: 754

SEQ ID NO: 1057 - protein, 64 aa, Homo sapiens
  variant (1)...(64): Xaa = Any amino acid
EPXPLRPIEEMTLRRRVLQETWXGVPSQSQWGAXHHXCHXQNXHAGTSREPXTHHAGXQDRTRG

SEQ ID NO: 1058 - protein, 53 aa, Homo sapiens
  variant (1)...(53): Xaa = Any amino acid
HSDVEYSKKRXLVSPAKASGELXTIXVTXRTXMQEPPGSXRHTMLXNRTGPGA

SEQ ID NO: 1059 - protein, 51 aa, Homo sapiens
  variant (1)...(51): Xaa = Any amino acid
GPWSCPVXQHGVSXAPWRFLHXSSXSDXDGXELPTGFGWGHQXTFLGVLYV

SEQ ID NO: 1060 - protein, 64 aa, Homo sapiens
  variant (1)...(64): Xaa = Any amino acid
APGPVLXSSMVCXRLPGGSCMXVLXVTXMVXSSPLALAGDTXPRFLEYSTSECHFFNGTERXRF

SEQ ID NO: 1061 - protein, 85 aa, Homo sapiens; identical to SEQ ID NO: 682

SEQ ID NO: 1062 - protein, 123 aa, Homo sapiens
  variant (1)...(123): Xaa = Any amino acid
TLTINRVEAGXEADYYCQVWDRNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 1063 - protein, 59 aa, Homo sapiens
PCLRSKVTRKRPCLPSMTLMEEMLREAFRCMTQGKTAKNLVLALLILLFVSFLGVLRAK

SEQ ID NO: 1064 - protein, 51 aa, Homo sapiens
EQNDNTQKFSKWDFPGRANERPYCYAIWSKTTLQEDVFTGGPHAKLLHEGI

SEQ ID NO: 1065 - protein, 120 aa, Homo sapiens
  variant (1)...(120): Xaa = Any amino acid
DCQKSCSCSPHFVICFIFRSFESKMTTPRNSVNGTFPAEPMKGPIAMQSGPKPLFRRMSSLVGPTQSFFMRESKTLGAVQIMNGLFHIALGGLLMIPAGIYAPICVTVWYPLWGXXGSIK

SEQ ID NO: 1066 - protein, 89 aa, Homo sapiens
IPAGIIRRPPRAMWKSPFIIWTAPKVLDSLMKKLCVGPTSEDILLKSGFGPDCIAIGPFIGSAGKVPFTEFLGVVILLSKLLKMKQITK

SEQ ID NO: 1067 - protein, 60 aa, Homo sapiens
  variant (1)...(60): Xaa = Any amino acid
LYASXXSPERVPHSHTDGCIDPCWDHQKTPQGNVEEPIHNLDSPQSLRFPHEEALRGAHQ

SEQ ID NO: 1068 - protein, 64 aa, Homo sapiens [sequence omitted]

SEQ ID NO: 1069 - protein, 59 aa, Homo sapiens
PCLRSKVTRKRPCLPSMTLMEEMLREAFRCMTQGKTAKNLVLALLILLFVLFLGVLRAK

SEQ ID NO: 1070 - protein, 51 aa, Homo sapiens; identical to SEQ ID NO: 1064

SEQ ID NO: 1071 - protein, 108 aa, Homo sapiens
DCQKSCSCSPHFVICFIFRSFESKMTTPRNSVNGTFPAEPMKGPIAMQSGPKPLFRRMSSLVGPTQSFFMRESKTLGAVQIMNGLFHIALGGLLMIPAGIYAPICVTV

SEQ ID NO: 1072 - protein, 64 aa, Homo sapiens
ISGCCHFALKTPKNKTNNKMRRARTRFLAVLPCVMHLNASLSISSMSVIEGRHGLFRVTLDLRQ

SEQ ID NO: 1073 - protein, 89 aa, Homo sapiens
IPAGIIRRPPRAMWKSPFIIWTAPKVLDSLMKKLCVGPTSEDILLKSGFGPDCIAIGPFIGSAGKVPFTEFLGVVILLSKLLKIKQITK

SEQ ID NO: 1074 - protein, 59 aa, Homo sapiens; identical to SEQ ID NO: 1069

SEQ ID NO: 1075 - protein, 51 aa, Homo sapiens
EQNDNTQKFSKWDFPGRANERPYCYAIWSKTTLQEDVFTGGPHARLLHEGI

SEQ ID NO: 1076 - protein, 76 aa, Homo sapiens
  variant (1)...(76): Xaa = Any amino acid
DFGGCPDYEWALPHCPGGSSDDPSRDLCTHLCDCVVPSLGRHYVYYFRITPGSNGEKLQEVFGQRKNDNEFIXPLC

SEQ ID NO: 1077 - protein, 149 aa, Homo sapiens
  variant (1)...(149): Xaa = Any amino acid
DCQKSCSCSPHFVICFIFRSFESKMTTPRNSVNGTFPAEPMKGPIAMQSGPKPLFRRMSSLVGPTQGFFMRESKTLGAVQIMNGLFHIALGGLLMIPAGIYAPICVTVWYPLWGGIMYIISGSLLAATEKNSRKCLVKGKMIMNSXXLF

SEQ ID NO: 1078 - protein, 89 aa, Homo sapiens
IPAGIIRRPPRAMWKSPFIIWTAPKVLDSLMKKPCVGPTSEDILLKSGFGPDCIAIGPFIGSAGKVPFTEFLGVVILLSKLLKIKQITK

SEQ ID NO: 1079 - protein, 62 aa, Homo sapiens; identical to SEQ ID NO: 880

SEQ ID NO: 1080 - protein, 64 aa, Homo sapiens; identical to SEQ ID NO: 1072

SEQ ID NO: 1081 - protein, 94 aa, Homo sapiens [sequence omitted]

SEQ ID NO: 1082 - protein, 61 aa, Homo sapiens [sequence omitted]

SEQ ID NO: 1083 - protein, 58 aa, Homo sapiens
  variant (1)...(58): Xaa = Any amino acid
GNPDPRPTDGGXGGXXVRLSGRNCPVDVIDHQYFLLEQRDLSERAHFKFIRCIGQNPV

SEQ ID NO: 1084 - protein, 139 aa, Homo sapiens
  variant (1)...(139): Xaa = Any amino acid
XTGAVSFXMXEETQTQDQPMEEXEVXTFAFQAEIAQLMSLIINTFYSNKEIFLRELISNSSDALDKIRYESLTDPSKLDSEKELHINLIPNKQDRTLTIVDTGIGMTKADLINNLGTIAKSGTKAFMEALQAGADISMI

SEQ ID NO: 1085 - protein, 66 aa, Homo sapiens
  variant (1)...(66): Xaa = Any amino acid
PCLXSXVTRKRPCLPSMTLMEEMLXEAFXCMTQGKTAKNLXLALLILLXVLXLGVXRAKXXHPEIQ

SEQ ID NO: 1086 - protein, 51 aa, Homo sapiens
  variant (1)...(51): Xaa = Any amino acid
EQNXXTQKFSKWDFPGRXNERPYCYAIWSKTTLQEDXFTGGPHAKLLHEGI

SEQ ID NO: 1087 - protein, 52 aa, Homo sapiens
  variant (1)...(52): Xaa = Any amino acid
DFGGCPDYEWALPHCPGGSSDDPXRDLCXHLCDCVVPSLGRHYVYYFRITPG

SEQ ID NO: 1088 - protein, 125 aa, Homo sapiens
  variant (1)...(125): Xaa = Any amino acid
DCQKSXSCSPHFVIXFXFRSXESKXTXPRNSVNGTFPAXPMKGPIAMQSGPKPLFRRMXSLVGPTQSFFMRESKTLGAVQIMNGLFHIALGGLLMIPXGIYXPICVTVWYPLWGGIMYIISGSLL

SEQ ID NO: 1089 - protein, 89 aa, Homo sapiens
  variant (1)...(89): Xaa = Any amino acid
IPXGIIRRPPRAMWKSPFIIWTAPKVLDSLMKKLCVGPTSEXILLKSGFGPDCIAIGPFIXSAGKVPFTEFLGXXILLSXLLKXKXITK

SEQ ID NO: 1090 - protein, 62 aa, Homo sapiens
  variant (1)...(62): Xaa = Any amino acid
SGNNIHNASPERVPHSHTDGXIDPXWDHQKTPQGNVEEPIHNLDSPQSLRFPHEEALRGAHQ

SEQ ID NO: 1091 - protein, 64 aa, Homo sapiens
  variant (1)...(64): Xaa = Any amino acid
ISGXCXFALXTPKXKXNNKMRRARXRFLAVLPCVMHXNASXSISSMSVIEGRHGLFRVTXDXRQ

SEQ ID NO: 1092 - protein, 123 aa, Homo sapiens
GHSMDMRVPAQLLGLLLLWLPGAKCDIQMTQSPSTLSASVGDTVTISCRASQNIDRWLAWHQQKPGKAPNVLIYATSSLEEGVSLRFTGSGSGTQFNLTITSLQPDDSATYYCQHYSASLRSF

SEQ ID NO: 1093 - protein, 71 aa, Homo sapiens; identical to SEQ ID NO: 813

SEQ ID NO: 1094 - protein, 85 aa, Homo sapiens
  variant (1)...(85): Xaa = Any amino acid
VASVGLPLLRRQAQIAAGRVLVVALFGGCGXLHSRLDGAAICLPGHCHGSRVEVTYETHQCGLVGLKLLRGGREQSDRGGSLGLT

SEQ ID NO: 1095 - protein, 123 aa, Homo sapiens
  variant (1)...(123): Xaa = Any amino acid
TLTINRVEAGDEADYYCQVWDRNNDHVVFGGGTKLAVLGQPKAAPSVTLFPPSSEELQANKATLVCLISDFYPGAVTVAWKADSSPVKAGVEXTTPSKQSNNKYAASSYLSLTPEQWKSHRSY

SEQ ID NO: 1096 - protein, 85 aa, Homo sapiens; identical to SEQ ID NO: 682

SEQ ID NO: 1097 - protein, 102 aa, Homo sapiens
TLTINRVEAGDEADYYCQVWDRNNDHVVFGGGTKLAVLSQPKAAPSVTLFPPSSEELQANKATLVCLISDFYPGAVTVAWKADSSPVKAGVETTTPSKQSNN

SEQ ID NO: 1098 - protein, 85 aa, Homo sapiens; identical to SEQ ID NO: 682

SEQ ID NO: 1099 - protein, 108 aa, Homo sapiens
  variant (1)...(108): Xaa = Any amino acid
YXQVWDRNYDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 1100 - protein, 56 aa, Homo sapiens
  variant (1)...(56): Xaa = Any amino acid
VASVGLPLLXRQAQIAAGRVLVVALFGGCGGLHSXLDGXXYLPSXPLXRLXGRSHL

SEQ ID NO: 1101 - protein, 54 aa, Homo sapiens
  variant (1)...(54): Xaa = Any amino acid
KATXVCLISDFYXGAVXVXWKADSXPRQXGSGDHHTLQTKQQQVRGQQLSEPDX

SEQ ID NO: 1102 - protein, 55 aa, Homo sapiens
  variant (1)...(55): Xaa = Any amino acid
VTSTXEPXQWXGRQIXXPVKXGVETTTPSKQSNNKYAASSYLSLTXEQWKSHRSY

SEQ ID NO: 1103 - protein, 56 aa, Homo sapiens
  variant (1)...(56): Xaa = Any amino acid
TLTINRVEAGDEADYYCQVWDRNNDHVXFGGGTKLAVLGXPKAAPSVTLFXPXSXE

SEQ ID NO: 1104 - protein, 85 aa, Homo sapiens; identical to SEQ ID NO: 682

SEQ ID NO: 1105 - protein, 123 aa, Homo sapiens
TLTINRVEAGDEADYYCQVWDLNNDHVVFGGGTKLAVLGQPKAAPSVTLFPPSSEELQANKATLVCLISDFYPGAVTVAWKADSSPVKAGVETTTPSKQSNNKYAASSYLSLTPEQWKSHRSY

SEQ ID NO: 1106 - protein, 194 aa, Homo sapiens
QYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFIIR

SEQ ID NO: 1107 - protein, 52 aa, Homo sapiens
AMGTQSQKVFLRPASSPRVIIPSSRSVTSPSSLLLRRVMTARWSTGDWTSLF

SEQ ID NO: 1108 - protein, 55 aa, Homo sapiens; identical to SEQ ID NO: 1014

SEQ ID NO: 1109 - protein, 66 aa, Homo sapiens
PSVTGDLENTVTSGTSLVAAVELERLIRLFKLCFRTAMFVSANCGSNLNCLRTGKHQTVSFLPRST

SEQ ID NO: 1110 - protein, 59 aa, Homo sapiens
HRGWNLRLPVFQKRLVQSPVLHLAVITLLSRREEGEVTDLEEGMITLGEEAGLRNTFCD

SEQ ID NO: 1111 - protein, 60 aa, Homo sapiens
VPIAQPCDVDHRRKDVVHKTDEDVGLTQCHGRLGKHCDLRNLIGSSGRVGAFNQTVQVMF

SEQ ID NO: 1112 - protein, 51 aa, Homo sapiens
  variant (1)...(51): Xaa = Any amino acid
KQHWWCLSHGLDRSPXRXPLSPXRLCDLLCVDSDTXSXXGPRXXGQDYLWG

SEQ ID NO: 1113 - protein, 51 aa, Homo sapiens
  variant (1)...(51): Xaa = Any amino acid
SSTGGASAMAWTVLXLXLLSHXTDSVTSYVLTQTPXVXXAPGXTAKITCGG

SEQ ID NO: 1114 - protein, 79 aa, Homo sapiens
PTVTLFPPSSEELQANKATLVCLISDFYPGAVTVAWKADGSPVKAGVETTKPSKQSNNKYAASSYLSLTPEQWKSHRSY

SEQ ID NO: 1115 - protein, 54 aa, Homo sapiens; identical to SEQ ID NO: 840

SEQ ID NO: 1116 - protein, 59 aa, Homo sapiens
VASVGLPLLGRQAQVAAGRVLVVALFGGFGGLHSRLDGAAICLPGHCHSSRVEVTDQTH

SEQ ID NO: 1117 - protein, 85 aa, Homo sapiens
  variant (1)...(85): Xaa = Any amino acid
VASVGLPLLRRQAQIAAGRVLVVALFGGCGGLHSRLDGAAICLPGHCHGSRVEVTYETHQCGLVGLKLLXGGREQSDRGGSLGLT

SEQ ID NO: 1118 - protein, 93 aa, Homo sapiens
  variant (1)...(93): Xaa = Any amino acid
XGTKXAVLGQPKAAPSVTLFPPSXEELQANKATLVCLISDFYPGAVTVAWKADSSPVKAGVETTTPSKQSNNKYAASSYLSLTPEQWKSHRSY

SEQ ID NO: 1119 - protein, 194 aa, Homo sapiens; identical to SEQ ID NO: 1106

SEQ ID NO: 1120 - protein, 52 aa, Homo sapiens; identical to SEQ ID NO: 1107

SEQ ID NO: 1121 - protein, 55 aa, Homo sapiens; identical to SEQ ID NO: 1014

SEQ ID NO: 1122 - protein, 66 aa, Homo sapiens; identical to SEQ ID NO: 1109

SEQ ID NO: 1123 - protein, 59 aa, Homo sapiens; identical to SEQ ID NO: 1110

SEQ ID NO: 1124 - protein, 60 aa, Homo sapiens; identical to SEQ ID NO: 1111

SEQ ID NO: 1125 - protein, 94 aa, Homo sapiens
TGGASAMAWTVLLLGLLSHCTDSVTSYVLTQTPSVSVAPGKTAKITCGGNNIGSNNVHWYYQKPGQAPVLIISFDNDRPSGISERFSGFNSGDM

SEQ ID NO: 1126 - protein, 53 aa, Homo sapiens
WWCLSHGLDRSPPRPPLSLHRLCDLLCVDSDTLSVSGPRKDGQDYLWGKQYWE

SEQ ID NO: 1127 - protein, 71 aa, Homo sapiens; identical to SEQ ID NO: 813

SEQ ID NO: 1128 - protein, 124 aa, Homo sapiens; identical to SEQ ID NO: 814

SEQ ID NO: 1129 - protein, 63 aa, Homo sapiens
  variant (1)...(63): Xaa = Any amino acid
NNDHVVFGGGTKLAVLGQPKAAPSVTLFPPXXEXLQANKATLVCLISDFYPGAVTVAWKAXSS

SEQ ID NO: 1130 - protein, 73 aa, Homo sapiens
WWCLSHGLDRSPPRPPLSPHRFCDFLCVDSNTLSVSGPRKDGQDYLWGKQYWESQCTLVLPEARPGPCPNHLF

SEQ ID NO: 1131 - protein, 57 aa, Homo sapiens
GGASAMAWTVLLLGLLSHRTDSVTSYVLTQTPSVSVAPGKTAKITCGGNNIGSHNVH

SEQ ID NO: 1132 - protein, 85 aa, Homo sapiens
  variant (1)...(85): Xaa = Any amino acid
SQESVQEPFLTPVMDNKAXPEEDEPQHEASNATQHLALGRFRLSPPLHGDGVLEAGVLHVAGVDVSMLGSHFQHHQDLEXPVTXS

SEQ ID NO: 1133 - protein, 56 aa, Homo sapiens
DYFNWDWLSLFCNACLSLPRIPNCLCQPVPLRSESYSGCHAATRSSPFIPTPRRWL

SEQ ID NO: 1134 - protein, 70 aa, Homo sapiens
  variant (1)...(70): Xaa = Any amino acid
ICPEQDAEWHWRLRAGAHLPRXGPYYPSQESERAPALTPETILTGIGYHFSVTPACPCPEFPTACVSLSP

SEQ ID NO: 1135 - protein, 82 aa, Homo sapiens
  variant (1)...(82): Xaa = Any amino acid
LGXGDWXFQILVMLEMTPQHGDVYTCHVEHPSLQNPITVEWRAQSESAQSKMLSGIGGFVLGLIFLGXGLIIHHRSQKGLLH

SEQ ID NO: 1136 - protein, 56 aa, Homo sapiens
RLLVPAQNSQLPVSACPPEIRVLQWLSRSHQVISFHPHPKALAVTLLPALTQSLCL

SEQ ID NO: 1137 - protein, 85 aa, Homo sapiens; identical to SEQ ID NO: 682

SEQ ID NO: 1138 - protein, 123 aa, Homo sapiens; identical to SEQ ID NO: 683

SEQ ID NO: 1139 - protein, 123 aa, Homo sapiens
  variant (1)...(123): Xaa = Any amino acid
TLTINRVEAGDEADYYCQVWDRNNDHVVFGGGTKLXXLGXXKAAPSVTLFPPSSEELQANKATLVCLISDFYPGAATVAWKADSSPVKAGVETTTPSKQSNNKYAASSYLSLTPEQWKSHRSY

SEQ ID NO: 1140 - protein, 85 aa, Homo sapiens
  variant (1)...(85): Xaa = Any amino acid
VASVGLPLLRRQAQIAAGRVLVVALFGGCGGLHSRLDGAAICLPGHCRGSRVEVTYETHQCGLVGLKLLRGGREQSDRGGSLXXT

SEQ ID NO: 1141 - protein, 85 aa, Homo sapiens; identical to SEQ ID NO: 682

SEQ ID NO: 1142 - protein, 123 aa, Homo sapiens; identical to SEQ ID NO: 683

SEQ ID NO: 1143 - protein, 115 aa, Homo sapiens
TLPPDRMKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 1144 - protein, 55 aa, Homo sapiens
EKEVLQLYQFQCLRERFPDADISTKNTCILPLSLLWILVLCLVKSFPGKRTSPYK

SEQ ID NO: 1145 - protein, 51 aa, Homo sapiens
SHAYLYGEVLFPGKDLTKHKTKIQSRDKGRMQVFLVEISASGNLSLKHWNW

SEQ ID NO: 1146 - protein, 60 aa, Homo sapiens
VRRSSSVAQVKAMIETKTGIIPETQIVTCNGKRLEDGKMMADYGIRKGNLLFLACYCIGG

SEQ ID NO: 1147 - protein, 74 aa, Homo sapiens
DPDCDLQWKETGRWEDDGRLRHQKGQLTLPGMLLYWRVTTLGMGCWQGSKSLFLLISYSTNTSSDDFPKLMRMR

SEQ ID NO: 1148 - protein, 74 aa, Homo sapiens [sequence omitted]

SEQ ID NO: 1149 - protein, 57 aa, Homo sapiens
SIPGGYNTDISRVFNGNNCTSCQQKLLPGPLEIYDIDAITFPFIDVLFHLEVKIGAT

SEQ ID NO: 1150 - protein, 78 aa, Homo sapiens
LDVLQMKEEDVLKFLAAGTHLGGTNLDFQMEQYIYKRKSDGIYIINLKRTWEKLLLAARAIVAIENPADVSVISSRNT

SEQ ID NO: 1151 - protein, 115 aa, Homo sapiens
TLSPDRMKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 1152 - protein, 55 aa, Homo sapiens; identical to SEQ ID NO: 1144

SEQ ID NO: 1153 - protein, 51 aa, Homo sapiens
PHAYLYGEVLFPGKDLTKHKTKIQSRDKGRMQVFLVEISASGNLSLKHWNW

SEQ ID NO: 1154 - protein, 59 aa, Homo sapiens [sequence omitted]

SEQ ID NO: 1155 - protein, 110 aa, Homo sapiens
EQRDLHTETPSWAPGTMAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 1156 - protein, 145 aa, Homo sapiens
PPLDPGAQGGGGEHRRWRSQVVPGDSQESGVRRLQDLSRLCRYLTAFFTLLLLGSEQMALPCTVTKTMASLEQSSDVWYHVFSFLRGMAPLKYSRQHSRPTLVPRAAWMCCREAPRRRVTRASIFSGAMVPGAQEGVSVCRSLCS

SEQ ID NO: 1157 - protein, 132 aa, Homo sapiens
TPTVEVPGSPGRQSGVWGEEASRPLKALQVFNCILHSLVVGVRTDGPALHSYKNDGIPGAVLRCLVPRLQLSKGNGSLEVLQAALPAHIGPSSCVDVLQRSPQEEGNQGQHLQWGHGARSPGGSLCVQVPLL

SEQ ID NO: 1158 - protein, 174 aa, Homo sapiens
ALAPGPVLFSSMVCLRLPGGSCMAVLTVTLMVLSSPLALAGDTRPRFLEYSTSECHFFNGTERVRFLDRYFYNQEEYVRFDSDVGEFRAVTELGRPDEEYWNSQKDFLEDRRAAVDTYCRHNYGVVESFTVQRRVHPKVTVYPSKTQPLQHHNLLVCSVSGFYPGSIEVRWFRN

SEQ ID NO: 1159 - protein, 56 aa, Homo sapiens; identical to SEQ ID NO: 794

SEQ ID NO: 1160 - protein, 52 aa, Homo sapiens
SGPWSCPVLQHGVSEAPWRLLHGSSDSDTDGAELPTGFGWGHQTTFLGVLYV

SEQ ID NO: 1161 - protein, 54 aa, Homo sapiens
HSDVEYSKKRGLVSPAKASGELSTISVTVRTAMQEPPGSLRHTMLENRTGPGAR

SEQ ID NO: 1162 - protein, 70 aa, Homo sapiens
SSPQPRSCVCSRCPPRPACLPGSPSGCSSTPHQAAPAPSPPGTPPRRCRSARTPLGYRSICPGTAPAPSH

SEQ ID NO: 1163 - protein, 50 aa, Homo sapiens
STPRNVVWCPQPKPVGSSAPSVSLSELPCRSLQGASDTPCWRTGQDQGPE

SEQ ID NO: 1164 - protein, 143 aa, Homo sapiens
RIHSHLRMDSPLHCEALHNPVVVSAVGVHRGPPVFQEVLLAVPVLLIRPPQLRHRPELPHVAVEAHVLLLVIEVSVQEPHPLRPIEEMTLRRRVLQETWSGVPSQSQWGAQHHQCHCQNCHAGASREPQTHHAGEQDRTRGQS

SEQ ID NO: 1165 - protein, 63 aa, Homo sapiens [sequence omitted]

SEQ ID NO: 1166 - protein, 50 aa, Homo sapiens
  variant (1)...(50): Xaa = Any amino acid
YICEYGLSFLADQISRRLLYTXEVHSYRKFKKSTLSFLSNSSEVMGSCSS

SEQ ID NO: 1167 - protein, 115 aa, Homo sapiens; identical to SEQ ID NO: 1143

SEQ ID NO: 1168 - protein, 55 aa, Homo sapiens; identical to SEQ ID NO: 1144

SEQ ID NO: 1169 - protein, 51 aa, Homo sapiens; identical to SEQ ID NO: 1145

SEQ ID NO: 1170 - protein, 117 aa, Homo sapiens
AAMARGPKKHLKRVAAPKHWMLDKLTGVFAPRPSTGPHKLRECLPLIIFLRNRLKYALTGDEVKKICMQRFIKIDGKVRTDITYPAGFMDVISIDKTGENFRLIYDTKGRFAVHRIT

SEQ ID NO: 1171 - protein, 117 aa, Homo sapiens
CNTMYSKATLGVIDQTEILSRLVNADDIHESSRVGYISSDLAIDFNEPLHANLLYFISCQGILKSVPQENDEGETLSQLVGTGGWTRSKHTGQFIQHPMLWSCHPLQMLLGTTSHGC

SEQ ID NO: 1172 - protein, 83 aa, Homo sapiens
VISVRTLPSILMNRCMQIFFTSSPVRAYLSLFLRKMMRGRHSLNLWGPVDGRGANTPVNLSSIQCFGAATRFRCFLGPRAMAA

SEQ ID NO: 1173 - protein, 170 aa, Homo sapiens
CYSFASMGMLEARIRILTNNSQTPILSPQEVVSCSQYAQGCDGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKN

SEQ ID NO: 1174 - protein, 91 aa, Homo sapiens
KGLLDQCGGRSPFCSGGSHHILQKQLPWAHDGPTQASSGLHCSLHRNLLHSGTQRSNNESSLPSFCMENQCLCRGSKLLPPAQNLGRTFLQ

SEQ ID NO: 1175 - protein, 109 aa, Homo sapiens [sequence omitted]

SEQ ID NO: 1176 - protein, 51 aa, Homo sapiens; identical to SEQ ID NO: 1145

SEQ ID NO: 1177 - protein, 78 aa, Homo sapiens
RCRCVQESSVFIPRRFIDRIQILPRGSGCPRKEIIVWKKNKSIVCVGPQAEWIQRMMEVLRKRSSSTLPVPVFKRKIP

SEQ ID NO: 1178 - protein, 53 aa, Homo sapiens
IFSRKKNFPIQISMRLCKNNLVEADGANSSFFTHSTLYTLGVCILIHQGGKFL

SEQ ID NO: 1179 - protein, 55 aa, Homo sapiens; identical to SEQ ID NO: 1144

SEQ ID NO: 1180 - protein, 99 aa, Homo sapiens
LSFLEVLCTYAPHLYLAFAWSDHSSFSLTLNVENVAIVAACVVTLLLLSNFLTLKKGRMSASECDFLLTCSLDRLFSIVFFLSFSPSTTRETAPDGKDI

SEQ ID NO: 1181 - protein, 57 aa, Homo sapiens
YFFCHFLHQQPGRLHLMEKIYDCFMTFLNYLFFIPHLRFWWSPFCIIVLRMIKKNNN

SEQ ID NO: 1182 - protein, 87 aa, Homo sapiens
SSHISFPSGAVSLVVDGENDKKNTILKSLSKEQVSRKSHSEALILPFFSVRKLLKRRSVTTQAATMATFSTFNVREKELWSLHAKAR

SEQ ID NO: 1183 - protein, 53 aa, Homo sapiens
AMLFLQKTDGCWLFRASLMGCGNSKNVPQCQPCRKINGMGSVLSLVVIFFYHP

SEQ ID NO: 1184 - protein, 59 aa, Homo sapiens
STHSAFLQCKKVAQKKKRDNTSCYNGYILYIQCKREGAMVTPCKGQIEMWCVCAEYLKK

SEQ ID NO: 1185 - protein, 115 aa, Homo sapiens; identical to SEQ ID NO: 1143

SEQ ID NO: 1186 - protein, 55 aa, Homo sapiens; identical to SEQ ID NO: 1144

SEQ ID NO: 1187 - protein, 51 aa, Homo sapiens; identical to SEQ ID NO: 1145

SEQ ID NO: 1188 - protein, 98 aa, Homo sapiens
  variant (1)...(98): Xaa = Any amino acid
PNCLSNVCINCESQXXQLLSRIYSLTSNKQALRDTESQIQILPMGIKRLRLSPHLENYLHHKYIITGSLYEADTKCYRHSQNIILGNNVIKMPNLSQQ

SEQ ID NO: 1189 - protein, 142 aa, Homo sapiens
  variant (1)...(142): Xaa = Any amino acid
WTXLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQ

SEQ ID NO: 1190 - protein, 64 aa, Homo sapiens
TRWRPMAGSSPVCYQLPSSRLPARGVYPPSRLSFFRDLVYLRKSRRRNRSFSGDSPEKKCTTGR

SEQ ID NO: 1191 - protein, 86 aa, Homo sapiens
  variant (1)...(86): Xaa = Any amino acid
DXPGRCRSADRLRAPAELAGGLWLAAHLCATNSRRQDYQRGECIHQADCLSSETLSTSENQEEGIEVSVAILQRRNAQQADEEIKR

SEQ ID NO: 1192 - protein, 73 aa, Homo sapiens
CSPLSSWTGPFISSETPPSCCCPETQFPMSPALEDWSSKFFSFSSACCLSLALSLPFDFLICLLCISSLENRH

SEQ ID NO: 1193 - protein, 52 aa, Homo sapiens
VLPCPLGQGPSSPRRLHPPAAVLKHSFPCLQLWKTGLLSSSHFLLLVVCLWH

SEQ ID NO: 1194 - protein, 115 aa, Homo sapiens
  variant (1)...(115): Xaa = Any amino acid
TLPPDRMKFISTSLLLMLLVSSLSPVQGVLEVYYTSLRCRCVQXSSVFIPXRFIDRIQILPRGNGCPRKEIIVWKKNKSIVCVDPQAEWIQRMMEVLRKRSSSTLPVPVFKRKIP

SEQ ID NO: 1195 - protein, 70 aa, Homo sapiens
  variant (1)...(70): Xaa = Any amino acid
LPPFLSELFLLHITAATTAPVITAPRRTRPAMMPTMGMVGWEDSSHLXVRGLGRPSCCTWQVYLCSSPEG

SEQ ID NO: 1196 - protein, 63 aa, Homo sapiens
  variant (1)...(63): Xaa = Any amino acid
ALPPPHHGSDHSSSDHSSKENQASNDAHDGDGGLGRQLPSXGEGLGQTLMLHMAGVSLLLSRR

SEQ ID NO: 1197 - protein, 50 aa, Homo sapiens
  variant (1)...(50): Xaa = Any amino acid
GSAQAPHXEMGAVFPAHHPHRGHHCWPGSPWSCDHWSCGRCRDVEEEELR

SEQ ID NO: 1198 - protein, 92 aa, Homo sapiens
  variant (1)...(92): Xaa = Any amino acid
PSGEEQRYTCHVQHEGLPKPLTXRWELSSQPTIPIVGIIAGLVLLGAVITGAVVAAVMWRRKSSDRKGGSYTQAASSDSAQGSDVSLTACKV

SEQ ID NO: 1199 - protein, 55 aa, Homo sapiens
  variant (1)...(55): Xaa = Any amino acid
EKEVLQLYQFQCLRERFPDADISTKNTCILPLSLLWILVLXLVKSFPGKRTSPYK

SEQ ID NO: 1200 - protein, 115 aa, Homo sapiens; identical to SEQ ID NO: 1143

SEQ ID NO: 1201 - protein, 51 aa, Homo sapiens
  variant (1)...(51): Xaa = Any amino acid
SHAYLYGEVLFPGKDLTKXKTKIQSRDKGRMQVFLVEISASGNLSLKHWNW

SEQ ID NO: 1202 - protein, 115 aa, Homo sapiens; identical to SEQ ID NO: 1143

SEQ ID NO: 1203 - protein, 55 aa, Homo sapiens; identical to SEQ ID NO: 1144

SEQ ID NO: 1204 - protein, 51 aa, Homo sapiens; identical to SEQ ID NO: 1145

SEQ ID NO: 1205 - protein, 50 aa, Homo sapiens
RIGFSHQGYNCWWWCHSTHPQISDWEERTTEDCLKDAWIPCYLRTLNTLT

SEQ ID NO: 1206 - protein, 134 aa, Homo sapiens
ASAEFEMAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 1207 - protein, 67 aa, Homo sapiens
RCDEGVGGGISPWVRLAFSLPCLLELQRNSKWLAVRLERTPERPRQRRFPARREPACSSQWAVFIDT

SEQ ID NO: 1208 - protein, 60 aa, Homo sapiens
DNKESRHPLDSLLLSFLPNQRFVDVWNDTTTSNCSLDERIQFFISTNSKLQVTRGNTLYL

SEQ ID NO: 1209 - protein, 64 aa, Homo sapiens
IRPTGNCKPALCERETAFVLAFPESFPALPPAISNSAEAQASKAEKRLIGPTVRSHHLLLRRTA

SEQ ID NO: 1210 - protein, 53 aa, Homo sapiens
ILGVDEYGPLGTASRLSASGKPPLSWPFRSPFQPYRQPFRIPLKLKQARQRKG

SEQ ID NO: 1211 - protein, 99 aa, Homo sapiens
  variant (1)...(99): Xaa = Any amino acid
PPLDPGAQGGGGEHQRWRSQVVPGDSQESGVRRLQDLSRLCRYLTAFFTLLLLGSEQMALPCTVTKTMXSLEQXXDXWXHVFSFLXGMAPLKYSRXALP

SEQ ID NO: 1212 - protein, 86 aa, Homo sapiens
  variant (1)...(86): Xaa = Any amino acid
TPTVEVPGSPGRQSGVWGEEASRPLKALQVFNCILHSLVVGVRTDGPALHSYKNDGXPGAXXRXLXPRLQLSXGNGSLEVLQAXTP

SEQ ID NO: 1213 - protein, 64 aa, Homo sapiens
  variant (1)...(64): Xaa = Any amino acid
GSXCLEYFKGAIPXRKLKTWXQXSXXCSRXAIVFVTVQGRAICSDPNNKRVKNAVKYLQSLERS

SEQ ID NO: 1214 - protein, 84 aa, Homo sapiens
PPLDPGAQGGGGEHQRWRSQVVPGDSQESGVRRLQDLSRLCRYLTAFFTLLLLGSEQMALPCTVTKTMASLEQSSDVWYHVFSF

SEQ ID NO: 1215 - protein, 71 aa, Homo sapiens
TPTVEVPGSPGRQSGVWGEEASRPLKALQVFNCILHSLVVGVRTDGPALHSYKNDGIPGAVLRCLVPRLQL

SEQ ID NO: 1216 - protein, 199 aa, Homo sapiens
HLIYKCGGIDKRTIEKFGKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNAS

SEQ ID NO: 1217 - protein, 76 aa, Homo sapiens
TGIAILTGDFPSLEPRHVSTWLQHVVTIPTRNWHKCYCVGVVANFLNVSADFLNNFLISLLAVGWLSGIHFVNTDN

SEQ ID NO: 1218 - protein, 122 aa, Homo sapiens
LFHTQCVSQKGMLSGLPILGDTSFKFTNTSSNNQDSTVSLRCPCNHVFDKVSVSWGINDSHIVLAGLKFPQGDINGDTTFTLSFQFIQDPGILEGALSHLSSLLPKFFNGSFVDATAFIDQM

SEQ ID NO: 1219 - protein, 56 aa, Homo sapiens
YLLVSNFHKEISMVIPRSRSAFSLSKTQAYLKEPFPISAASFPNFSMVLLSMPPHL

SEQ ID NO: 1220 - protein, 62 aa, Homo sapiens
VFLSPWVKSESGSLCLSVLVYCWSESKFLIKAVDLALTVYADIGETIWLFQTSQDLSKKTWL

SEQ ID NO: 1221 - protein, 86 aa, Homo sapiens
EPSQQLLSRIYSLTSNKQALRDTESQIQILPMGIKRLRLSPHLENYLHHKYIITGSLYEADTKCYRHSQNIILGNNVIKMPNLSQQ

SEQ ID NO: 1222 - protein, 95 aa, Homo sapiens
  variant (1)...(95): Xaa = Any amino acid
PLXVALAQRKEERQAHLTNQYMQRMASVRAVPNPVINPYQPAPPSGYFMAAIPQTQNXAAYYPPSQIAQLRPSPRWTAQGARPHPFQNMPGAIRP

SEQ ID NO: 1223 - protein, 115 aa, Homo sapiens
TLPPDRMKFISTSLLLMLLVSSLSPVQGVLEVYYTSLGCRCVQESSVFIPRRFIDRIQILPRGNGCPRKEIIVWKKNKSIVCVDPQAEWIQRMMEVLRKRSFSTLPVPVFKRKIP

SEQ ID NO: 1224 - protein, 51 aa, Homo sapiens
IFSRKKNFPIQISMRLCKNNLAEADGANSSFFTHSTLYTLGVCILIHQGGK

SEQ ID NO: 1225 - protein, 64 aa, Homo sapiens
SSSRHLCFSCCWSAASLQSKVFWRSITQAWGVDVSKRAQSLSLDASLIEFKSCPVGMVVQEKKS

SEQ ID NO: 1226 - protein, 55 aa, Homo sapiens
EKEVFQLYQFQCLRERFPDADISTKNTCILPLSLLWILVLCLVKSFPGKRTSPYK

SEQ ID NO: 1227 - protein, 51 aa, Homo sapiens; identical to SEQ ID NO: 1145

SEQ ID NO: 1228 - protein, 73 aa, Homo sapiens
YSIFFCHFLHQQPGRLHLMEKIYDCFMTFLNYLFFIPHLRFWWSPFCIIVLRMIKKITTRDNTEPIPFIFLQG

SEQ ID NO: 1229 - protein, 70 aa, Homo sapiens
SFSLTLNVENVAIVAACVVTLLLLSNFLTLKKGRMSASECDFLLTCSLDRLFSIVFFFVIFSINNQGDCT

SEQ ID NO: 1230 - protein, 82 aa, Homo sapiens
ECHEAVIYLFHQVQSPWLLMEKMTKKNTILKSLSKEQVSRKSHSEALILPFFSVRKLLKRRSVTTQAATMATFSTFNVREKE

SEQ ID NO: 1231 - protein, 72 aa, Homo sapiens
AMLFLQKTDGCWLFRASLMGCGNSKNVPQCQPCRKINGMGSVLSLVVIFFIILKTMMQKGLHQKRRCGIKKR

SEQ ID NO: 1232 - protein, 50 aa, Homo sapiens
YSIFFCHFLHQQPGRLHLMEKIYDCFMTFLNYLFLFHIYVFGGVPFASLF

SEQ ID NO: 1233 - protein, 94 aa, Homo sapiens
LSFLEVLCTYAPHLYLAFAWSDHSSFSLTLNVENVAIVAACVVTLLLLSNFLTLKKGRMSASECDFLLTCSLDRLFSIVFFFVIFSINNQGDCT

SEQ ID NO: 1234 - protein, 53 aa, Homo sapiens
  variant (1)...(53): Xaa = Any amino acid
XMLFLQKTDGCWLFRASLMGCGNSKNVPQCQPCRKINGMGSVLSLVVIFFYHP

SEQ ID NO: 1235 - protein, 59 aa, Homo sapiens; identical to SEQ ID NO: 1184

SEQ ID NO: 1236 - protein, 91 aa, Homo sapiens
ECHEAVIYLFHQVQSPWLLMEKMTKKNTILKSLSKEQVSRKSHSEALILPFFSVRKLLKRRSVTTQAATMATFSTFNVREKELWSLHAKAR

SEQ ID NO: 1237 - protein, 55 aa, Homo sapiens
PRLLPAPPWRRATSCLTARSSPLAMSGSAALRHSSSLPSWAWSPVASTKLPSTPS

SEQ ID NO: 1238 - protein, 54 aa, Homo sapiens
RSRSLLLLSASTPCGSAAPSWPRCPPSSRCGSASRSMTSPAPPSSTANASRRTM

SEQ ID NO: 1239 - protein, 147 aa, Homo sapiens
TAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 1240 - protein, 135 aa, Homo sapiens
KHLRWTMEGPDSSYSCLLIHICWKVDSEARMEPPIHTEYLRSGGAMILIFIVLGARAVISFCILSAMPGYMVVPPDSTVLAYRSLRMSTSHFMMELKVVSWMPQDSMPRKEGWKSASGQRNRSLPMVMTWPSGSS

SEQ ID NO: 1241 - protein, 151 aa, Homo sapiens
IVRLEAFAVDDGGAGLVILLLADPHLLEGGQRGQDGAADPHGVLALRRSNDLDLHCAGCQGSDLLLHPVGNARVHGGAARQHCVGVQVFADVHVTLHDGVEGSFVDATGLHAQEGRLEECLRAAEPLIANGDDLAVRQLVALLQGGAGSSR

SEQ ID NO: 1242 - protein, 85 aa, Homo sapiens
  variant (1)...(85): Xaa = Any amino acid
PPLDPGAQGGGGEHQRWRSQVVPGDSQESGVRRLQDLSRLCRYLTAFFTLLLXGSEQMALPCXVTKTMASLEQSSDVWYHVFSFL

SEQ ID NO: 1243 - protein, 72 aa, Homo sapiens
  variant (1)...(72): Xaa = Any amino acid
TPTVEVPGSPGRQSGVWGEEASRPLKALQVFNCILHSLVXGVRTDGPALXSYKNDGIPGAVLRCLVPRLQLS

SEQ ID NO: 1244 - protein, 50 aa, Homo sapiens
  variant (1)...(50): Xaa = Any amino acid
RKLKTWYQTSEDCSRDAIVFVTXQGRAICSDPXNKRVKNAVKYLQSLERS

SEQ ID NO: 1245 - protein, 115 aa, Homo sapiens; identical to SEQ ID NO: 1143

SEQ ID NO: 1246 - protein, 55 aa, Homo sapiens; identical to SEQ ID NO: 1144

SEQ ID NO: 1247 - protein, 51 aa, Homo sapiens
  variant (1)...(51): Xaa = Any amino acid
XHAYLYGEVLFPGKDLTKHKTKIQSRDKGRMQVFLVEISASGNLSLKHWNW

SEQ ID NO: 1248 - protein, 62 aa, Homo sapiens
  variant (1)...(62): Xaa = Any amino acid
VFLSPWVKSESGSLCXSVLVYCWSESKFLIKAVDLALTVYAXIGETIWLFQTSQDXSKXTWL

SEQ ID NO: 1249 - protein, 86 aa, Homo sapiens
  variant (1)...(86): Xaa = Any amino acid
EPSQQLLSRIYSLTSNKQALXDTESQIQILPMGIKRLRLSPHLENYLHHKYIITGSLYEADTKCYRHSQNIILGNNVIKMPNLSQQ

SEQ ID NO: 1250 - protein, 69 aa, Homo sapiens [sequence omitted]

SEQ ID NO: 1251 - protein, 102 aa, Homo sapiens
LPTSPSALASYSPSTTDMAQSLALSLLILVLAFGIPRTQGSDGGAQDCCLKYSQRKIPAKVVRSYRKQEPSLGCSIPAILFLPRKRSQAELCADPKELWVQQ

SEQ ID NO: 1252 - protein, 77 aa, Homo sapiens [sequence omitted]

SEQ ID NO: 1253 - protein, 60 aa, Homo sapiens [sequence omitted]

SEQ ID NO: 1254 - protein, 115 aa, Homo sapiens; identical to SEQ ID NO: 1143

SEQ ID NO: 1255 - protein, 55 aa, Homo sapiens
  variant (1)...(55): Xaa = Any amino acid
EKEVLQLYQFQCLRERFPDADISTKNTCILPLSLLWILVLCLVKSFPGKRXSPYK

SEQ ID NO: 1256 - protein, 51 aa, Homo sapiens
  variant (1)...(51): Xaa = Any amino acid
SHAYLYGEXLFPGKDLTKHKTKIQSRDKGRMQVFLVEISASGNLSLKHWNW

SEQ ID NO: 1257 - protein, 64 aa, Homo sapiens
PNHFFFYFNSLFFFSSADRRTMLDLGLEHVLFHSFSTMPAITSSWKKAKISITDKMPKNRDCML

SEQ ID NO: 1258 - protein, 59 aa, Homo sapiens
SWGGSGKFVSVSSSSSSWIGIISMSSSFFGWEDVSVSPTTSSFISIVCSFFLLLTGELC

SEQ ID NO: 1259 - protein, 71 aa, Homo sapiens
HSSPVSRRKKEQTIEIKEEVVGLTETSSQPKNEEDIEIIPIQEEEEEETETNFPEPPQDQESSPIENDSSP

SEQ ID NO: 1260 - protein, 94 aa, Homo sapiens
  variant (1)...(94): Xaa = Any amino acid
KMESXNFIRAHTPYINIXNYEPANPXEKNSPSTQYCYSIQSLFLGILSVMLIFAFFQELVIAGIVENEWKRTCSRPKSNIVLLSAEEKKNRLLK

SEQ ID NO: 1261 - protein, 164 aa, Homo sapiens
LNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYS

SEQ ID NO: 1262 - protein, 72 aa, Homo sapiens
RTSSRGPSCCGSVRAPGKGPSHSHGWSGPRTEANLTSMRLNPTRRKNFLLLLSLTSFAITKSWLLRIFLRIP

SEQ ID NO: 1263 - protein, 120 aa, Homo sapiens
GVILSKGMVFVNIWIQILQGILRNILSSHDFVIANDVRESNSRKFFLRVGFNRMEVRFASVLGPLHPCECDGPFPGALTEPQQEGPRLLVLQQGTLSLLADEAHDAPIIPEREQVFFNEF

SEQ ID NO: 1264 - protein, 114 aa, Homo sapiens
GSTAWKSGSPPFWDRSTHVNVMAPSRELSLNRSRKVPGCWSFNRARSRSLLMKPMMHPSFQRGSRCFLMSSRMLSIQSQKGKFLSFIFSLQNLVHGMRPSGLALGPRSFSPNMF

SEQ ID NO: 1265 - protein, 88 aa, Homo sapiens
TLPPDRMKFISTSLLLMLLVSSLSPVQGVLEVYYTSLRCRCVQESSVFIPRRFIDRIQILPRGNGCPRKEIIVWKKNKSIVCVDPQAE

SEQ ID NO: 1266 - protein, 75 aa, Homo sapiens
CVQESSVFIPRRFIDRIQILPRGNGCPRKEIIVWKKNKSIVCVDPQAEWIQRMMEVLRKRSSSTLPVPVFKRKIP

SEQ ID NO: 1267 - protein, 53 aa, Homo sapiens
IFSRKKNFPIQISMRLCKNNLAEADGANSSFFTHSTLYTLGVCILIHQGGKFL

SEQ ID NO: 1268 - protein, 55 aa, Homo sapiens; identical to SEQ ID NO: 1144

SEQ ID NO: 1269 - protein, 52 aa, Homo sapiens
DYVKITLQKLMGQTQASSLTAPYIHLEFAFLFIREESFFENSYSVISNTGLF

SEQ ID NO: 1270 - protein, 51 aa, Homo sapiens; identical to SEQ ID NO: 1145

SEQ ID NO: 1271 - protein, 112 aa, Homo sapiens
LPEQRDLHTETPSWAPGTMAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 1272 - protein, 59 aa, Homo sapiens
AEGPAHRDSLLGSWHHGPTEDAGPGHPPPGGFSAAHPRSSRDQCGPGVLPGVLQGSHSP

SEQ ID NO: 1273 - protein, 146 aa, Homo sapiens
PPLDPGAQGGGGEHQRWRSQVVPGDSQESGVRRLQDLSRLCRYLTAFFTLLLLGSEQMALPCTVTKTMASLEQSSDVWYHVFSFLRGMAPLKYSRQHSRPTLVPRAAWMCCREAPRRRVTRASIFSGAMVPGAQEGVSVCRSLCSG

SEQ ID NO: 1274 - protein, 134 aa, Homo sapiens
TPTVEVPGSPGRQSGVWGEEASRPLKALQVFNCILHSLVVGVRTDGPALHSYKNDGIPGAVLRCLVPRLQLSKGNGSLEVLQAALPAHIGPSSCVDVLQRSPQEEGDQGQHLQWGHGARSPGGSLCVQVPLLRE

SEQ ID NO: 1275 - protein, 115 aa, Homo sapiens
  variant (1)...(115): Xaa = Any amino acid
PPLDPGAQGGGGEHQRWRSQVVPGDSQESGVRRLQDLSRLCRYLTAFFTLLXLGSEQMALPCTVTKTMASLEQSSDVWYHVFSFLRGMAPLKYSRQHSRPTLVPRAAWMCCXXXP

SEQ ID NO: 1276 - protein, 102 aa, Homo sapiens
  variant (1)...(102): Xaa = Any amino acid
TPTVEVPGSPGRQSGVWGEEASRPLKALQVFNCILHSLXVGVRTDGPALHSYKNDGIPGAVLRCLVPRLQLSKGNGSLEVLQAALPAHIGPSSCVDVLXXXP

SEQ ID NO: 1277 - protein, 80 aa, Homo sapiens
  variant (1)...(80): Xaa = Any amino acid
GXXXQHIHAARGTNVGRECCLEYFKGAIPLRKLKTWYQTSEDCSRDAIVFVTVQGRAICSDPNXKRVKNAVKYLQSLERS

SEQ ID NO: 1278 - protein, 64 aa, Homo sapiens
  variant (1)...(64): Xaa = Any amino acid
MIITCVSXTXCXLWLLVIYXLPVXXKVXGXXTXKFXKHLXFSXKLXEGTREFHXXIKXSXGIST

SEQ ID NO: 1279 - protein, 79 aa, Homo sapiens
  variant (1)...(79): Xaa = Any amino acid
QXKXFKLQGXQXNTXLXXKXICFESXCMYIYMINDYNVCVXDXMXSLVVSYILXTCXXQGKXXTXXXIYXTLXFFXEVX

SEQ ID NO: 1280 - protein, 78 aa, Homo sapiens
  variant (1)...(78): Xaa = Any amino acid
NSLVPSXNFXEKXKCXINXXXCXXLTLXXTGXQYITNNQRXHXVXDTHVIIIYHIYIHAXTFKANXFXXQXSIXLXTL

SEQ ID NO: 1281 - protein, 191 aa, Homo sapiens
PKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQ

SEQ ID NO: 1282 - protein, 51 aa, Homo sapiens
LKQLGINCLISFTKHRDKVAHLLYVIRCKESVCCACFGTASSSSNSMNIIL

SEQ ID NO: 1283 - protein, 51 aa, Homo sapiens
NPVTLLLTLVTMDTHGRPPISPHFSGKLITSSFGFHKNNGFILLLTHDLFH

SEQ ID NO: 1284 - protein, 55 aa, Homo sapiens
LLSPWIPMAGHPSLLIFLVSSSHLLLVSTKTMVLFSFSLMISSIRRISFSSFSTS

SEQ ID NO: 1285 - protein, 107 aa, Homo sapiens
DLHTETPSWAPGTMALLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 1286 - protein, 56 aa, Homo sapiens
PAHRDSLLGSWHHGPTEDAGPGHPPPGGFSAAHPRSSRDQCGPGVLPGVLQGSHSP

SEQ ID NO: 1287 - protein, 141 aa, Homo sapiens
PPLDPGAQGGGGEHQRWRSQVVPGDSQESGVRRLQDLSRLCRYLTAFFTLLLLGSEQMALPCTVTKTMASLEQSSDVWYHVFSFLRGMAPLKYSRQHSRPTLVPRAAWMCCREAPRRRVTRASIFSRAMVPGAQEGVSVCR

SEQ ID NO: 1288 - protein, 113 aa, Homo sapiens
TPTVEVPGSPGRQSGVWGEEASRPLKALQVFNCILHSLVVGVRTDGPALHSYKNDGIPGAVLRCLVPRLQLSKGNGSLEVLQAALPAHIGPSSCVDVLQRSPQEEGDQGQHLQ

SEQ ID NO: 1289 - protein, 106 aa, Homo sapiens
ISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 1290 - protein, 53 aa, Homo sapiens
IFSRKKNFPIQISMRLCKNNLAEADGANSSFFTHSTLYTLGVCILIHRGGKFL

SEQ ID NO: 1291 - protein, 55 aa, Homo sapiens; identical to SEQ ID NO: 1144

SEQ ID NO: 1292 - protein, 51 aa, Homo sapiens
DYVKITLQKLMGQTQASSLTAPYIHLEFAFLFIGEESFFENSYSVISNTGL

SEQ ID NO: 1293 - protein, 51 aa, Homo sapiens; identical to SEQ ID NO: 1145

SEQ ID NO: 1294 - protein, 74 aa, Homo sapiens
DPDCDLQWKETGRWEDDGRLRHQKGQLTLPGILLYWRVTTLGMGCWQGSKSLFLLISYSTNTSSDDFPKLMRMR

SEQ ID NO: 1295 - protein, 56 aa, Homo sapiens
SSVAQVKAMIETKTGIIPETQIVTCNGKRLEDGKMMADYGIRKGNLLFLASYCIGG

SEQ ID NO: 1296 - protein, 74 aa, Homo sapiens
LIVLESKKHRVGQYTSSYPSHPNLTLLISFSLILGNHQKMCSLSKRLKEISFLTPANTPCPGWSPSNTIRCQEE

SEQ ID NO: 1297 - protein, 115 aa, Homo sapiens
TLPPDRMKFISTSLLLMLLVSSLSPVQGVLEVYYTSLRCRCVQESSVFIPRRFIDRIQILPRGNGCPRKEIIVWKKNKSIACVDPQAEWIQRMMEVLRKRSSSTPPVPVFKRKIP

SEQ ID NO: 1298 - protein, 53 aa, Homo sapiens; identical to SEQ ID NO: 1267

SEQ ID NO: 1299 - protein, 55 aa, Homo sapiens
EKEVLQLHQFQCLRERFPDADISTKNTCILPLSLLWILVLCLVKSFPGKRTSPYK

SEQ ID NO: 1300 - protein, 53 aa, Homo sapiens [sequence omitted]

SEQ ID NO: 1301 - protein, 125 aa, Homo sapiens
RYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 1302 - protein, 59 aa, Homo sapiens
SSESGKIRFKSWILVFGKRSVLRRGILLDSPGSSSNIGPFSSRQFAELLSGLQRTHWYL

SEQ ID NO: 1303 - protein, 100 aa, Homo sapiens
GCHGKHHFRLLVGNPVPFPLGSHSQILIQSRSRSRSLIQSSPQKVGRYDSSPGFSSLEKGQSSDGGSCWIHLEVVRTLVLFLQGSLQNYCLDCSAPIGTW

SEQ ID NO: 1304 - protein, 50 aa, Homo sapiens
SWEPGQVSVGTSLSRWQHSDWPCRRGWLSPLETKTGWLETVTTQVLRWSL

SEQ ID NO: 1305 - protein, 131 aa, Homo sapiens
PDSTGELVLSQSPATLSLSPGERATLSCRASQSVATYLGWSQQKPGQAPRIIIYDTSYRAAGIPARFTGSGSGTDFTLTVSSLEPEDFAVYYCHGRAKWPPSLTFGGGTKVEIKRTVAAPSVFIFPPSDEQ

SEQ ID NO: 1306 - protein, 53 aa, Homo sapiens
RLHRRTCVVTVSSHPVFVSRGESHPLLQGQSECCHLLRLVPTETWPGSQDHHL

SEQ ID NO: 1307 - protein, 78 aa, Homo sapiens
CPRWGTPRYWLGALYRNQQSSPTAPPGLLPLEYFPAAPHCSHSRQWRCSQTHRIHHHPQMLGPCRQEICGEIQGCGWF

SEQ ID NO: 1308 - protein, 134 aa, Homo sapiens [sequence omitted]

SEQ ID NO: 1309 - protein, 66 aa, Homo sapiens
ASSSPRIRLTSSFAFSVACLLWCMMPKVGNTQVLAGGTISESAKLTHCTTWAAASGVLPRSSSLLT

SEQ ID NO: 1310 - protein, 141 aa, Homo sapiens
QTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLVDITVVCTLLWLYKQVLEPSFHQ

SEQ ID NO: 1311 - protein, 61 aa, Homo sapiens
CHKRSLPICTYSQEEHLYGKDGSPVSLPYTLQGLSEASLMRCLKPGHGYKQLHGSKKFCPF

SEQ ID NO: 1312 - protein, 51 aa, Homo sapiens
SIFWGYDGLTFIRKYGFILIVASSSGGVNHFIFTLTWFEFLSHYCIYFAFP

SEQ ID NO: 1313 - protein, 101 aa, Homo sapiens; identical to SEQ ID NO: 930

SEQ ID NO: 1314 - protein, 150 aa, Homo sapiens; identical to SEQ ID NO: 928

SEQ ID NO: 1315 - protein, 115 aa, Homo sapiens; identical to SEQ ID NO: 1143

SEQ ID NO: 1316 - protein, 55 aa, Homo sapiens; identical to SEQ ID NO: 1144

SEQ ID NO: 1317 - protein, 51 aa, Homo sapiens; identical to SEQ ID NO: 1145

SEQ ID NO: 1318 - protein, 68 aa, Homo sapiens
PPAYAACHTGDRFSRRARRCWCGWKKGNRKQKKSLKESCHFLLVRIPDLGEVLESSSLFLLLPLLGLE

SEQ ID NO: 1319 - protein, 101 aa, Homo sapiens; identical to SEQ ID NO: 930

SEQ ID NO: 1320 - protein, 137 aa, Homo sapiens
YINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 1321 - protein, 59 aa, Homo sapiens
NKKAMLVECTVHIGGARLITIRLLASPVQSFLWKAVDFSLASLSSSVSTYRISRSQPYR

SEQ ID NO: 1322 - protein, 64 aa, Homo sapiens
TAKRSKIRRQCLWNVQCILAAHASLRFACLLLLFNRFFGRQWIFLLRLCLLQFRLIEFLDLSHI

SEQ ID NO: 1323 - protein, 57 aa, Homo sapiens
EGNACGMYSAYWRRTPHYDSPACFSCSIVSLEGSGFFSCVSVFFSFDLSNFSISAIS

SEQ ID NO: 1324 - protein, 51 aa, Homo sapiens
RRQRRKRKIHCLPKKRLNRRSKQANRNEACAANMHCTFHKHCLLILLLLAV

SEQ ID NO: 1325 - protein, 64 aa, Homo sapiens
  variant (1)...(64): Xaa = Any amino acid
LNILNXALLSVELLYFTFSAFGDHYLIEFVEIDFPDRSLFFNEQMIRNNLTPYMTMELNKLTLI

SEQ ID NO: 1326 - protein, 100 aa, Homo sapiens
LNKRGTNFQFVKLQSRKYWCLLPCEFFLRHAEKMYARDQKDGSKLCHVTCNKIFSSRFFLCWQIISPCSFHSLILAFRVTMIILPMWFLRKKDQFFVCSR

SEQ ID NO: 1327 - protein, 52 aa, Homo sapiens
NSKAESIGACYLVNSSLDMQRKCMQETKKMAPSYVMLPVIKSFLLDSFYVGR

SEQ ID NO: 1328 - protein, 59 aa, Homo sapiens; identical to SEQ ID NO: 1321

SEQ ID NO: 1329 - protein, 64 aa, Homo sapiens; identical to SEQ ID NO: 1322

SEQ ID NO: 1330 - protein, 57 aa, Homo sapiens; identical to SEQ ID NO: 1323

SEQ ID NO: 1331 - protein, 51 aa, Homo sapiens; identical to SEQ ID NO: 1324

SEQ ID NO: 1332 - protein, 50 aa, Homo sapiens
DRYWYSFIIETKRSALLDFPLFVLKGIKDCRFPALSSRGHYEQIKWKDKF

SEQ ID NO: 1333 - protein, 51 aa, Homo sapiens
WPREDRAGNLQSLIPFRTKSGKSSKADLLVSIIKEYQYRSQKRSVSLQGYF

SEQ ID NO: 1334 - protein, 90 aa, Homo sapiens
PKEVRQLAEDFLKDYIHINIGALELSANHNILQIVDVCHDVEKDEKLIRLMEEIMSEKENKTIVFVETKRRCDELTRKMRRDGWPAMGIH

SEQ ID NO: 1335 - protein, 52 aa, Homo sapiens
PWIPMAGHPSLLIFLVSSSHLLLVSTKTMVLFSFSLMISSIRRISFSSFSTS

SEQ ID NO: 1336 - protein, 166 aa, Homo sapiens
  variant (1)...(166): Xaa = Any amino acid
RQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILXEIGG

SEQ ID NO: 1337 - protein, 76 aa, Homo sapiens
LPNQGQCESAVSFIEILSTDANQGELRLILPQFYRVVTILKLLHIASQFGVWRFVYSVPVNRNFDLFIELEDDQGI

SEQ ID NO: 1338 - protein, 73 aa, Homo sapiens
VTVQMIDSRVNTQGVHPVPKCPLFSRLTFKSPPVNVLVLWFVQGRVSVKEVGNKSQVQLGVPSDNICGCDKLP

SEQ ID NO: 1339 - protein, 68 aa, Homo sapiens
LTRGLTPREFIQFLNVRSSLVSPSRAPQSMSWFSGLCRAGYLLKRLAIKAKFNLGFPRTTSVAVTNCR

SEQ ID NO: 1340 - protein, 60 aa, Homo sapiens
WRGSGLLPQVQPKEDSRQGCPQLPEAGTKLRLLHPSYPVLAPQALSGRAMCRPKGALGAA

SEQ ID NO: 1341 - protein, 95 aa, Homo sapiens
LASYSPSTTDMAQSLALSLLTLVLAFGIPRTQGSDGGAQDCCLKYSQRKIPAKVVRSYRKQEPSLGCSIPAILFLPRKRSQAELCADPKELWVQQ

SEQ ID NO: 1342 - protein, 50 aa, Homo sapiens
AWFLLPVAADNLGGNLPLAVLEATVLSPSITALGPGDAKGQNQGKEAQSQ

SEQ ID NO: 1343 - protein, 102 aa, Homo sapiens [sequence omitted]

SEQ ID NO: 1344 - protein, 60 aa, Homo sapiens; identical to SEQ ID NO: 1340

SEQ ID NO: 1345 - protein, 50 aa, Homo sapiens
AWFLLPVAADNLGGNLPLAVLEATVLSPSITALGPGDAKGQNQDKEAQSQ

SEQ ID NO: 1346 - protein, 76 aa, Homo sapiens
TKLVMMQKLLKCSRLVLALALILVLESSVQGYPTQRARYQWVRCNPDSNSANCLEEKGPMFELLPGESNKIPRLRT

SEQ ID NO: 1347 - protein, 68 aa, Homo sapiens
CRSYSNAVGLSWLLPSSWFWNPQFKVILRREPGTNGCAAIQTVILQTALKKKDQCSNYFQVNPTRSPV

SEQ ID NO: 1348 - protein, 87 aa, Homo sapiens
ILTLYSEPSFNTMVSFLRASRSPVRSMVIGPGALSQTRVSRVTTTLGAFGSVTTGPSPSSVFLYLIRLSSSLSISCSSFRDFCGGGL

SEQ ID NO: 1349 - protein, 55 aa, Homo sapiens
HNGFLFEGFQISSKVHGDWSRGTLTNQGEPGDNDIGGFRICHHRTISQQRFLVLN

SEQ ID NO: 1350 - protein, 120 aa, Homo sapiens
LKKPQSPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVS

SEQ ID NO: 1351 - protein, 124 aa, Homo sapiens
IMHLSFVDNLNVEVLSVSLVHLILEKALDQSGLMILYATGNESALWNCKHQGWGKHNCDHAEDAGVICSKGADLSLRLVDGVTECSGRLEVRFQGEWGTICDDGWDSYDAAVACKQLGCPTAVP

SEQ ID NO: 1352 - protein, 69 aa, Homo sapiens
RGGNMCSGRIEIKFQGRWGTVCDDNFNIDHASVICRQLECGSAVSFSGSSNFGEGSGPIWFDDLICNRK

SEQ ID NO: 1353 - protein, 80 aa, Homo sapiens
LHLPVSGSDLLPLSKSLQHPQHDHSYAFPILDVCSSRELTHFRLHIRSSNQIGPEPSPKLDEPEKLTALPHSSCLQMTDA

SEQ ID NO: 1354 - protein, 59 aa, Homo sapiens
ESNKIPRLRTDLFPKTRIQDLNRIFPLSEDYSGSGFGSGSGSGSGSGSGFLTEMDKDSN

SEQ ID NO: 1355 - protein, 68 aa, Homo sapiens
SWKASLSSTSWNPCPFPLGSHSQILIQSRSRSRSLIQSSPQKVGRYDSSPGFSSLEKGQSSDGGSCWI

SEQ ID NO: 1356 - protein, 158 aa, Homo sapiens
  variant (1)...(158): Xaa = Any amino acid
MMQKLLKCSRVVLALALILVLESSVQGYPTQRARYQWVRCNPDSNSANCLEEKGPMFXLLPGESNKIPRLRTDLFPKTRIQDLNRIFXLSEDYSGSGFGSGSXSGSGSGSGFLTEMEQDYQLVDQSDAFHDNLRSLDRNLPSXSXDLGQHGLEEDFML

SEQ ID NO: 1357 - protein, 68 aa, Homo sapiens
  variant (1)...(68): Xaa = Any amino acid
CRSYSNAVGLSWLLPSSWFWNPQFKVILRREPGTNGCAAIQTVILQTALKKKDQCXNYFQVNPTRSPV

SEQ ID NO: 1358 - protein, 64 aa, Homo sapiens
  variant (1)...(64): Xaa = Any amino acid
SSEXGKIRFKSWILVFGKRSVLRRGILLDSPGSSXNIGPFSSRQFAELLSGLQRTHWYLALCVG

SEQ ID NO: 1359 - protein, 103 aa, Homo sapiens
  variant (1)...(103): Xaa = Any amino acid
GCHGKHHFGLLVGNPVPFPLGSHSQILIQXRSRSRSLIQSSPQKXGRYDSSPGFWSLEKGQSSDGGSCWIHLEVVXTLVLFLQGSLQNYCLDCSAPIGTWLSA

SEQ ID NO: 1360 - protein, 123 aa, Homo sapiens
  variant (1)...(123): Xaa = Any amino acid
VMMQKLLKCSRLVLALALILVLESSVQGYPTQRARYQWVRCNPDSNSANCLEEKGPMFELLPGESNKIPRLRTDLFPKTRIQDLNRIFXLSEDYSGSGFGSRSGSGSGSGSGFLTEMEXGLPN

SEQ ID NO: 1361 - protein, 68 aa, Homo sapiens; identical to SEQ ID NO: 1347

SEQ ID NO: 1362 - protein, 64 aa, Homo sapiens
  variant (1)...(64): Xaa = Any amino acid
SSEXGKIRFKSWILVFGKRSVLRRGILLDSPGSSSNIGPFSSRQFAELLSGLQRTHWYLALCVG

SEQ ID NO: 1363 - protein, 104 aa, Homo sapiens
  variant (1)...(104): Xaa = Any amino acid
GLSWKASLSSTSWVIXVPFPLGSHSQILIQSRSGSRSLIQSSPQKXGRYDSSPGFSSLEKGQSSDGGSCWIHLEVVRTLVLFLQGSLQNYCLDCSAPIGTWLSA

SEQ ID NO: 1364 - protein, 148 aa, Homo sapiens
  variant (1)...(148): Xaa = Any amino acid
TXXVMMQKLLKCSRLVLALALILVLESSVQGYPTQRARYQWVRCNPDSNSANCLEEKGPMXELLXGEXNXIPRLRTDLFPKTRIQDLNRIFPLSEDYSGSGFGSGSGSGSGSGSGFLTEMEQDYQLXDESDAFHDNLXSLDRNLPXDS

SEQ ID NO: 1365 - protein, 68 aa, Homo sapiens
  variant (1)...(68): Xaa = Any amino acid
CRSYSNAVGLSWLLPSSWFWNPQFKVILRREPGTNGCAAIQTVILQTALKKKDQCXNYXQVNXTXSPV

SEQ ID NO: 1366 - protein, 103 aa, Homo sapiens
  variant (1)...(103): Xaa = Any amino acid
GCHGKHHFRLXVGNPVPFPLGSHSQILIQSRSRSRSLIQSSPQKVGRYDSSPGFSSLEKGQSSDGGXCXIHLXVVXTLVLFLQGSLQNYCLDCSAPIGTWLSA

SEQ ID NO: 1367 - protein, 64 aa, Homo sapiens
  variant (1)...(64): Xaa = Any amino acid
SSESGKIRFKSWILVFGKRSVLRRGIXLXSPXSSXNIGPFSSRQFAELLSGLQRTHWYLALCVG

SEQ ID NO: 1368 - protein, 50 aa, Homo sapiens
LTLPGGIRVRRRGRGWRSGGDHGVSRPHCASHCDERVLGLRRLLGALVHP

SEQ ID NO: 1369 - protein, 93 aa, Homo sapiens
GDGVGVGAQAATMAYHGLTVPLIVMSVFWGFVGFLVPWFIPKGPNRGVIITMLVTCSVCCYLFWLIAILAQLNPLFGPQLKNETIWYLKYHWP

SEQ ID NO: 1370 - protein, 65 aa, Homo sapiens
TGHQHGNDNSPVRTLRDEPRHQEADEAPEHAHHNERHSEAVIRHGRRLSANPYPVASLGSHQEVS

SEQ ID NO: 1371 - protein, 68 aa, Homo sapiens
  variant (1)...(68): Xaa = Any amino acid
CXSYSNAVGLSWLLPSSWFWNPQFKVILRREPGTNGCAAIQTVILQTALKKKDQCSNYFXVNPTRSPV

SEQ ID NO: 1372 - protein, 143 aa, Homo sapiens
  variant (1)...(143): Xaa = Any amino acid
XMMXKLLKCSRLVLALALILVLESSVQGYPTQRARYQWVRCNPDSNSANCLEEKGPMFELLPXESNKIPRLRTDLFXKTRIQDLNRIFPLSEDYSGSGXXSGSGSGSXSGSGFLTEMEQDYQLXDESDAFHDNLRSLDRNLPS

SEQ ID NO: 1373 - protein, 64 aa, Homo sapiens
  variant (1)...(64): Xaa = Any amino acid
SSESGKIRFKSWILVFXKRSVLRRGILLDSXGSSSNIGPFSSRQFAELLSGLQRTHWYLALCVG

SEQ ID NO: 1374 - protein, 103 aa, Homo sapiens
  variant (1)...(103): Xaa = Any amino acid
GCHGKHHFRXLVGNPVPFPLGSHSQIXIQSRSRXXSLIQSSPQKVGRYDSSPGFSSLXKGQSSDGGSCWIHXEVVRTLVLFLQGSLQNYCLDCSAPIGTWLSA

SEQ ID NO: 1375 - protein, 73 aa, Homo sapiens
RMLSYSSMLPPSGLMLHYTLLGSNLPLRLKALEGRVFKMLDLVQAQILELKAEGFLVAEKKQNLMTFGTPVLR

SEQ ID NO: 1376 - protein, 52 aa, Homo sapiens
LHAAAEWLDAPLHPPWIQPSIKAEGSRGQSIQDVRSGPSPNSRVKSRGVLSG

SEQ ID NO: 1377 - protein, 64 aa, Homo sapiens
WKVGSKEGVMEHQATRRQHGAITKHPLGFCLSRHLALTLDLVTVVWLIPVNIWRQSYLAFASRA

SEQ ID NO: 1378 - protein, 55 aa, Homo sapiens
LKTGVPNVIRFCFFSATKNPSAFNSRIWAWTRSNILNTLPSRAFSLNGRLDPRRV

SEQ ID NO: 1379 - protein, 69 aa, Homo sapiens
KLLKCSRLVLALALILVLESSVQGYPTQRARYQWVRCNPDSNSANCLEEKGPMFELLPGESNKIPRLRT

SEQ ID NO: 1380 - protein, 66 aa, Homo sapiens
SYSNAVGLSWLLPSSWFWNPQFKVILRREPGTNGCAAIQTVILQTALKKKDQCSNYFQVNPTRSPV

SEQ ID NO: 1381 - protein, 58 aa, Homo sapiens [sequence omitted]

SEQ ID NO: 1382 - protein, 109 aa, Homo sapiens; identical to SEQ ID NO: 674

SEQ ID NO: 1383 - protein, 100 aa, Homo sapiens; identical to SEQ ID NO: 675

SEQ ID NO: 1384 - protein, 103 aa, Homo sapiens [sequence omitted]

SEQ ID NO: 1385 - protein, 55 aa, Homo sapiens
HMVRLDGPSSSETQQESQGEGSQDHSSDMEHSVFRAHVVGSIIDDCEHRNSDEEL

SEQ ID NO: 1386 - protein, 97 aa, Homo sapiens
QFLITVPVLTVINYRPHNMRPEDRMFHIRAVILRALSLAFLLSLRGAGAIKADHVSTYAAFVQTHRPTGEFMFEFDEDEMFYVDLDKKETVWHLEEF

SEQ ID NO: 1387 - protein, 55 aa, Homo sapiens; identical to SEQ ID NO: 791

SEQ ID NO: 1388 - protein, 89 aa, Homo sapiens; identical to SEQ ID NO: 677

SEQ ID NO: 1389 - protein, 89 aa, Homo sapiens; identical to SEQ ID NO: 678

SEQ ID NO: 1390 - protein, 59 aa, Homo sapiens; identical to SEQ ID NO: 679

SEQ ID NO: 1391 - protein, 136 aa, Homo sapiens
RSVKLCKHTDTPEPCVFNDLLHILCCVDVGDRVVGPLSHELWKSEALIWEGRIIYQMPVEHVQFIVRHDIQSVQDAREWQVMARCIQQQAPVRKAGKVLNLSLVDKELGELPRQSQRGVNTGHHLWSGYNSPLTPK

SEQ ID NO: 1392 - protein, 124 aa, Homo sapiens
MMTSVYSSLRLSGELSEFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLTEFDTP

SEQ ID NO: 1393 - protein, 52 aa, Homo sapiens
DCLGSSPSSLSTRLRLRTFPAFLTGACCWIHLAITCHSLASWTLWMSWRTIN

SEQ ID NO: 1394 - protein, 59 aa, Homo sapiens
GNGHTLEKNVLVVSVVTPGCNQLPTLESVENYTLTINDDQCLLLSETVWGALRVLYQQD

SEQ ID NO: 1395 - protein, 88 aa, Homo sapiens
GQRRPRSIGERGGGTPGEPGAWTQPELITEAGVQSRVTCSRNKQPLWGHQVERQDDKEGARVLAKAGLLATSAGQRPPRSACPHHAVP

SEQ ID NO: 1396 - protein, 157 aa, Homo sapiens
  variant (1)...(157): Xaa = Any amino acid
LXXKAGDQVPGGQDSALVGPEDRGGPGASGREVEGHRESQERGHSQNSSQRLASSPGSRAAGTSSHSGGTRWRGKTTKRVPVFLRKRGCWPRVLDRGPHALLAPITPFRDCHAESAXRKGDSKRECGQACLRPSGRTPGLTXRRCHHFRFXXLFFFF

SEQ ID NO: 1397 - protein, 156 aa, Homo sapiens
  variant (1)...(156): Xaa = Any amino acid
XXXRLVTRSQAGKTQPWWGLRTEEAQEHRGERWRDTGRARSVDTARTHHRGWRPVPGHVQQEQAATLGAPGGEARRQRGCPCSCESGAAGHECWTEAPTLCLPPSRRSVTVTQNLXTGRETLSGSAAKPASARQGGLPGSLXGGATISALXSFSFS

SEQ ID NO: 1398 - protein, 75 aa, Homo sapiens
  variant (1)...(75): Xaa = Any amino acid
RAEAGLAALPLRVSLPXCRFCVTVTERRDGGKQSVGASVQHSWPAAPLSQEHGHPLCRLASPPGAPRVAACSCCT

SEQ ID NO: 1399 - protein, 111 aa, Homo sapiens
  variant (1)...(111): Xaa = Any amino acid
QSRNGVMGASRAWGPLSSTRGQQPRFRKNTGTLFVVLPLHLVPPEWLLVPAARDPGLDASLCDEFWLCPRSWLSRCPSTSLPDAPGPPLSSGPTKAESCPPGTWSPAFXXR

SEQ ID NO: 1400 - protein, 104 aa, Homo sapiens
  variant (1)...(104): Xaa = Any amino acid
WGQAERGGLCPALVASSPAFARTRAPSLSSCLSTWCPQSGCLFLLHVTRDWTPASVMSSGCVHAPGSPGVPPPLSPMLLGLLCPQAPPRLSLARLGPGHQPXXX

SEQ ID NO: 1401 - protein, 53 aa, Homo sapiens [sequence omitted]

SEQ ID NO: 1402 - protein, 67 aa, Homo sapiens
  variant (1)...(67): Xaa = Any amino acid
KPPFFXLLKRKGPQDTIFEWLMVFKXFRELPAFYLETEKARKILSFLACISRVGANDSKLVSKPIPL

SEQ ID NO: 1403 - protein, 120 aa, Homo sapiens; identical to SEQ ID NO: 715
  variant (1)...(120): Xaa = Any amino acid

SEQ ID NO: 1404 - protein, 52 aa, Homo sapiens; identical to SEQ ID NO: 716
  variant (1)...(52): Xaa = Any amino acid

SEQ ID NO: 1405 - protein, 60 aa, Homo sapiens; identical to SEQ ID NO: 717
  variant (1)...(60): Xaa = Any amino acid

SEQ ID NO: 1406 - protein, 52 aa, Homo sapiens [sequence omitted]

SEQ ID NO: 1407 - protein, 75 aa, Homo sapiens
SSHLLSYIHLGIPISNVSLEIRAPGGQVTEGQKLILLCSVAGGTGNVTFSWYREATGTSMGKKTQRSLSAELEIP

SEQ ID NO: 1408 - protein, 63 aa, Homo sapiens
DIQMSLSTFLKDNCYRFPTSIGMLIMDYLYNLHIPTFCIREWNQSNPVPRVSLRVLTCCLISI

SEQ ID NO: 1409 - protein, 68 aa, Homo sapiens
GISSSADRERWVFFPILVPVASLYQENVTFPVPPATEQSRISFCPSVTCPPGARISKLTLEMGIPRWI

SEQ ID NO: 1410 - protein, 56 aa, Homo sapiens; identical to SEQ ID NO: 729

SEQ ID NO: 1411 - protein, 50 aa, Homo sapiens; identical to SEQ ID NO: 730

SEQ ID NO: 1412 - protein, 70 aa, Homo sapiens; identical to SEQ ID NO: 731

SEQ ID NO: 1413 - protein, 53 aa, Homo sapiens; identical to SEQ ID NO: 732

SEQ ID NO: 1414 - protein, 69 aa, Homo sapiens
  variant (1)...(69): Xaa = Any amino acid
XHKICSIDVHESSCCXGAVSTDXWNNWPVRKLIKAANSTXECNRXXQGLISLSDGGLXICXPGXYCVIN

SEQ ID NO: 1415 - protein, 64 aa, Homo sapiens
  variant (1)...(64): Xaa = Any amino acid
XPXQQXSSPPSERLIRPCXXLLHSXVLFAALMSFLTGQLFXKSVDTAPXQQEDSWTSIEHILWX

SEQ ID NO: 1416 - protein, 92 aa, Homo sapiens
  variant (1)...(92): Xaa = Any amino acid
VERTRKPSLSEKKNNPSKWXVSSVYDTIXSWXTNXKSSIRKANKALXXSIAFXCTVCSFDELPHRPIIPXVCGYRSXTARGLMDVYRTYLVX

SEQ ID NO: 1417 - protein, 77 aa, Homo sapiens
  variant (1)...(77): Xaa = Any amino acid
GLEFRKAERFLIWQSSSSSRXLKGLSFCRRTCFSSSNSAVLFGIHPLQVFYVXNHHFNCFTNPAFLIDGSQHLSPTG

SEQ ID NO: 1418 - protein, 75 aa, Homo sapiens
  variant (1)...(75): Xaa = Any amino acid
PFLELHVNLCGQAAFAGVFTGRQRLQACLPAGSVCRRVYMQAXHHVRPLVQGFRGPAQVNRLCSHKFTELXGCAT

SEQ ID NO: 1419 - protein, 74 aa, Homo sapiens
  variant (1)...(74): Xaa = Any amino acid
AAREPVWAGSVCRRVYGQAAFAGVFTGRQRLQACLHAGVXPCETTGPGFQRSCSGESAVFSQVHGAXWVCNMKY

SEQ ID NO: 1420 - protein, 66 aa, Homo sapiens
  variant (1)...(66): Xaa = Any amino acid
LDXGLXPLSVPSVPHSTSISCCTPXQLRELVRTQPIHLSRTSETLDQWSHMVXRLHVNTPANAACR

SEQ ID NO: 1421 - protein, 127 aa, Homo sapiens
  variant (1)...(127): Xaa = Any amino acid
PPRLTSGRWGPTGPXASMPWKGRXWPRMSEPRATWSAQPLAIGEYSRCLSASSELPSTRPGDETEGGSSPSMSARSSKPQETSHNTYVCTPKTNGEREGREARKAWCFLWVHPKQRLLLDTVIDEAW

SEQ ID NO: 1422 - protein, 54 aa, Homo sapiens
VQDLLNPKRLHTTLMYAPQRLMGRGRAGKPGKLGVFSGYTPSSVSFWIQLLMRL

SEQ ID NO: 1423 - protein, 76 aa, Homo sapiens
  variant (1)...(76): Xaa = Any amino acid
TQTDQREMGPHRAXCVNAMEGKXLAQDVRAKGYLECSALSNRGVQQVFECVVRTAVNQARRRNRRRLFSINECKIF

SEQ ID NO: 1424 - protein, 138 aa, Homo sapiens; identical to SEQ ID NO: 778
  variant (1)...(138): Xaa = Any amino acid

SEQ ID NO: 1425 - protein, 60 aa, Homo sapiens; identical to SEQ ID NO: 779
  variant (1)...(60): Xaa = Any amino acid

SEQ ID NO: 1426 - protein, 66 aa, Homo sapiens; identical to SEQ ID NO: 780

SEQ ID NO: 1427 - protein, 55 aa, Homo sapiens
KLYNACIMKKDLPFPYILIELHRLAVHFVIHVIRILDSIAFEICFFLGTKSQLIV

SEQ ID NO: 1428 - protein, 52 aa, Homo sapiens; identical to SEQ ID NO: 787
  variant (1)...(52): Xaa = Any amino acid

SEQ ID NO: 1429 - protein, 56 aa, Homo sapiens; identical to SEQ ID NO: 792

SEQ ID NO: 1430 - protein, 177 aa, Homo sapiens; identical to SEQ ID NO: 793
  variant (1)...(177): Xaa = Any amino acid

SEQ ID NO: 1431 - protein, 56 aa, Homo sapiens; identical to SEQ ID NO: 794

SEQ ID NO: 1432 - protein, 70 aa, Homo sapiens [sequence omitted]

SEQ ID NO: 1433 - protein, 53 aa, Homo sapiens; identical to SEQ ID NO: 796

SEQ ID NO: 1434 - protein, 146 aa, Homo sapiens [sequence omitted]

SEQ ID NO: 1435 - protein, 58 aa, Homo sapiens; identical to SEQ ID NO: 798

SEQ ID NO: 1436 - protein, 69 aa, Homo sapiens
  variant (1)...(69): Xaa = Any amino acid
EGKLSDNRSSIRWVCPCIACQRLAHHQGSGVAVLPCVVCIASLSSACLSPSXPPSPLXLYQVCHGEQEY

SEQ ID NO: 1437 - protein, 50 aa, Homo sapiens
  variant (1)...(50): Xaa = Any amino acid
LWKRAPPGAXGKDCFSLSSPIPGYSRADQQGHFHLTSCCSLMFPWDKRGN

SEQ ID NO: 1438 - protein, 59 aa, Homo sapiens
  variant (1)...(59): Xaa = Any amino acid
VLLXHPLPXGSTRYATGSRNINPRILTLSGNTECTPGMLGETRGILLTINLGSKRPYLI

SEQ ID NO: 1439 - protein, 68 aa, Homo sapiens
  variant (1)...(68): Xaa = Any amino acid
QPQQHPLGLSLYRMPEACASPRVGRSCAALRCVHSLSLLCLLKSFLXTLSLXALPGMPRGAGILILES

SEQ ID NO: 1440 - protein, 54 aa, Homo sapiens
  variant (1)...(54): Xaa = Any amino acid
LSVAIQSVLQGCWVKPGEFYSPLTLGVRGHTSSETLPARAGRSKGXFPXPLRXY

SEQ ID NO: 1441 - protein, 100 aa, Homo sapiens
  variant (1)...(100): Xaa = Any amino acid
NSPGFTQHPWSTLCIATESQDSRINIPAPRGIPGRAXRERVXKKDLSKQRRERLCTQRRAAQLRPTLGDAQASGMRYRDRPSGCCCGCHLISPLIPREHQ

SEQ ID NO: 1442 - protein, 72 aa, Homo sapiens
  variant (1)...(72): Xaa = Any amino acid
YXGAKXGGXGLLNGPPGQVKFQMRYGLLLPRLMVSRIPRVSPSIPGVHSVLPLRVRILGLIFLLPVAYLVEX

SEQ ID NO: 1443 - protein, 115 aa, Homo sapiens
  variant (1)...(115): Xaa = Any amino acid
PMWLVFXLXLARFHTLTSLSQPQETMIGLLLLGEKRTQDTHSEWLSSWTVYLHTPRVFHSLMVLSRDPETICRLSEEKATLSTSLVWPTNRLVVVPVVRSQRRRVPSQEPERANW

SEQ ID NO: 1444 - protein, 50 aa, Homo sapiens
LDGFISRSRDNLPVVRGEGHTQHILGMAHKSPRGGARCEIPEAQGSIPGA

SEQ ID NO: 1445 - protein, 114 aa, Homo sapiens
  variant (1)...(114): Xaa = Any amino acid
QFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLAXCKXKTNHI

SEQ ID NO: 1446 - protein, 74 aa, Homo sapiens
  variant (1)...(74): Xaa = Any amino acid
VWPSPLTTGRLSLDLEIKPSSYGIPWVCANTLSRMRATQSGCLVSASRPTAATLSSSPVAGTSWSRYGTWLXAX

SEQ ID NO: 1447 - protein, 60 aa, Homo sapiens
  variant (1)...(60): Xaa = Any amino acid
HKICSRDVHESSCCVGAXSTDFWNNWPVRKPIKAANSTMNAIESQRALLAFXMEDLRFVA

SEQ ID NO: 1448 - protein, 60 aa, Homo sapiens
  variant (1)...(60): Xaa = Any amino acid
ATNLKSSIXKANKALWLSIAFIVLFAALMGFLTGQLFQKSVDXAPTQQEDSWTSLEHILW

SEQ ID NO: 1449 - protein, 58 aa, Homo sapiens
SNIKAIRRHPCHHLTQGGRCWSWVQLGRRSRSRKQGDYGSQSVSKWAGLPGRDYSEGQ

SEQ ID NO: 1450 - protein, 146 aa, Homo sapiens
ANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSSTASLSRGPRTMMPW

SEQ ID NO: 1451 - protein, 62 aa, Homo sapiens
TVITLFSRSAPPAKLNPRPAPSSLCKMVTWMPSNCFNVASSRTFTSSMSFFNSSELSREITD

SEQ ID NO: 1452 - protein, 109 aa, Homo sapiens
  variant (1)...(109): Xaa = Any amino acid
SPARPLIRSDKMKETIMNQEKLAKLQAQVRIGGKGTARRKKKVVHRTATADDKKLQFSLKKLXVNNISGIEEVNMFTNQGTVIHFNNPKVQASLAANTFTITGHAETKQ

SEQ ID NO: 1453 - protein, 81 aa, Homo sapiens
GELKFFVICCGCSMNHLLLSASSSFPTNAHLCLQFGEFFLVHDCFFHLVGANKGPRGGLGLVLKGSRVDHLRLGAHTRGRK

SEQ ID NO: 1454 - protein, 59 aa, Homo sapiens
  variant (1)...(59): Xaa = Any amino acid
TYSPLQYQRYCLPXTSLRRTEVFCHLLWLFYEPPSSFCEQFLSHQCALVPAVWRVFPGS

SEQ ID NO: 1455 - protein, 153 aa, Homo sapiens
LRDSRDCVTSFVSFDLESLSRTMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGV

SEQ ID NO: 1456 - protein, 60 aa, Homo sapiens [sequence omitted]

SEQ ID NO: 1457 - protein, 98 aa, Homo sapiens
  variant (1)...(98): Xaa = Any amino acid
MRKIIIVDATLMSTEMTTLKDVNLDIAKETMKAGIRTIVASLLVEVEEVVIKANTGFTTVLHIVVHMGYEPFLPARAGAXGEFQHTXRRSRGSELGPX

SEQ ID NO: 1458 - protein, 73 aa, Homo sapiens [sequence omitted]

SEQ ID NO: 1459 - protein, 62 aa, Homo sapiens [sequence omitted]

SEQ ID NO: 1460 - protein, 89 aa, Homo sapiens
STVVNPVFAFITTSSTSTRRLATMVLIPAFMVSLAMSRFTSLSVVISVLINVASTMIIFLIYRPAFQIMAITHFRVIVFAALVLLGTAM

SEQ ID NO: 1461 - protein, 74 aa, Homo sapiens [sequence omitted]

SEQ ID NO: 1462 - protein, 66 aa, Homo sapiens; identical to SEQ ID NO: 822

SEQ ID NO: 1463 - protein, 75 aa, Homo sapiens; identical to SEQ ID NO: 823

SEQ ID NO: 1464 - protein, 59 aa, Homo sapiens; identical to SEQ ID NO: 824

SEQ ID NO: 1465 - protein, 59 aa, Homo sapiens; identical to SEQ ID NO: 825
  variant (1)...(59): Xaa = Any amino acid

SEQ ID NO: 1466 - protein, 63 aa, Homo sapiens; identical to SEQ ID NO: 826
  variant (1)...(63): Xaa = Any amino acid

SEQ ID NO: 1467 - protein, 65 aa, Homo sapiens
KSGVGIPFHMHIDYFLSFFKTCFSGFLNVPDDSLSCRTVNVNLSRGLWLDVNLIKLLCPRNSAPP

SEQ ID NO: 1468 - protein, 107 aa, Homo sapiens
KMEHSDENIQFWMACETYKKIASRWSRISRAKKLYKIYIQPQSPREINIDSSTRETIIRNIQEPTETCFEEAQKIVYMHMERDSYPRFLKSEMYQKLLKTMQSNNSF

SEQ ID NO: 1469 - protein, 74 aa, Homo sapiens
KWSTVTRIFNSGWHVKPIRKLPHGGAEFLGQRSFIRFTSSHSPLERLTLTVRQERLSSGTFRNPLKHVLKKLRK

SEQ ID NO: 1470 - protein, 63 aa, Homo sapiens
LLPLYPEILEMQEWWLGWKIMIDSVEGQAVGVFWGQSRVNTVPHYLDLLAPIPGQMLKKKNVN

SEQ ID NO: 1471 - protein, 181 aa, Homo sapiens
SRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVS

SEQ ID NO: 1472 - protein, 109 aa, Homo sapiens
VLINRGNEGRCSLCFDPKIRQLLDLLLNRSLFSIPATIPAFPIFLGKEAIVTLRREDGLEFREAERFLIWQSSSSSRGLKDLSFCRRTCFSSSNSACSLAYILFKFSTC

SEQ ID NO: 1473 - protein, 100 aa, Homo sapiens [sequence omitted]

SEQ ID NO: 1474 - protein, 103 aa, Homo sapiens [sequence omitted]

SEQ ID NO: 1475 - protein, 58 aa, Homo sapiens [sequence omitted]

SEQ ID NO: 1476 - protein, 109 aa, Homo sapiens
HTAPALDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDG

SEQ ID NO: 1477 - protein, 94 aa, Homo sapiens; identical to SEQ ID NO: 844
  variant (1)...(94): Xaa = Any amino acid

SEQ ID NO: 1478 - protein, 57 aa, Homo sapiens; identical to SEQ ID NO: 845

SEQ ID NO: 1479 - protein, 93 aa, Homo sapiens; identical to SEQ ID NO: 846
  variant (1)...(93): Xaa = Any amino acid

SEQ ID NO: 1480 - protein, 121 aa, Homo sapiens; identical to SEQ ID NO: 847
  variant (1)...(121): Xaa = Any amino acid

SEQ ID NO: 1481 - protein, 54 aa, Homo sapiens; identical to SEQ ID NO: 848
  variant (1)...(54): Xaa = Any amino acid

SEQ ID NO: 1482 - protein, 59 aa, Homo sapiens; identical to SEQ ID NO: 849

SEQ ID NO: 1483 - protein, 67 aa, Homo sapiens; identical to SEQ ID NO: 850
  variant (1)...(67): Xaa = Any amino acid

SEQ ID NO: 1484 - protein, 55 aa, Homo sapiens; identical to SEQ ID NO: 851
  variant (1)...(55): Xaa = Any amino acid

SEQ ID NO: 1485 - protein, 80 aa, Homo sapiens
  variant (1)...(80): Xaa = Any amino acid
QTIYNISSLKSSFKDHRQTSSPLYFSWGDKGKKRKCKLSYSHSENLWFHAILSQLKVTNLRSSDLKLKNQXPYIRMSCCH

SEQ ID NO: 1486 - protein, 76 aa, Homo sapiens
  variant (1)...(76): Xaa = Any amino acid
VLPGTLIPLCQVMHSQILGTRVWTSLGGIILPAIIELXGRLNNIIYMTYVXARLAPGKYSGCTNHCSYTXQXLKES

SEQ ID NO: 1487 - protein, 67 aa, Homo sapiens
  variant (1)...(67): Xaa = Any amino acid
EQWLVHPEYFPGAKRXSTYVMYIMLFNLXNNSIMAGRIMPPKDVHTLVPRICECITWQRGIKVPGRT

SEQ ID NO: 1488 - protein, 67 aa, Homo sapiens
KISNLKMGHNYTFTVQARCLFGNQICGEPAILLYDELGSGADASATQAARSTDVAAVVVPILFLILL

SEQ ID NO: 1489 - protein, 58 aa, Homo sapiens
RWVIITRSPSKQDAFLATRSVGSLPSCCTMSWGLVQMHLQRRLPDLRMLLLWWCPSYS

SEQ ID NO: 1490 - protein, 61 aa, Homo sapiens
DGHHHSSNIRRSGSLRCRCICTRPQLIVQQDGRLPTDLVAKKASCLDGERVIMTHLQVGNF

SEQ ID NO: 1491 - protein, 56 aa, Homo sapiens
SSIRNKMGTTTAATSVDLAACVADASAPDPSSSYSRMAGSPQIWLPKRHLAWTVNV

SEQ ID NO: 1492 - protein, 67 aa, Homo sapiens; identical to SEQ ID NO: 871
  variant (1)...(67): Xaa = Any amino acid

SEQ ID NO: 1493 - protein, 66 aa, Homo sapiens; identical to SEQ ID NO: 872
  variant (1)...(66): Xaa = Any amino acid

SEQ ID NO: 1494 - protein, 60 aa, Homo sapiens
  variant (1)...(60): Xaa = Any amino acid
TSSPAAPTSACASRPPGPSWTWGRAPRTESSQPRGSSSCSARWCLGRCCCXGNDGKNXNX

SEQ ID NO: 1495 - protein, 60 aa, Homo sapiens
  variant (1)...(60): Xaa = Any amino acid
PAVLRHLPPRAPAAPQALPGHGGGHQEPNHHSRGDHPPVLRGGAWDAAAVXETMARTXTX

SEQ ID NO: 1496 - protein, 60 aa, Homo sapiens
  variant (1)...(60): Xaa = Any amino acid
QQSCGTYLRVRQPPPRPFLDMGEGTKNRIITAEGIILLFCAVVPGTLLLXRKRWQERXLX

SEQ ID NO: 1497 - protein, 60 aa, Homo sapiens
  variant (1)...(60): Xaa = Any amino acid
XEXSFLPSFPXQQQRPRHHRAEQEDDPLGCDDSVLGALPHVQEGPGGRLAHAEVGAAGLL

SEQ ID NO: 1498 - protein, 53 aa, Homo sapiens
  variant (1)...(53): Xaa = Any amino acid
XSXRSCHRFXNSSSVPGTTAQNRRMIPSAVMIRFLVPSPMSRKGLGGGWRTRR

SEQ ID NO: 1499 - protein, 51 aa, Homo sapiens
PAYNGDVVFLFTFVYYACVFSTTLGSGRNGQTEDELYPGPAGPACSPLCSP

SEQ ID NO: 1500 - protein, 79 aa, Homo sapiens
QPTMGMLCFCSPSFTMPVSSPPRWGLGGMDRQRMSSTQGLQDLPVAHSARLSTTTPAKEDSIWQSFFQVPSYTCASAFS

SEQ ID NO: 1501 - protein, 71 aa, Homo sapiens
LGTWKKLCQMESSLAGVVVLRRAEWATGRSCRPWVELILCLSIPPRPQRGGEDTGIVNEGEQKHNIPIVGW

SEQ ID NO: 1502 - protein, 67 aa, Homo sapiens
KSRGTGIAGHLEEALPNGILLGRSGSAKASRVGYRQVLQALGRAHPLSVHSSQTPAWWRRHRHSKRR

SEQ ID NO: 1503 - protein, 71 aa, Homo sapiens [sequence omitted]

SEQ ID NO: 1504 - protein, 73 aa, Homo sapiens; identical to SEQ ID NO: 882

SEQ ID NO: 1505 - protein, 74 aa, Homo sapiens
AAREPVWAGSVCRRVYGQAAFAGVFTGRQRLQACLHAGVAPCETTGPGFQRSCSGESAVFSQVHGAEWVCNMKY

SEQ ID NO: 1506 - protein, 66 aa, Homo sapiens
LDDGLQPLSVPSVPHSTSISCCTPTQLRELVRTQPIHLSRTSETLDQWSHMVLRLHVNTPANAACR

SEQ ID NO: 1507 - protein, 98 aa, Homo sapiens
IAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHIS

SEQ ID NO: 1508 - protein, 62 aa, Homo sapiens
GSAGPPGPCHPTCQKAPGAAGAGWWGSRPHAARCCPWVGAGRCPALGQTPLWEAHLHPEPPA

SEQ ID NO: 1509 - protein, 97 aa, Homo sapiens
DVVSGTLPFDLDEDLQVLQVLAIPLVKRLQELQALAGGAHVHMLPAAVLGWVLVGVLPWVKLPFGKLICIRSLQPELLAIRARQVVGLWVELEGSRN

SEQ ID NO: 1510 - protein, 54 aa, Homo sapiens
EMWSVVHFPLTLMRICRSSRSLPSHLSKGSRSCRRWLVGLTSTCCPLLSLGGCW

SEQ ID NO: 1511 - protein, 137 aa, Homo sapiens
  variant (1)...(137): Xaa = Any amino acid
PCLXSXVTRKRPCLPSMTLMEEMLREAFRCMTQEPMKGPIAMQSGPKPLFRRMSSLVGPTQSFFMRESKTLGAVQIMNGLFHIALGGLLMIPARDLCTHLCDCVVPSLGEALCILFSGSLLAXTEKKLXEVVWSKEK

SEQ ID NO: 1512 - protein, 67 aa, Homo sapiens
  variant (1)...(67): Xaa = Any amino acid
LPXIXGHSEEAMSTLNDTHGGNAERSIQMHDTRANERPYCYAIWSKTTLQEDVFTGGPHAKLLHEGI

SEQ ID NO: 1513 - protein, 137 aa, Homo sapiens
  variant (1)...(137): Xaa = Any amino acid
HFSFDQTTXWSFFSVXARSDPENNIHNASPREGTTQSHRWVHRSLAGIIRRPPRAMWKSPFIIWTAPKVLDSLMKKLCVGPTSEDILLKSGFGPDCIAIGPFIGSCVMHLNASLSISSMSVIEGRHGLFRVTXDXRQ

SEQ ID NO: 1514 - protein, 61 aa, Homo sapiens
  variant (1)...(61): Xaa = Any amino acid
IFPLTKQLXGVFSPXLPGVIRKIIYIMPPPERVPHSHTDGCIDPLLGSSEDPPGQCGRAHS

SEQ ID NO: 1515 - protein, 87 aa, Homo sapiens
LGGPGKGLGHEPGSSEAVTEAREPAPRSWGDLALTPGLGAHLQTTSLPLSAASLCPHRWLSGQCPGPRRCDLPPCQPCCHPCPAAGR

SEQ ID NO: 1516 - protein, 113 aa, Homo sapiens [sequence omitted]

SEQ ID NO: 1517 - protein, 79 aa, Homo sapiens
LKQRNTLKDGIIMIQTLLIILFIIVPIFLLLDKDDSKAGMEEDHTYEGLDIDQTATYEDIVTLRTGEVKWSVGEHPGQE

SEQ ID NO: 1518 - protein, 51 aa, Homo sapiens; identical to SEQ ID NO: 1499

SEQ ID NO: 1519 - protein, 79 aa, Homo sapiens
QPTMGMLCFCSPSFTMPVSSPPRWGLGGMDRQRMSSTQGLQDLPVAHSARLSTTTPAKEDSIWQSFFQVPSYTCASAFL

SEQ ID NO: 1520 - protein, 71 aa, Homo sapiens; identical to SEQ ID NO: 1501

SEQ ID NO: 1521 - protein, 68 aa, Homo sapiens
EKSRGTGIAGHLEEALPNGILLGRSGSAKASRVGYRQVLQALGRAHPLSVHSSQTPAWWRRHRHSKRR

SEQ ID NO: 1522 - protein, 117 aa, Homo sapiens
KKQRRRSHKAIEMEHPLGELRQGAPETDFQDSFFEVLCGVKYSSAKRVTGKGPVKQQFLISSLSSLRIIYPKILCIYKMYTSLQFTKHSLLPNTYPCCMANEMSNPTGYMAVELHSK

SEQ ID NO: 1523 - protein, 68 aa, Homo sapiens
MQSILGYIILREDKDDIKNCCFTGPLPVTLFAEEYLTPHSTSKKLSWKSVSGAPCLNSPSGCSISIAL

SEQ ID NO: 1524 - protein, 88 aa, Homo sapiens; identical to SEQ ID NO: 995

SEQ ID NO: 1525 - protein, 55 aa, Homo sapiens; identical to SEQ ID NO: 791

SEQ ID NO: 1526 - protein, 52 aa, Homo sapiens
GQPGVLLLVQIHELLPGPQAVRVVGDCLPECRALGHGVLGPPKKQEPEPLKA

SEQ ID NO: 1527 - protein, 75 aa, Homo sapiens
LPRTTSSRRKSTRNCNLSFISMVKGSQACCFSSKYTNFSQAHRRSGWSVTASPSVGHSAMASSGRLRSKSQSLSR

SEQ ID NO: 1528 - protein, 76 aa, Homo sapiens
GLERLWLLLLRRPEDAMAECPTLGEAVTDHPDRLWAWEKFVYLDEKQHAWLPLTIEIKDRLQLRVLLRREDVVLGR

SEQ ID NO: 1529 - protein, 52 aa, Homo sapiens
ALRGSGSCFLGGPRTPWPSARHSGRQSPTTRTACGPGRSSCIWTRSSTPGCP

SEQ ID NO: 1530 - protein, 96 aa, Homo sapiens [sequence omitted]

SEQ ID NO: 1531 - protein, 54 aa, Homo sapiens [sequence omitted]

SEQ ID NO: 1532 - protein, 59 aa, Homo sapiens
VSFGGILPGGSHHLLLRTYPFTYLLSCWTSAFQGPEKMGTPMQAQDYHPEDRSCPCCFL

SEQ ID NO: 1533 - protein, 55 aa, Homo sapiens [sequence omitted]

SEQ ID NO: 1534 - protein, 66 aa, Homo sapiens
QGLMSEPQPDLEPPQHGLYMLFLLVLVFFLMGLAGFMICHVLKKKGYRCRTSRGSEPDDAQLQPRE

SEQ ID NO: 1535 - protein, 54 aa, Homo sapiens
  variant (1)...(54): Xaa = Any amino acid
TVICWFSLKNDLWCEAQISGNIRKTWSGGGSSGACITXPAPQLFPASSASCRTY

SEQ ID NO: 1536 - protein, 55 aa, Homo sapiens
  variant (1)...(55): Xaa = Any amino acid
LYVRQLAEEAGKSCGAXSVMQAPEEPPPDQVFRMFPDICASHQRSFFRENQQITV

SEQ ID NO: 1537 - protein, 61 aa, Homo sapiens
CRPPRSRRQTRSSGCFQIFVPHTRDHFSEKTNRSPSKCVAWAPHPVCVLHPSPCYSGPHHD

SEQ ID NO: 1538 - protein, 96 aa, Homo sapiens
  variant (1)...(96): Xaa = Any amino acid
VCPATGRRGWEELWSRXCDAGPRGAAARPGLPDVSRYLCLTPEIIFQRKPTDHRLSASLGRPTPSASCIHLPVTVARIMIKECGSLCLGWDALLCT

SEQ ID NO: 1539 - protein, 115 aa, Homo sapiens [sequence omitted]

SEQ ID NO: 1540 - protein, 50 aa, Homo sapiens; identical to SEQ ID NO: 1444

SEQ ID NO: 1541 - protein, 114 aa, Homo sapiens
QFALSGSWDGTLRLWDLTTGTTTRRFVGHTKDVLSVAFSSDNRQIVSGSRDKTIKLWNTLGVCKYTVQDESHSEWVSCVRFSPNSSNPIIVSRGWDKLVKVWNLANCKLKTNHI

SEQ ID NO: 1542 - protein, 74 aa, Homo sapiens
VWPSPLTTGRLSLDLEIKPSSYGIPWVCANTLSRMRATQSGCLVSASRPTAATLSSSPVAGTSWSRYGTWLTAS

SEQ ID NO: 1543 - protein, 55 aa, Homo sapiens
LYVRQLAEEAGKSCGAGSVMQAPEEPPPDQVFRMFPDTCASHQRSFFRENQQITV

SEQ ID NO: 1544 - protein, 61 aa, Homo sapiens [sequence omitted]

SEQ ID NO: 1545 - protein, 96 aa, Homo sapiens
VCPATGRRGWEELWSRLCDAGPRGAAARPGLPDVSRYLCLTPEIIFQRKPTDHRLSASLGRPTPSASCIHLPVTVARIMIKECGSLCLGWDALLCT

SEQ ID NO: 1546 - protein, 54 aa, Homo sapiens [sequence omitted]

SEQ ID NO: 1547 - protein, 52 aa, Homo sapiens
SPAESLTLSSCALSFTVPPTQDPNFFYSILFPLVNRRAQYDLFSKEPAGIWF

SEQ ID NO: 1548 - protein, 62 aa, Homo sapiens
KKLGSWVGGTVKLRAHELKVSDSAGLHRESCAHHSVQVLSLPRQHRTPAPLLTWIIEFPPKI

SEQ ID NO: 1549 - protein, 62 aa, Homo sapiens
SEVGAALKKLPRRTNRHRSDRDFVIRTRFLPAPLKTGHIVLFCLQEETRWNKRNWDLGLEGQ

SEQ ID NO: 1550 - protein, 62 aa, Homo sapiens
SLEHMNSRLVTLQDFTERAVPIIQSKCFLCPDSTELQPRYLHGSSSFHLKYDSIYFESLLPN

SEQ ID NO: 1551 - protein, 64 aa, Homo sapiens; identical to SEQ ID NO: 1057
  variant (1)...(64): Xaa = Any amino acid

SEQ ID NO: 1552 - protein, 53 aa, Homo sapiens; identical to SEQ ID NO: 1058
  variant (1)...(53): Xaa = Any amino acid

SEQ ID NO: 1553 - protein, 51 aa, Homo sapiens; identical to SEQ ID NO: 1059
  variant (1)...(51): Xaa = Any amino acid

SEQ ID NO: 1554 - protein, 64 aa, Homo sapiens; identical to SEQ ID NO: 1060
  variant (1)...(64): Xaa = Any amino acid

SEQ ID NO: 1555 - protein, 94 aa, Homo sapiens [sequence omitted]

SEQ ID NO: 1556 - protein, 61 aa, Homo sapiens [sequence omitted]

SEQ ID NO: 1557 - protein, 58 aa, Homo sapiens; identical to SEQ ID NO: 1083
  variant (1)...(58): Xaa = Any amino acid

SEQ ID NO: 1558 - protein, 139 aa, Homo sapiens; identical to SEQ ID NO: 1084
  variant (1)...(139): Xaa = Any amino acid

SEQ ID NO: 1559 - protein, 66 aa, Homo sapiens; identical to SEQ ID NO: 1085
  variant (1)...(66): Xaa = Any amino acid

SEQ ID NO: 1560 - protein, 51 aa, Homo sapiens; identical to SEQ ID NO: 1086
  variant (1)...(51): Xaa = Any amino acid

SEQ ID NO: 1561 - protein, 52 aa, Homo sapiens; identical to SEQ ID NO: 1087
  variant (1)...(52): Xaa = Any amino acid

SEQ ID NO: 1562 - protein, 125 aa, Homo sapiens; identical to SEQ ID NO: 1088
  variant (1)...(125): Xaa = Any amino acid

SEQ ID NO: 1563 - protein, 89 aa, Homo sapiens; identical to SEQ ID NO: 1089
  variant (1)...(89): Xaa = Any amino acid

SEQ ID NO: 1564 - protein, 62 aa, Homo sapiens; identical to SEQ ID NO: 1090
  variant (1)...(62): Xaa = Any amino acid

SEQ ID NO: 1565 - protein, 64 aa, Homo sapiens; identical to SEQ ID NO: 1091
  variant (1)...(64): Xaa = Any amino acid

SEQ ID NO: 1566 - protein, 131 aa, Homo sapiens
  variant (1)...(131): Xaa = Any amino acid
LEKXKXXLKNVDENIRXLXGRDPNDXRPIQARLLALSGPXGXRGRGSXLLRRGFXXSXGGPXAXQRDLEGAVXXLGGERXTRRESRQESDPXDDDVKKPXLQXSVVATXKERTRXDXIQXQNMDEKGKQRN

SEQ ID NO: 1567 - protein, 55 aa, Homo sapiens
  variant (1)...(55): Xaa = Any amino acid
GVDSXIVXEDXQXNRETLKGQSXXWAGSXGPEENHARKATRXMMMLKSXHCXLQL

SEQ ID NO: 1568 - protein, 119 aa, Homo sapiens
  variant (1)...(119): Xaa = Any amino acid
XWIXSXRVRSLXVATTEXCNXGFLTSSXSGSLSWRDSLLVXRSPPSXXTAPSRSLCXAXGPPXLXXNPRLSNXLPRPXPXPGPERASNLAWMGLXSFGSRXVSXRMFSSTFLXLXXAFS

SEQ ID NO: 1569 - protein, 53 aa, Homo sapiens
  variant (1)...(53): Xaa = Any amino acid
LPLQGLSVXLXVLXHYXRIHASVIXYHVLXLXQDQKGPAIWLGWASXHSDPAX

SEQ ID NO: 1570 - protein, 73 aa, Homo sapiens [sequence omitted]

SEQ ID NO: 1571 - protein, 56 aa, Homo sapiens [sequence omitted]

SEQ ID NO: 1572 - protein, 194 aa, Homo sapiens; identical to SEQ ID NO: 1106

SEQ ID NO: 1573 - protein, 52 aa, Homo sapiens; identical to SEQ ID NO: 1107

SEQ ID NO: 1574 - protein, 55 aa, Homo sapiens; identical to SEQ ID NO: 1014

SEQ ID NO: 1575 - protein, 66 aa, Homo sapiens; identical to SEQ ID NO: 1109

SEQ ID NO: 1576 - protein, 59 aa, Homo sapiens; identical to SEQ ID NO: 1110

SEQ ID NO: 1577 - protein, 60 aa, Homo sapiens; identical to SEQ ID NO: 1111

SEQ ID NO: 1578 - protein, 85 aa, Homo sapiens
KVSNIKVRILIQLILILTTEKTNSREQQKNKKDLLFSQPKFSSLKVSTRRGVYSSNTFHFSVNIHKLKKKTSWSHLAHTFMQCSL

SEQ ID NO: 1579 - protein, 52 aa, Homo sapiens
TPLLVDTFREENLGWEKRRSFLFFCCSLLFVFSVVNININCINILTLILETF

SEQ ID NO: 1580 - protein, 54 aa, Homo sapiens [sequence omitted]

SEQ ID NO: 1581 - protein, 87 aa, Homo sapiens
QIQCVTLVLCSRQGFLNERHRLPAYGKVSSKGIEVRDRVELWVFIVFHAKPTKSKIEFKLNKLLLQNGRGKRLRKVYENELTYLVKS

SEQ ID NO: 1582 - protein, 85 aa, Homo sapiens; identical to SEQ ID NO: 1132
  variant (1)...(85): Xaa = Any amino acid

SEQ ID NO: 1583 - protein, 56 aa, Homo sapiens; identical to SEQ ID NO: 1133

SEQ ID NO: 1584 - protein, 70 aa, Homo sapiens; identical to SEQ ID NO: 1134
  variant (1)...(70): Xaa = Any amino acid

SEQ ID NO: 1585 - protein, 82 aa, Homo sapiens; identical to SEQ ID NO: 1135
  variant (1)...(82): Xaa = Any amino acid

SEQ ID NO: 1586 - protein, 56 aa, Homo sapiens; identical to SEQ ID NO: 1136

SEQ ID NO: 1587 - protein, 52 aa, Homo sapiens
SYRPAAGRWSPRTACPCPHSPPERGSCSREGNRHTQIVAEGRSTGRVCHRRS

SEQ ID NO: 1588 - protein, 99 aa, Homo sapiens
SVAAEDLFVHYGRDGQAVEAVSEGFPQFDVVASLALIVETIDAVDAGTLVVPTEQEEVLGVLDLIGQQQADGLQGLLAPVHIVPQKEVVALGRETAILK

SEQ ID NO: 1589 - protein, 145 aa, Homo sapiens
  variant (1)...(145): Xaa = Any amino acid
LTENEIRGLCLKSREIFLSQPILXELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHG

SEQ ID NO: 1590 - protein, 116 aa, Homo sapiens
  variant (1)...(116): Xaa = Any amino acid
ASPFXWSWRHPSRSAVTYTASTTTFCDYLSMAVSLPRATTSFWGTMWTGASSPWRPSACCWPIRSSTPRTSSCSVGTTSVPASTASMVSTMSARDATTSNCGKPSLTASTACPSRP

SEQ ID NO: 1591 - protein, 62 aa, Homo sapiens; identical to SEQ ID NO: 1220

SEQ ID NO: 1592 - protein, 86 aa, Homo sapiens; identical to SEQ ID NO: 1221

SEQ ID NO: 1593 - protein, 97 aa, Homo sapiens
TKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRP

SEQ ID NO: 1594 - protein, 57 aa, Homo sapiens; identical to SEQ ID NO: 1149

SEQ ID NO: 1595 - protein, 78 aa, Homo sapiens; identical to SEQ ID NO: 1150

SEQ ID NO: 1596 - protein, 130 aa, Homo sapiens
  variant (1)...(130): Xaa = Any amino acid
YKLFFFFFFFFFSTKVYXXETITSCCPXWHTXSPRRVFNSXPXIIFIPKXXPXTIXWLQHXPXNEVPQXAKFYIGXTGKFKXXDGXTIGSXIMSGGXKXWXGMVPSLSXNLLLTWXGSCRILPLGNXXSX

SEQ ID NO: 1597 - protein, 73 aa, Homo sapiens
  variant (1)...(73): Xaa = Any amino acid
TSFFFFFFFFFFPPKFIXXKQSPVAVXXGTLXAPGGSLTXFLXLYSSQKXXXGQXFGYSIXPXMRSPKXLSFT

SEQ ID NO: 1598 - protein, 57 aa, Homo sapiens
  variant (1)...(57): Xaa = Any amino acid
PXYCXRXXFWDEYNXRXGVKDPPGAXSVPXRTATGDCFXXINFGGKKKKKKKKKKLV

SEQ ID NO: 1599 - protein, 69 aa, Homo sapiens
  variant (1)...(69): Xaa = Any amino acid
LVXLXXLXPIIXXXGXFPRGRILQLXLQVRRRFXLNDGTMPXQXFXPPDIXLDPMVXPSXXLNFPXSPM

SEQ ID NO: 1600 - protein, 65 aa, Homo sapiens
MLQYLNMLCQTIPLCNRLHIVFMILIKLYVETECEVKSEHKKIMHDEIAYHFIGYLLCIYTLRPL

SEQ ID NO: 1601 - protein, 64 aa, Homo sapiens
LTHLFLLKRYCPLGGEWESLLHCCSHSERTFPCTYLSTCFNLINATFCIFQTSINSAIKRCSFF

SEQ ID NO: 1602 - protein, 174 aa, Homo sapiens; identical to SEQ ID NO: 1158

SEQ ID NO: 1603 - protein, 56 aa, Homo sapiens; identical to SEQ ID NO: 794

SEQ ID NO: 1604 - protein, 52 aa, Homo sapiens; identical to SEQ ID NO: 1160

SEQ ID NO: 1605 - protein, 54 aa, Homo sapiens; identical to SEQ ID NO: 1161

SEQ ID NO: 1606 - protein, 70 aa, Homo sapiens; identical to SEQ ID NO: 1162

SEQ ID NO: 1607 - protein, 50 aa, Homo sapiens; identical to SEQ ID NO: 1163

SEQ ID NO: 1608 - protein, 143 aa, Homo sapiens; identical to SEQ ID NO: 1164

SEQ ID NO: 1609 - protein, 79 aa, Homo sapiens
  variant (1)...(79): Xaa = Any amino acid
LKQRNTLKDGIIMIXTLLIIXXXIVPIFLLLDKDDSKAGMEEDHTYEGLDIDQTATYEDIVTLRTGEVKWSVGEHPGQE

SEQ ID NO: 1610 - protein, 87 aa, Homo sapiens; identical to SEQ ID NO: 1515

SEQ ID NO: 1611 - protein, 113 aa, Homo sapiens
  variant (1)...(113): Xaa = Any amino acid
WGVRERGWAMSQAAPKQSLRPGSLHPGHGATWLSLLAWVLTYRPLHFPCPQRHYVLIGGCLVNVQALVGVIFLHASLAVILVQQQEDRHDXXXDDQQRXDHDDTILQRVPLLQ

SEQ ID NO: 1612 - protein, 115 aa, Homo sapiens; identical to SEQ ID NO: 1143

SEQ ID NO: 1613 - protein, 55 aa, Homo sapiens; identical to SEQ ID NO: 1144

SEQ ID NO: 1614 - protein, 51 aa, Homo sapiens; identical to SEQ ID NO: 1145

SEQ ID NO: 1615 - protein, 136 aa, Homo sapiens
YLKVIVALGMPGQEDEGALWTQQSAEFRSGKPMVAGTPCFLPLLSACVTHINGNNFFQLLAEVGEAGSLHREGLSSLLLPASFCFGCREWFIHTLIPSPPLVDGGLAFSIPVFWCLPLSATLNHLPWSCCVMGTCL

SEQ ID NO: 1616 - protein, 79 aa, Homo sapiens
TRPTKARSMSPQVSSQSRLTLSSGRVYIAVFNTSRSLWLWGCRGRRTRVRCGHSSPRNSVLGSQWSPAPLASSLCCLPV

SEQ ID NO: 1617 - protein, 73 aa, Homo sapiens
HTSMAITSSNSSQKWERPAACTERGFPLSCSPLRSVLAAESGSSILSFPRLPLWTGVLPFQFLCFGVFPYLLP

SEQ ID NO: 1618 - protein, 57 aa, Homo sapiens
LYLIPQGHCGSGDAGAGGRGCAVDTAVRGIPFWEANGRRHPLLPPSVVCLCDTHQWQ

SEQ ID NO: 1619 - protein, 89 aa, Homo sapiens
LLPTPRRSGRGRQPAPRGAFLSLAPRFVLFWLQRVVHPYSHSLASPCGRGSCLFNSCVLVSSLICYPESPALVLLCDGNMLVNCVTNLL

SEQ ID NO: 1620 - protein, 124 aa, Homo sapiens
KGKTPVHKGRRGNESMDEPLSAAKTERSGEQERGKPLSVQAAGLSHFCEELEEVIAIDVCHTGRQQREEARGAGDHWLPRTEFRGLLCPQRTLVLLPRHPQSHNDLEVLNTAIYTRPELRVNLD

SEQ ID NO: 1621 - protein, 123 aa, Homo sapiens
FRVADKGRHQNTGIEKARPPSTRGGEGMRVWMNHSLQPKQNEAGSKREESPSRCRLPASPTSARSWKKLLPLMCVTQADNRGRKQGVPATIGFPERNSADCCVHSAPSSSCPGIPRATMTLRY

SEQ ID NO: 1622 - protein, 117 aa, Homo sapiens; identical to SEQ ID NO: 1170

SEQ ID NO: 1623 - protein, 117 aa, Homo sapiens; identical to SEQ ID NO: 1171

SEQ ID NO: 1624 - protein, 83 aa, Homo sapiens; identical to SEQ ID NO: 1172

SEQ ID NO: 1625 - protein, 67 aa, Homo sapiens
  variant (1)...(67): Xaa = Any amino acid
LKQRNTLKDGIIMIXTLLIILFIIVPIFLLLDKDDSKAGMEEDHXYEGLDIDQTATYEDIVTLRTGE

SEQ ID NO: 1626 - protein, 52 aa, Homo sapiens
  variant (1)...(52): Xaa = Any amino acid
ITNWVTLNELIKFQAIVHATNSQRPRKLLAEKVVYVGXWIPALLLTIXDFIF

SEQ ID NO: 1627 - protein, 102 aa, Homo sapiens
  variant (1)...(102): Xaa = Any amino acid
LQVLQDAFCXXXYYIHLIINFLLRLCRLGIFXXKEKIWPLLKVCACQNFKKIPHVKVPSASAGDSVLVLLSLDWRSLFPSSLVPVLQLLFLANRCANELPTG

SEQ ID NO: 1628 - protein, 86 aa, Homo sapiens
  variant (1)...(86): Xaa = Any amino acid
ISFSDSVGWAFSXSRKKFGPCSRSVHVKTLRRFPMLRYLQPVLVILSLSFYPWIGVPSFLVHLFQSFNFCFLLTGVQMNYQLGNLE

SEQ ID NO: 1629 - protein, 62 aa, Homo sapiens
  variant (1)...(62): Xaa = Any amino acid
RYLNMGNLLKVLTCTDLEQGPNFFLXXENAQPTESEKEIYNQVNVVXXXAEGILEDLQSYXG

SEQ ID NO: 1630 - protein, 99 aa, Homo sapiens; identical to SEQ ID NO: 1180

SEQ ID NO: 1631 - protein, 57 aa, Homo sapiens; identical to SEQ ID NO: 1181

SEQ ID NO: 1632 - protein, 87 aa, Homo sapiens; identical to SEQ ID NO: 1182

SEQ ID NO: 1633 - protein, 53 aa, Homo sapiens; identical to SEQ ID NO: 1183

SEQ ID NO: 1634 - protein, 59 aa, Homo sapiens; identical to SEQ ID NO: 1184

SEQ ID NO: 1635 - protein, 98 aa, Homo sapiens; identical to SEQ ID NO: 1188
  variant (1)...(98): Xaa = Any amino acid

SEQ ID NO: 1636 - protein, 66 aa, Homo sapiens
KDGIIMIQTLLIILFIIVPIFLLLDKDDSKAGMEEDHTYEGLDIDQTATYEDIVTLRTGEVKWFCR

SEQ ID NO: 1637 - protein, 84 aa, Homo sapiens
  variant (1)...(84): Xaa = Any amino acid
PAPRSWGDLALTPGLGXSPTEPLHFPCPQRHYVLIGGCLVNVQALVGVIFLHASLAVILVQQQEDRHDDEEDDQQRLDHDDTIL

SEQ ID NO: 1638 - protein, 64 aa, Homo sapiens
  variant (1)...(64): Xaa = Any amino acid
CTQVMGRPGSHSWPGCXTYRTTSLPLSAASLCPHRWLSGQCPGPRRCDLPPCQPCCHPCPAAGR

SEQ ID NO: 1639 - protein, 59 aa, Homo sapiens; identical to SEQ ID NO: 1069

SEQ ID NO: 1640 - protein, 51 aa, Homo sapiens
EQNDNTQKFSKWDFPGRANERPYCYAIWSKTTLQEDVFTGGPRAKLLHEGI

SEQ ID NO: 1641 - protein, 82 aa, Homo sapiens
  variant (1)...(82): Xaa = Any amino acid
DFGGCPDYEWALPHCPGGSSDDSSRDLCTHLCDCVVPSLGRHYVYYFRITPGSNGEKLQEVLGQRKNDNEFIXPXCCHFWND

SEQ ID NO: 1642 - protein, 155 aa, Homo sapiens
  variant (1)...(155): Xaa = Any amino acid
DCQKSCSCSPHFVICFIFRSFESKMTTPRNSVNGTFPAEPMKGPIAMQSGPKPLFRRMSSLVGPAQSFFMRESKTLGAVQIMNGLFHIALGGLLMIPAGIYAPICVTVWYPLWGGIMYIISGSLLAATEKNSRKCWVKGKMIMNSLXXFAAISGM

SEQ ID NO: 1643 - protein, 55 aa, Homo sapiens
  variant (1)...(55): Xaa = Any amino acid
IIPEMAAXRXNEFIIIFPLTQHFLEFFSVAARSDPEIIYIMPPQRGYHTVTQMGA

SEQ ID NO: 1644 - protein, 89 aa, Homo sapiens
IPAGIIRRPPRAMWKSPFIIWTAPKVLDSLMKKLCAGPTSEDILLKSGFGPDCIAIGPFIGSAGKVPFTEFLGVVILLSKLLKIKQITK

SEQ ID NO: 1645 - protein, 62 aa, Homo sapiens
SGNNIHNASPERVPHSHTDGCIDPCWNHQKTPQGNVEEPIHNLDSPQSLRFPHEEALRGAHQ

SEQ ID NO: 1646 - protein, 64 aa, Homo sapiens; identical to SEQ ID NO: 1072

SEQ ID NO: 1647 - protein, 58 aa, Homo sapiens
CPSAITIQQLQAGLADREYGRRTRSDENMHATIFTTEHTVFCDRNCRPCWGTRYSRPH

SEQ ID NO: 1648 - protein, 71 aa, Homo sapiens
KSRPTCSHWTDVQVQSPYSSYRQGWLIGSMGEGHAQMKTCMQRFSPLNTLFSVIETVGPAGGQDIHGLTSQ

SEQ ID NO: 1649 - protein, 73 aa, Homo sapiens
GREYLVPQQGRQFLSQKTVCSVVKIVACMFSSERVLLPYSLSASPACSCCMVIALGHQSNDCKSAWIFTCRGY

SEQ ID NO: 1650 - protein, 88 aa, Homo sapiens [sequence omitted]

SEQ ID NO: 1651 - protein, 69 aa, Homo sapiens
  variant (1)...(69): Xaa = Any amino acid
LLLPDTLHRLVDFGMSGLRLHARGCNTMYSKATLGVIDQTEILSRLXNADDIHESSXGRXYQFGPCHXF

SEQ ID NO: 1652 - protein, 57 aa, Homo sapiens [sequence omitted]

SEQ ID NO: 1653 - protein, 66 aa, Homo sapiens
  variant (1)...(66): Xaa = Any amino acid
IRRKFSPVLXMLMTSMNPAXVGXISSDLAIXFNEPLHANLLYFIXXQGILKSVPQENDEGETLSXL

SEQ ID NO: 1654 - protein, 67 aa, Homo sapiens
  variant (1)...(67): Xaa = Any amino acid
KXRECLPLIIFLRNRLKYALXXDEVKKICMQRFIKXDGKVRTDXTYXCWIHGCHQHXQDGREFPSDL

SEQ ID NO: 1655 - protein, 99 aa, Homo sapiens
  variant (1)...(99): Xaa = Any amino acid
RRFACSGSLKXMARSELIXPTXAGFMDVISIXKTGENFRLIYDTKGRFAVHRITPTSMKSEPRHSKIDKAMECVWKQKLYEPVVIPVGRLFRPNEKQVA

SEQ ID NO: 1656 - protein, 115 aa, Homo sapiens; identical to SEQ ID NO: 1194
  variant (1)...(115): Xaa = Any amino acid

SEQ ID NO: 1657 - protein, 70 aa, Homo sapiens; identical to SEQ ID NO: 1195
  variant (1)...(70): Xaa = Any amino acid

SEQ ID NO: 1658 - protein, 63 aa, Homo sapiens; identical to SEQ ID NO: 1196
  variant (1)...(63): Xaa = Any amino acid

SEQ ID NO: 1659 - protein, 50 aa, Homo sapiens; identical to SEQ ID NO: 1197
  variant (1)...(50): Xaa = Any amino acid

SEQ ID NO: 1660 - protein, 92 aa, Homo sapiens; identical to SEQ ID NO: 1198
  variant (1)...(92): Xaa = Any amino acid

SEQ ID NO: 1661 - protein, 55 aa, Homo sapiens; identical to SEQ ID NO: 1199
  variant (1)...(55): Xaa = Any amino acid

SEQ ID NO: 1662 - protein, 115 aa, Homo sapiens; identical to SEQ ID NO: 1143

SEQ ID NO: 1663 - protein, 51 aa, Homo sapiens; identical to SEQ ID NO: 1201
  variant (1)...(51): Xaa = Any amino acid

SEQ ID NO: 1664 - protein, 115 aa, Homo sapiens; identical to SEQ ID NO: 1143

SEQ ID NO: 1665 - protein, 55 aa, Homo sapiens; identical to SEQ ID NO: 1144

SEQ ID NO: 1666 - protein, 51 aa, Homo sapiens; identical to SEQ ID NO: 1145

SEQ ID NO: 1667 - protein, 62 aa, Homo sapiens
  variant (1)...(62): Xaa = Any amino acid
VFLSPWVKSESGSLCLSVLVYCWSESKFLIKXVDLALTVYADIGETIWLFQTSQDLSKKTWL

SEQ ID NO: 1668 - protein, 86 aa, Homo sapiens
  variant (1)...(86): Xaa = Any amino acid
EPSQQXLSRIYSLTSNKQALRDTESQIQILPMGIKRLRLXPHLEXYLHHKYIITGSLYEADTKCYRHSQNIILGNNVIKMPNXSQQ

SEQ ID NO: 1669 - protein, 70 aa, Homo sapiens
RDNVICTPYDISTFLATTSGRHSPKLEKKEIEDFCLCKVLKICSKLIKLSLCSFLQQMIQKKKKKKKKSL

SEQ ID NO: 1670 - protein, 50 aa, Homo sapiens
IICCRKEHKDSFINLEQILRTLHRQKSSISFFSNFGECLPLVVAKNVEIS

SEQ ID NO: 1671 - protein, 115 aa, Homo sapiens
YDEDRLFFFDFSQNTRVPCLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVS

SEQ ID NO: 1672 - protein, 65 aa, Homo sapiens [sequence omitted]

SEQ ID NO: 1673 - protein, 77 aa, Homo sapiens
DKSRPKSFHRDGMMLPVHCQHGWEEITDKTDQSVGLAKLQGLQREHFSDRKPSGHRDFPIKFWPYLLDHPLAELFVK

SEQ ID NO: 1674 - protein, 73 aa, Homo sapiens
CCQFTVSMGGKRLLTKQTKVLGLPNSRGFSVNTSAIGNPLDTGIFPSSFGPICWIIHSQNSLSNKMAGASPCS

SEQ ID NO: 1675 - protein, 199 aa, Homo sapiens; identical to SEQ ID NO: 1216

SEQ ID NO: 1676 - protein, 76 aa, Homo sapiens; identical to SEQ ID NO: 1217

SEQ ID NO: 1677 - protein, 122 aa, Homo sapiens; identical to SEQ ID NO: 1218

SEQ ID NO: 1678 - protein, 56 aa, Homo sapiens; identical to SEQ ID NO: 1219

SEQ ID NO: 1679 - protein, 87 aa, Homo sapiens; identical to SEQ ID NO: 1348

SEQ ID NO: 1680 - protein, 55 aa, Homo sapiens; identical to SEQ ID NO: 1349

SEQ ID NO: 1681 - protein, 123 aa, Homo sapiens
IRMTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVS

SEQ ID NO: 1682 - protein, 191 aa, Homo sapiens; identical to SEQ ID NO: 1281

SEQ ID NO: 1683 - protein, 51 aa, Homo sapiens; identical to SEQ ID NO: 1282

SEQ ID NO: 1684 - protein, 51 aa, Homo sapiens; identical to SEQ ID NO: 1283

SEQ ID NO: 1685 - protein, 55 aa, Homo sapiens; identical to SEQ ID NO: 1284

SEQ ID NO: 1686 - protein, 62 aa, Homo sapiens; identical to SEQ ID NO: 1220

SEQ ID NO: 1687 - protein, 86 aa, Homo sapiens; identical to SEQ ID NO: 1221

SEQ ID NO: 1688 - protein, 95 aa, Homo sapiens; identical to SEQ ID NO: 1222
  variant (1)...(95): Xaa = Any amino acid

SEQ ID NO: 1689 - protein, 50 aa, Homo sapiens; identical to SEQ ID NO: 1232

SEQ ID NO: 1690 - protein, 94 aa, Homo sapiens; identical to SEQ ID NO: 1233

SEQ ID NO: 1691 - protein, 53 aa, Homo sapiens; identical to SEQ ID NO: 1234
  variant (1)...(53): Xaa = Any amino acid

SEQ ID NO: 1692 - protein, 59 aa, Homo sapiens; identical to SEQ ID NO: 1184

SEQ ID NO: 1693 - protein, 91 aa, Homo sapiens; identical to SEQ ID NO: 1236

SEQ ID NO: 1694 - protein, 55 aa, Homo sapiens; identical to SEQ ID NO: 1237

SEQ ID NO: 1695 - protein, 54 aa, Homo sapiens; identical to SEQ ID NO: 1238

SEQ ID NO: 1696 - protein, 147 aa, Homo sapiens; identical to SEQ ID NO: 1239

SEQ ID NO: 1697 - protein, 135 aa, Homo sapiens; identical to SEQ ID NO: 1240

SEQ ID NO: 1698 - protein, 151 aa, Homo sapiens; identical to SEQ ID NO: 1241

SEQ ID NO: 1699 - protein, 60 aa, Homo sapiens
PGFPLWEVLFLAGQLGREWRTEKRVEITCSLELSWGTSPHSVHKSLPLEMECSFYHGKRI

SEQ ID NO: 1700 - protein, 57 aa, Homo sapiens
VGHDSEQDRPKEVQGLWSGMETSSERTHGRSRCRRYTSSRITHRMDPLEVKTCGKTV

SEQ ID NO: 1701 - protein, 50 aa, Homo sapiens [sequence omitted]

SEQ ID NO: 1702 - protein, 53 aa, Homo sapiens
KWSVHFIMGKESEWDMIQNRTGPRKCRGCGVGWRQALKGHMGDLDVEGTQVVG

SEQ ID NO: 1703 - protein, 65 aa, Homo sapiens
HPGFQVLSNTVGPLKASSFLPLPQSHPYQDKGLLTVLSIAPTVTMFASLLSPTEQLPITLSYHMS

SEQ ID NO: 1704 - protein, 64 aa, Homo sapiens [sequence omitted]

SEQ ID NO: 1705 - protein, 52 aa, Homo sapiens
AWGIHLPRISILASRSSLIQWGLSRHPLSFLYLKATLIRIKGSSLSSPLPPR

SEQ ID NO: 1706 - protein, 67 aa, Homo sapiens
QCLLPYFLQLSSFLLHCLTTCLNLQWIHPVSYPTTCVPSTSRSPMCPFRACLHPTPQPLHFLGPVLF

SEQ ID NO: 1707 - protein, 115 aa, Homo sapiens; identical to SEQ ID NO: 1143

SEQ ID NO: 1708 - protein, 55 aa, Homo sapiens; identical to SEQ ID NO: 1144

SEQ ID NO: 1709 - protein, 51 aa, Homo sapiens; identical to SEQ ID NO: 1247
  variant (1)...(51): Xaa = Any amino acid

SEQ ID NO: 1710 - protein, 58 aa, Homo sapiens
LTRGLTPREFIQFLNVRSSLVSPSRAPQSMSWFSGLCRAGYLLKRLAIKAKFNLGFPR

SEQ ID NO: 1711 - protein, 76 aa, Homo sapiens; identical to SEQ ID NO: 1337

SEQ ID NO: 1712 - protein, 63 aa, Homo sapiens
VTVQMIDSRVNTQGVHPVPKCPLFSRLTFKSPPVNVLVLWFVQGRVSVKEVGNKSQVQLGVPS

SEQ ID NO: 1713 - protein, 156 aa, Homo sapiens
RGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGG

SEQ ID NO: 1714 - protein, 62 aa, Homo sapiens; identical to SEQ ID NO: 1248
  variant (1)...(62): Xaa = Any amino acid

SEQ ID NO: 1715 - protein, 86 aa, Homo sapiens; identical to SEQ ID NO: 1249
  variant (1)...(86): Xaa = Any amino acid

SEQ ID NO: 1716 - protein, 69 aa, Homo sapiens [sequence omitted]

SEQ ID NO: 1717 - protein, 102 aa, Homo sapiens; identical to SEQ ID NO: 1251

SEQ ID NO: 1718 - protein, 77 aa, Homo sapiens [sequence omitted]

SEQ ID NO: 1719 - protein, 60 aa, Homo sapiens [sequence omitted]

SEQ ID NO: 1720 - protein, 115 aa, Homo sapiens; identical to SEQ ID NO: 1143

SEQ ID NO: 1721 - protein, 55 aa, Homo sapiens; identical to SEQ ID NO: 1255
  variant (1)...(55): Xaa = Any amino acid

SEQ ID NO: 1722 - protein, 51 aa, Homo sapiens; identical to SEQ ID NO: 1256
  variant (1)...(51): Xaa = Any amino acid

SEQ ID NO: 1723 - protein, 62 aa, Homo sapiens [sequence omitted]

SEQ ID NO: 1724 - protein, 62 aa, Homo sapiens
LKLEKGRMEESQNESLATLTIQGIRFEDNGIYFCQQKCNNTSEVYQGCGTELRVMGFSTLAQ

SEQ ID NO: 1725 - protein, 60 aa, Homo sapiens [sequence omitted]

SEQ ID NO: 1726 - protein, 88 aa, Homo sapiens; identical to SEQ ID NO: 1265

SEQ ID NO: 1727 - protein, 57 aa, Homo sapiens
  variant (1)...(57): Xaa = Any amino acid
IQGQNQQQXLQSSADIKYKLQGQFLFEGLFXFXEASMRCXHLPGANFYSQLTHAXNA

SEQ ID NO: 1728 - protein, 65 aa, Homo sapiens
RDNVICTPYDISTFLATTSGRHSPKLEKKEIEDFCLCKVLKICSKLIKLSLCSFLQKKKKKKKKR

SEQ ID NO: 1729 - protein, 56 aa, Homo sapiens
LFFFFFFFFCRKEHKDSFINLEQILRTLHRQKSSISFFSNFGECLPLVVAKNVEIS

SEQ ID NO: 1730 - protein, 73 aa, Homo sapiens
  variant (1)...(73): Xaa = Any amino acid
RSVLEPDANETQQMLFLRHNSLFXELRNPVYAXPXXTFLLLLCMKMPTPXMMSPSXKPPAPVNVLLRAXSDXA

SEQ ID NO: 1731 - protein, 52 aa, Homo sapiens
  variant (1)...(52): Xaa = Any amino acid
SFQXAQEPCLCXSSXNFLAPPVHEDAHSTXDEPQHXAPSSRQCLTPGXIRLX

SEQ ID NO: 1732 - protein, 64 aa, Homo sapiens
  variant (1)...(64): Xaa = Any amino acid
HLAPGQTFNFQIGYCCQXVAXKSVSIIXLFDSXHCXSHWASNHVPXFLXXQIXKTXKKKKKKKK

SEQ ID NO: 1733 - protein, 52 aa, Homo sapiens
  variant (1)...(52): Xaa = Any amino acid
TGFLSXLKRLLCLRKSICCVSLASGSRTDLQLPNWILLPXSCXEVSFYHXAL

SEQ ID NO: 1734 - protein, 59 aa, Homo sapiens
  variant (1)...(59): Xaa = Any amino acid
PCLXSKVTRKRPCLPSMTLMEEMLXXAFRCMTQGKTAKNLVLALLILLFVLFLGVXRAK

SEQ ID NO: 1735 - protein, 54 aa, Homo sapiens
  variant (1)...(54): Xaa = Any amino acid
EFXEQNDXTQKFSKWDFPGRTNERPYCYAIWXKTTLXEDVFTGGPHXKLLXEGI

SEQ ID NO: 1736 - protein, 119 aa, Homo sapiens
  variant (1)...(119): Xaa = Any amino acid
DCQKSCSCSPHFVICFIFRSXESKMXTPRNSVNGTFPAEPMKGPIAMQSGXKPLXXRMSSLVGPXQSFFXRESXTLGAXQIXNGLFHIALGGLXMIPXGIYAPICVTVWXPLWGGIMYI

SEQ ID NO: 1737 - protein, 59 aa, Homo sapiens
  variant (1)...(59): Xaa = Any amino acid
NIHNASPERXPHSHTDGCIDPXWDHXKTPQGNVEEPIXNLXSPQSXRFPXEEALXGAHQ

SEQ ID NO: 1738 - protein, 64 aa, Homo sapiens
  variant (1)...(64): Xaa = Any amino acid
ISGCXHFALXTPKNKTNNKMRRARTRFLAVLPCVMHLNXSXSISSMSVIEGRHGLFRVTLDXRQ

SEQ ID NO: 1739 - protein, 89 aa, Homo sapiens
  variant (1)...(89): Xaa = Any amino acid
IXXGIIXRPPRAMWKSPXIIWXAPKXLDSLXKKLXVGPTSEDILXKSGFXPDCIAIGPFIGSAGKVPFTEFLGXVILLXKLLKIKQITK

SEQ ID NO: 1740 - protein, 58 aa, Homo sapiens
  variant (1)...(58): Xaa = Any amino acid
LVHFLNFPHSEFQSLLLHHVCRNLVLFSVYLHITLKTLLFENFSISQINIHFHNLPLX

SEQ ID NO: 1741 - protein, 94 aa, Homo sapiens
  variant (1)...(94): Xaa = Any amino acid
QQKQNFRFQNLLLAKFILIIPASYGYITIKTEYHRVIALFENSXILQCTSPMKQXISILKIKRKQHREVKCGVAKLWGLLEGTNLNRLFLLSLE

SEQ ID NO: 1742 - protein, 93 aa, Homo sapiens
  variant (1)...(93): Xaa = Any amino acid
VNLYFHGYSKERRNNLLRLVPSSRPHNFATPHLTSLCCFLLIFKMEIXCFIGEVHCKMXEFSNNAITLWYSVLIVIYPYEAGIMRINFANNKF

SEQ ID NO: 1743 - protein, 62 aa, Homo sapiens
VFLSPWVKSESGSLCLSVLVYCWSESKFLIKAVDLAPTVYADIGETIWLFQTSQDLSKKTWL

SEQ ID NO: 1744 - protein, 116 aa, Homo sapiens
EPCFITRSSYSNPVMFEITKLSLQCLHKLWEPSQQLLSRIYSLTSNKQALRDTESQIQILPMGIKRLRLSPHLENYLHHKYIITGSLYEADTKCYRHSQNIILGNNVIKMPNLSQQ

SEQ ID NO: 1745 - protein, 87 aa, Homo sapiens; identical to SEQ ID NO: 1515

SEQ ID NO: 1746 - protein, 113 aa, Homo sapiens [sequence omitted]

SEQ ID NO: 1747 - protein, 79 aa, Homo sapiens; identical to SEQ ID NO: 1517

SEQ ID NO: 1748 - protein, 52 aa, Homo sapiens
RTIGGCRHVLLEQLPRTTLLRSGFQRPPNFVSFNSFRPDLLFGSVTGRQVST

SEQ ID NO: 1749 - protein, 115 aa, Homo sapiens
HMPDWLFATHLKDTTQSMEAFNRTALPISGLLADADMFYSSSYQGPLYCDQDSNDHLISYLSTLFDRTSYSEALQEDRSQLRDQITLSTLWDRCNLALQGSAPITSRPANTDLEV

SEQ ID NO: 1750 - protein, 52 aa, Homo sapiens
VETCLPVTLPNKRSGRKELKDTKLGGRWNPDRSKVVLGNCSSRTCLHPPIVR

SEQ ID NO: 1751 - protein, 56 aa, Homo sapiens
NMSASANSPLIGRAVRLKASIDWVVSFKWVAKSQSGICHEGFSDRLMVCCLTSLGK

SEQ ID NO: 1752 - protein, 86 aa, Homo sapiens; identical to SEQ ID NO: 1221

SEQ ID NO: 1753 - protein, 62 aa, Homo sapiens; identical to SEQ ID NO: 1220

SEQ ID NO: 1754 - protein, 191 aa, Homo sapiens; identical to SEQ ID NO: 1281

SEQ ID NO: 1755 - protein, 51 aa, Homo sapiens; identical to SEQ ID NO: 1282

SEQ ID NO: 1756 - protein, 51 aa, Homo sapiens; identical to SEQ ID NO: 1283

SEQ ID NO: 1757 - protein, 55 aa, Homo sapiens; identical to SEQ ID NO: 1284

SEQ ID NO: 1758 - protein, 87 aa, Homo sapiens; identical to SEQ ID NO: 1515

SEQ ID NO: 1759 - protein, 113 aa, Homo sapiens [sequence omitted]

SEQ ID NO: 1760 - protein, 79 aa, Homo sapiens; identical to SEQ ID NO: 1517

SEQ ID NO: 1761 - protein, 106 aa, Homo sapiens; identical to SEQ ID NO: 1289

SEQ ID NO: 1762 - protein, 53 aa, Homo sapiens; identical to SEQ ID NO: 1290

SEQ ID NO: 1763 - protein, 55 aa, Homo sapiens; identical to SEQ ID NO: 1144

SEQ ID NO: 1764 - protein, 51 aa, Homo sapiens; identical to SEQ ID NO: 1292

SEQ ID NO: 1765 - protein, 51 aa, Homo sapiens; identical to SEQ ID NO: 1145

SEQ ID NO: 1766 - protein, 101 aa, Homo sapiens
SHLLEGGQRGQDGAADPHGVLALRRSNDLDLHCAGCQGSDLLLHPVGNARVHGGAARQHCVGVQVFADVHVTLHDGVEGSFVDATGLHAQEGRLEECLRAA

SEQ ID NO: 1767 - protein, 124 aa, Homo sapiens
VIVRLEAFAVDDGGAGLVILLLADHICWKVDSEARMEPPIHTEYLRSGGAMILIFIVLGARAVISFCILSAMPGYMVVPPDSTVLAYRSLRMSTSHFMMELKVVSWMPQDSMPRKEGWKSASGQ

SEQ ID NO: 1768 - protein, 100 aa, Homo sapiens
RCPEALFQPSFLGMESCGIHETTFNSIMKCDVDIRKDLYANTVLSGGTTMYPGIADRMQKEITALAPSTMKIKIIAPPERKYSVWIGGSILASLSTFQQM

SEQ ID NO: 1769 - protein, 115 aa, Homo sapiens; identical to SEQ ID NO: 1297

SEQ ID NO: 1770 - protein, 53 aa, Homo sapiens; identical to SEQ ID NO: 1267

SEQ ID NO: 1771 - protein, 55 aa, Homo sapiens; identical to SEQ ID NO: 1299

SEQ ID NO: 1772 - protein, 53 aa, Homo sapiens [sequence omitted]

SEQ ID NO: 1773 - protein, 54 aa, Homo sapiens
LGQELCPVPAAFISTHVHSLLRPRPPGICPGLPHPTSIRSCPRCMSSIGRIARW

SEQ ID NO: 1774 - protein, 63 aa, Homo sapiens [sequence omitted]

SEQ ID NO: 1775 - protein, 68 aa, Homo sapiens
GERPRVGTGNLRRAGNGSLRFRKLLCKLRGWLGPKGCSARRASCELSKALGSQHPKSLWLQSCVCTTH

SEQ ID NO: 1776 - protein, 72 aa, Homo sapiens
GIRSQLSLNSQSPPWASLPNDLVALGAPEVNPEILPPSTLGSDLCPSLCHKEISVKRVGTGGFRPCSKATAR

SEQ ID NO: 1777 - protein, 52 aa, Homo sapiens
VLRQILSLLIQSEPDLTFSPPSNPAYAGHASWATPDGGGMREPGADTRRSGP

SEQ ID NO: 1778 - protein, 60 aa, Homo sapiens
SHRLLGCCEPRALLSSQLARRAEQPFGPSHPRSLHRSFLNLRDPFPALLKFPVPTLGLSP

SEQ ID NO: 1779 - protein, 52 aa, Homo sapiens
NTPSVNSGLRPLPFSVSQGNFGQEGGNRWFQTVQQSHCQVSFKANFISSYSV

SEQ ID NO: 1780 - protein, 78 aa, Homo sapiens; identical to SEQ ID NO: 1307

SEQ ID NO: 1781 - protein, 134 aa, Homo sapiens [sequence omitted]

SEQ ID NO: 1782 - protein, 66 aa, Homo sapiens; identical to SEQ ID NO: 1309

SEQ ID NO: 1783 - protein, 141 aa, Homo sapiens; identical to SEQ ID NO: 1310

SEQ ID NO: 1784 - protein, 53 aa, Homo sapiens
FFFLHRIGRGGRFGRKGVAINFVTEEDKRILRDIETFYNTTVEEMPMNVADLI

SEQ ID NO: 1785 - protein, 51 aa, Homo sapiens
  variant (1)...(51): Xaa = Any amino acid
KMGSVKSFFLRNLFPSSVEMXXLDVLYHLIIYLXTKRYKCXIKSANYVKLA

SEQ ID NO: 1786 - protein, 67 aa, Homo sapiens
SPIQQQRALHPKLSSQELNKVSHIHGHLLHCSIVESLNVTKNPLVFFSNKVYSHTFPPKSTPSANSV

SEQ ID NO: 1787 - protein, 58 aa, Homo sapiens
KVSMSRRILLSSSVTKFIATPFLPNRPPLPILCKKKNQNVTSHIMYKLLNMTIHLLTT

SEQ ID NO: 1788 - protein, 61 aa, Homo sapiens; identical to SEQ ID NO: 1311

SEQ ID NO: 1789 - protein, 51 aa, Homo sapiens; identical to SEQ ID NO: 1312

SEQ ID NO: 1790 - protein, 192 aa, Homo sapiens
LLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSASCIVILAVCLLCYVSITKIKKEWWDQIPNPARSRLVAIIIQDAQGSQWEKRSRGQEPAKCP

SEQ ID NO: 1791 - protein, 75 aa, Homo sapiens [sequence omitted]

SEQ ID NO: 1792 - protein, 64 aa, Homo sapiens
RPAGGAARRAPCRSCATWCWGSTHSRWCYSTEPRPSPVPCRKSQTSGCWLRCGGRVLGRSRYRF

SEQ ID NO: 1793 - protein, 104 aa, Homo sapiens [sequence omitted]

SEQ ID NO: 1794 - protein, 71 aa, Homo sapiens
VGHVIDSEICRVVFTPNVDCIGEMIIQVIVRGIRVAPGQQQSVGDIGVNCQVSWGPGFHMLAGLEGALPQQ

SEQ ID NO: 1795 - protein, 115 aa, Homo sapiens; identical to SEQ ID NO: 1143

SEQ ID NO: 1796 - protein, 55 aa, Homo sapiens; identical to SEQ ID NO: 1144

SEQ ID NO: 1797 - protein, 51 aa, Homo sapiens; identical to SEQ ID NO: 1145

SEQ ID NO: 1798 - protein, 54 aa, Homo sapiens
PVLRQIWGWGEHFGLKAQSSLPCFFCAYHSPLASTSVRWGGDKKRSKVKKKVEN

SEQ ID NO: 1799 - protein, 56 aa, Homo sapiens
DGGGTKREVKLRRKWKIKKKMSKFLHAYISAYAEDLPVCCTLNHTFRTPQKPSLSP

SEQ ID NO: 1800 - protein, 59 aa, Homo sapiens; identical to SEQ ID NO: 1321

SEQ ID NO: 1801 - protein, 64 aa, Homo sapiens; identical to SEQ ID NO: 1322

SEQ ID NO: 1802 - protein, 57 aa, Homo sapiens; identical to SEQ ID NO: 1323

SEQ ID NO: 1803 - protein, 51 aa, Homo sapiens; identical to SEQ ID NO: 1324

SEQ ID NO: 1804 - protein, 74 aa, Homo sapiens
MDRGPKRKRYLKTNGRNLEAHDPEPRKDRSLKTWGNPKMRTLNPTSFLLFTLLTLRYFQFSCLSLSLILLRCTF

SEQ ID NO: 1805 - protein, 77 aa, Homo sapiens
GSHLGISPGLQASILPGFWVMGLQIPAVSLEIPFSLGSSIHLGRLCDRGLPSLGCRSSSYNPGLILGRWPCVTSLSS

SEQ ID NO: 1806 - protein, 85 aa, Homo sapiens
YCQSKGNRQHQKVHLKRIRLKDKQENWKYLRVRSVNNRKEVGFRVLILGFPQVFKLLSFLGSGSWASRFRPLVLRYLFRLGPLSI

SEQ ID NO: 1807 - protein, 50 aa, Homo sapiens; identical to SEQ ID NO: 1332

SEQ ID NO: 1808 - protein, 51 aa, Homo sapiens; identical to SEQ ID NO: 1333

SEQ ID NO: 1809 - protein, 92 aa, Homo sapiens [sequence omitted]

SEQ ID NO: 1810 - protein, 50 aa, Homo sapiens
GVLNFNLRGPTVPSKTETTELLGWRLEAGAEGLIPVVGKLRQPPKVEVGE

SEQ ID NO: 1811 - protein, 66 aa, Homo sapiens
VTPFPFPEIGTSYSKGERRAQRDLYRTSLAHGDWRQRVGSWRGVQSLQQILRASKSSSWTFLLIWI

SEQ ID NO: 1812 - protein, 83 aa, Homo sapiens
KSRLRETSRKSSLKPSIFVGGTGLLSSSPPSASSHHVQERSCTDLSGLSFLLWNNLFLFQEREMVSLRPWTASPARLGPQVPL

SEQ ID NO: 1813 - protein, 82 aa, Homo sapiens
SPQYLLEGLDSSPAPHPLPPVTMCKRGPVQISLGSPFSFGITCSYFRKGKWCHSGPGLLLQPGWGHRSHSSEGQCLRIKAVF

SEQ ID NO: 1814 - protein, 53 aa, Homo sapiens
IQIKRNVQEELFEALNICWRDWTPLQLPTLCLQSPCAREVLYRSLWALLSPLE

SEQ ID NO: 1815 - protein, 116 aa, Homo sapiens
  variant (1)...(116): Xaa = Any amino acid
PKEVRQLAEDFLKDYIHINIGALELSANHNILQIVDVCHDXXKDEKLIXLMEEIMSEKENKTIVFVETKRRCDELTRKMRRDGWPAMGIHXDKSQQERDWALNESKHGKAPILIXT

SEQ ID NO: 1816 - protein, 51 aa, Homo sapiens
  variant (1)...(51): Xaa = Any amino acid
SPVTLLLTLVXMDTHGRPPISPHFSGKLITSSFGFHKNNGFILLLTHDLFH

SEQ ID NO: 1817 - protein, 55 aa, Homo sapiens
  variant (1)...(55): Xaa = Any amino acid
LLXPWIPMAGHPSLLIFLVSSSHLLLVSTKTMVLFSFSLMISSIRXISFSSFXXS

SEQ ID NO: 1818 - protein, 63 aa, Homo sapiens
  variant (1)...(63): Xaa = Any amino acid
GGKMAVQISKKRKFVADGIFKAELNEFLTRELAEDGYSGVEGASYTNQDRNHYLXHQNTXCSW

SEQ ID NO: 1819 - protein, 70 aa, Homo sapiens
  variant (1)...(70): Xaa = Any amino acid
MSFLLGSWLKMATLELRVRVTPTRTEIIILXTRTXNVLGEKGRRIRELTAVVQKRFGFPEGSVELYAXKV

SEQ ID NO: 1820 - protein, 76 aa, Homo sapiens
  variant (1)...(76): Xaa = Any amino acid
TTAVSSRIRRPFSPRTXCVLVXKIMISVLVGVTRTLNSRVAIFSQLPSKKLIQFSFEDAISDKLPLLGYLHCHLAA

SEQ ID NO: 1821 - protein, 70 aa, Homo sapiens
PMWLVFSLQLARFHTLTSLSQPQETMIGLLLLGEKRTQDTHSEWLSSWTVYLHTPRVFHSLMVLSRDPKT

SEQ ID NO: 1822 - protein, 70 aa, Homo sapiens
IVFGSRDKTIKLWNTLGVCKYTVQDESHSEWVSCVRFSPNSSNPIIVSCGWDKLVKVWNLANCKLKTNHI

SEQ ID NO: 1823 - protein, 64 aa, Homo sapiens
LFLDLEIKPSSYGIPWVCANTLSRMRATQSGCLVSASRPTAATLSSSPVAGTSWSRYGTWLTAS

SEQ ID NO: 1824 - protein, 74 aa, Homo sapiens; identical to SEQ ID NO: 1505

SEQ ID NO: 1825 - protein, 66 aa, Homo sapiens
LDDGLQPLSVLSVPHSTSISCCTPTQLRELVRTQPIHLSRTSETLDQWSHMVLRLHVNTPANAACR

SEQ ID NO: 1826 - protein, 76 aa, Homo sapiens
YGDSLWKSSFPSFVSLPTMQEASLAVLFYYHYISPICNKVLYRQVRSMLSSSLSPRRLRLRYRGNSPVQSLFMLTQ

SEQ ID NO: 1827 - protein, 60 aa, Homo sapiens; identical to SEQ ID NO: 1340

SEQ ID NO: 1828 - protein, 95 aa, Homo sapiens; identical to SEQ ID NO: 1341

SEQ ID NO: 1829 - protein, 50 aa, Homo sapiens; identical to SEQ ID NO: 1342

SEQ ID NO: 1830 - protein, 62 aa, Homo sapiens
VAVSSLRHGVCSPTDIGVLRKGGVIWQKCHFACCIQGSYSTRYCELCSHQLAQKQQTALCCQ

SEQ ID NO: 1831 - protein, 94 aa, Homo sapiens
WLSPLSAMACARPLISVYSEKGESSGKNVTLPAVFKAPIRPDIVNFVHTNLRKNNRQPYAVSELAGHQTSAESWGTGRAVARIPRVRGGGTHRS

SEQ ID NO: 1832 - protein, 102 aa, Homo sapiens [sequence omitted]

SEQ ID NO: 1833 - protein, 60 aa, Homo sapiens; identical to SEQ ID NO: 1340

SEQ ID NO: 1834 - protein, 50 aa, Homo sapiens; identical to SEQ ID NO: 1345

SEQ ID NO: 1835 - protein, 76 aa, Homo sapiens; identical to SEQ ID NO: 1346

SEQ ID NO: 1836 - protein, 68 aa, Homo sapiens; identical to SEQ ID NO: 1347

SEQ ID NO: 1837 - protein, 87 aa, Homo sapiens; identical to SEQ ID NO: 1348

SEQ ID NO: 1838 - protein, 55 aa, Homo sapiens; identical to SEQ ID NO: 1349

SEQ ID NO: 1839 - protein, 120 aa, Homo sapiens; identical to SEQ ID NO: 1350

SEQ ID NO: 1840 - protein, 75 aa, Homo sapiens [sequence omitted]

SEQ ID NO: 1841 - protein, 59 aa, Homo sapiens
VFSSVTHNIKNKNPVSLAKFGLKSEMFLWSCQQAGMYLIQFNLLLFLWLSSKPLSSCNS

SEQ ID NO: 1842 - protein, 51 aa, Homo sapiens [sequence omitted]

SEQ ID NO: 1843 - protein, 74 aa, Homo sapiens [sequence omitted]

SEQ ID NO: 1844 - protein, 50 aa, Homo sapiens [sequence omitted]

SEQ ID NO: 1845 - protein, 93 aa, Homo sapiens
  variant (1)...(93): Xaa = Any amino acid
GDXVGXGAQAATMAYHGLTVPLIVMSVFWGFVGFLVPWFIPKGPNRGVIITMLVTCSVCCYLFWLIAILAQLNPLFGPQLKNETIWYLKYHWP

SEQ ID NO: 1846 - protein, 56 aa, Homo sapiens
  variant (1)...(56): Xaa = Any amino acid
TGHQHGNDNSPVRTLRDEPRHQEADEAPEHAHHNERHSEAVIRHGRRLSAXPYXVA

SEQ ID NO: 1847 - protein, 64 aa, Homo sapiens
  variant (1)...(64): Xaa = Any amino acid
FXXFFXKXRILGXFXETKADIKSYKDFXFSFTKKVIHILHYTRYDINTGKYYVHCKEKGKIETY

SEQ ID NO: 1848 - protein, 53 aa, Homo sapiens
  variant (1)...(53): Xaa = Any amino acid
AKGGFIKXNQYWANPFXPFFSFSMXILFFXYSSSSCSKLKLGKESHFXLXVFL

SEQ ID NO: 1849 - protein, 54 aa, Homo sapiens
  variant (1)...(54): Xaa = Any amino acid
NXHRKREKGXKGIGPILIXFYKTSFGLEGMTLATIIXSMFKQVPLVVALNVIXL

SEQ ID NO: 1850 - protein, 188 aa, Homo sapiens
QVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGD

SEQ ID NO: 1851 - protein, 50 aa, Homo sapiens
SHLSSRSCCSAPLLTYHSSSLLLVCSVPFQFFPGFPGENPLFVLSGSAPS

SEQ ID NO: 1852 - protein, 66 aa, Homo sapiens
LIILHLYCLFALFLFNFFQVFQERIHFLFYLGQLLLNGLKVISFQLSRLGRSPLSTLRIEATFAPS

SEQ ID NO: 1853 - protein, 71 aa, Homo sapiens
SPSSAESSAPPSDSIFTLVSSFFTELLLCSSSDLSFFISTACLLCSFSIFSRFSRRESTFCFIWVSSFLMA

SEQ ID NO: 1854 - protein, 80 aa, Homo sapiens
HRGRQEAIAGGHLSLDGSSLVHTVPKKGLPLGPRNPSQPSQAEPHPGFSQRGAQEDPSCPKSEEQQETASEVRHSSVLLP

SEQ ID NO: 1855 - protein, 112 aa, Homo sapiens
  variant (1)...(112): Xaa = Any amino acid
MEAPWSTQSQRKVCLWAHETHPSPHRLNLTLGFPREVPKKTQAAPSQRSSRKQPQKSVTLQYSSLRMSTSCLVTMATKRQWQCSACGMGELHLPWVHGEETPVTXRSGESHG

SEQ ID NO: 1856 - protein, 127 aa, Homo sapiens
  variant (1)...(127): Xaa = Any amino acid
PMALPASXGHWSLLPMYPRKMELPHPTRTALPLSFGCHGHQTGSGHSKGGVLKSDGLLRLFPAAPLTWGSLGLLGHLSGKTQGEVQPVRAGMGFVGPKADLSLGLCGPRSFHLVTSDPQLSPLAFPC

SEQ ID NO: 1857 - protein, 51 aa, Homo sapiens
  variant (1)...(51): Xaa = Any amino acid
PWLSPLLXVTGVSSPCTQGRWSSPIPHALHCHCLLVAMVTKQEVDILREEY

SEQ ID NO: 1858 - protein, 53 aa, Homo sapiens
TKDYLFKKSFEVKYFVYVIHRCTYKHTHIESQYFNTSLGSCTNSLTLRKKLRN

SEQ ID NO: 1859 - protein, 57 aa, Homo sapiens
YSVKLTDNLESLSSFIFLTLQKGKEDKHSLPFYLTNRRGTQFFSRLGTVRERWGKPF

SEQ ID NO: 1860 - protein, 62 aa, Homo sapiens; identical to SEQ ID NO: 1220

SEQ ID NO: 1861 - protein, 86 aa, Homo sapiens; identical to SEQ ID NO: 1221

SEQ ID NO: 1862 - protein, 58 aa, Homo sapiens [sequence omitted]

SEQ ID NO: 1863 - protein, 109 aa, Homo sapiens; identical to SEQ ID NO: 674

SEQ ID NO: 1864 - protein, 100 aa, Homo sapiens; identical to SEQ ID NO: 675

SEQ ID NO: 1865 - protein, 103 aa, Homo sapiens [sequence omitted]

SEQ ID NO: 1866 - protein, 88 aa, Homo sapiens; identical to SEQ ID NO: 1395

SEQ ID NO: 1867 - protein, 157 aa, Homo sapiens; identical to SEQ ID NO: 1396
  variant (1)...(157): Xaa = Any amino acid

SEQ ID NO: 1868 - protein, 156 aa, Homo sapiens; identical to SEQ ID NO: 1397
  variant (1)...(156): Xaa = Any amino acid

SEQ ID NO: 1869 - protein, 75 aa, Homo sapiens; identical to SEQ ID NO: 1398
  variant (1)...(75): Xaa = Any amino acid

SEQ ID NO: 1870 - protein, 111 aa, Homo sapiens; identical to SEQ ID NO: 1399
  variant (1)...(111): Xaa = Any amino acid

SEQ ID NO: 1871 - protein, 104 aa, Homo sapiens; identical to SEQ ID NO: 1400
  variant (1)...(104): Xaa = Any amino acid

SEQ ID NO: 1872 - protein, 53 aa, Homo sapiens [sequence omitted]

SEQ ID NO: 1873 - protein, 67 aa, Homo sapiens; identical to SEQ ID NO: 1402
  variant (1)...(67): Xaa = Any amino acid

SEQ ID NO: 1874 - protein, 56 aa, Homo sapiens; identical to SEQ ID NO: 712

SEQ ID NO: 1875 - protein, 56 aa, Homo sapiens; identical to SEQ ID NO: 713

SEQ ID NO: 1876 - protein, 56 aa, Homo sapiens; identical to SEQ ID NO: 714

SEQ ID NO: 1877 - protein, 51 aa, Homo sapiens
  variant (1)...(51): Xaa = Any amino acid
TNQSLLRNCYSLNWSIKTSHGSGYGVIWCPCFSPXGHLIXEPPXEFCGRHL

SEQ ID NO: 1878 - protein, 56 aa, Homo sapiens; identical to SEQ ID NO: 729

SEQ ID NO: 1879 - protein, 50 aa, Homo sapiens; identical to SEQ ID NO: 730

SEQ ID NO: 1880 - protein, 70 aa, Homo sapiens; identical to SEQ ID NO: 731

SEQ ID NO: 1881 - protein, 53 aa, Homo sapiens; identical to SEQ ID NO: 732

SEQ ID NO: 1882 - protein, 69 aa, Homo sapiens; identical to SEQ ID NO: 1414
  variant (1)...(69): Xaa = Any amino acid

SEQ ID NO: 1883 - protein, 64 aa, Homo sapiens; identical to SEQ ID NO: 1415
  variant (1)...(64): Xaa = Any amino acid

SEQ ID NO: 1884 - protein, 92 aa, Homo sapiens; identical to SEQ ID NO: 1416
  variant (1)...(92): Xaa = Any amino acid

SEQ ID NO: 1885 - protein, 77 aa, Homo sapiens; identical to SEQ ID NO: 1417
  variant (1)...(77): Xaa = Any amino acid

SEQ ID NO: 1886 - protein, 97 aa, Homo sapiens; identical to SEQ ID NO: 725

SEQ ID NO: 1887 - protein, 56 aa, Homo sapiens; identical to SEQ ID NO: 754

SEQ ID NO: 1888 - protein, 75 aa, Homo sapiens; identical to SEQ ID NO: 1418
  variant (1)...(75): Xaa = Any amino acid

SEQ ID NO: 1889 - protein, 74 aa, Homo sapiens; identical to SEQ ID NO: 1419
  variant (1)...(74): Xaa = Any amino acid

SEQ ID NO: 1890 - protein, 66 aa, Homo sapiens; identical to SEQ ID NO: 1420
  variant (1)...(66): Xaa = Any amino acid

SEQ ID NO: 1891 - protein, 55 aa, Homo sapiens; identical to SEQ ID NO: 1427

SEQ ID NO: 1892 - protein, 52 aa, Homo sapiens; identical to SEQ ID NO: 787
  variant (1)...(52): Xaa = Any amino acid

SEQ ID NO: 1893 - protein, 115 aa, Homo sapiens; identical to SEQ ID NO: 1443
  variant (1)...(115): Xaa = Any amino acid

SEQ ID NO: 1894 - protein, 50 aa, Homo sapiens; identical to SEQ ID NO: 1444

SEQ ID NO: 1895 - protein, 114 aa, Homo sapiens; identical to SEQ ID NO: 1445
  variant (1)...(114): Xaa = Any amino acid

SEQ ID NO: 1896 - protein, 74 aa, Homo sapiens; identical to SEQ ID NO: 1446
  variant (1)...(74): Xaa = Any amino acid

SEQ ID NO: 1897 - protein, 60 aa, Homo sapiens; identical to SEQ ID NO: 1447
  variant (1)...(60): Xaa = Any amino acid

SEQ ID NO: 1898 - protein, 60 aa, Homo sapiens; identical to SEQ ID NO: 1448
  variant (1)...(60): Xaa = Any amino acid

SEQ ID NO: 1899 - protein, 58 aa, Homo sapiens; identical to SEQ ID NO: 1449

SEQ ID NO: 1900 - protein, 146 aa, Homo sapiens; identical to SEQ ID NO: 1450

SEQ ID NO: 1901 - protein, 62 aa, Homo sapiens; identical to SEQ ID NO: 1451

SEQ ID NO: 1902 - protein, 109 aa, Homo sapiens; identical to SEQ ID NO: 1452
  variant (1)...(109): Xaa = Any amino acid

SEQ ID NO: 1903 - protein, 81 aa, Homo sapiens; identical to SEQ ID NO: 1453

SEQ ID NO: 1904 - protein, 59 aa, Homo sapiens; identical to SEQ ID NO: 1454
  variant (1)...(59): Xaa = Any amino acid

SEQ ID NO: 1905 - protein, 74 aa, Homo sapiens [sequence omitted]

SEQ ID NO: 1906 - protein, 66 aa, Homo sapiens; identical to SEQ ID NO: 822

SEQ ID NO: 1907 - protein, 75 aa, Homo sapiens; identical to SEQ ID NO: 823

SEQ ID NO: 1908 - protein, 59 aa, Homo sapiens; identical to SEQ ID NO: 824

SEQ ID NO: 1909 - protein, 65 aa, Homo sapiens; identical to SEQ ID NO: 1467

SEQ ID NO: 1910 - protein, 107 aa, Homo sapiens; identical to SEQ ID NO: 1468

SEQ ID NO: 1911 - protein, 74 aa, Homo sapiens; identical to SEQ ID NO: 1469

SEQ ID NO: 1912 - protein, 63 aa, Homo sapiens; identical to SEQ ID NO: 1470

SEQ ID NO: 1913 - protein, 181 aa, Homo sapiens; identical to SEQ ID NO: 1471

SEQ ID NO: 1914 - protein, 109 aa, Homo sapiens; identical to SEQ ID NO: 1472

SEQ ID NO: 1915 - protein, 100 aa, Homo sapiens [sequence omitted]

SEQ ID NO: 1916 - protein, 103 aa, Homo sapiens [sequence omitted]

SEQ ID NO: 1917 - protein, 58 aa, Homo sapiens [sequence omitted]

SEQ ID NO: 1918 - protein, 109 aa, Homo sapiens; identical to SEQ ID NO: 1476

SEQ ID NO: 1919 - protein, 78 aa, Homo sapiens
  variant (1)...(78): Xaa = Any amino acid
RGCMPXSTLELEELKQVLLHNERSFNPLEDDDDCQIKKRPASLNSKPSSLRRVTIASLPXNIGNAGMVAGMENNDPIX

SEQ ID NO: 1920 - protein, 103 aa, Homo sapiens
  variant (1)...(103): Xaa = Any amino acid
XIGSLFSIPATIPAFPIFXGKEAIVTLRREDGLEFREAGRFLIWQSSSSSRGLKDLSLCRRTCFSSSNSSVXFGIHPLQVXYVLNHHFNCFTNPAFLIDGSQH

SEQ ID NO: 1921 - protein, 60 aa, Homo sapiens; identical to SEQ ID NO: 1494
  variant (1)...(60): Xaa = Any amino acid

SEQ ID NO: 1922 - protein, 60 aa, Homo sapiens; identical to SEQ ID NO: 1495
  variant (1)...(60): Xaa = Any amino acid

SEQ ID NO: 1923 - protein, 60 aa, Homo sapiens; identical to SEQ ID NO: 1496
  variant (1)...(60): Xaa = Any amino acid

SEQ ID NO: 1924 - protein, 60 aa, Homo sapiens; identical to SEQ ID NO: 1497
  variant (1)...(60): Xaa = Any amino acid

SEQ ID NO: 1925 - protein, 53 aa, Homo sapiens; identical to SEQ ID NO: 1498
  variant (1)...(53): Xaa = Any amino acid

SEQ ID NO: 1926 - protein, 71 aa, Homo sapiens [sequence omitted]

SEQ ID NO: 1927 - protein, 73 aa, Homo sapiens; identical to SEQ ID NO: 882

SEQ ID NO: 1928 - protein, 63 aa, Homo sapiens; identical to SEQ ID NO: 1470

SEQ ID NO: 1929 - protein, 181 aa, Homo sapiens; identical to SEQ ID NO: 1471

SEQ ID NO: 1930 - protein, 109 aa, Homo sapiens; identical to SEQ ID NO: 1472

SEQ ID NO: 1931 - protein, 74 aa, Homo sapiens; identical to SEQ ID NO: 1505

SEQ ID NO: 1932 - protein, 66 aa, Homo sapiens; identical to SEQ ID NO: 1506

SEQ ID NO: 1933 - protein, 63 aa, Homo sapiens; identical to SEQ ID NO: 1470

SEQ ID NO: 1934 - protein, 169 aa, Homo sapiens
SRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLS

SEQ ID NO: 1935 - protein, 109 aa, Homo sapiens; identical to SEQ ID NO: 1472

SEQ ID NO: 1936 - protein, 56 aa, Homo sapiens
DKSRPKSFHRDGMMLPVHCQHGWEEITDKTDQSVGLAKLQGLQREHFSDRKPWWGD

SEQ ID NO: 1937 - protein, 79 aa, Homo sapiens
  variant (1)...(79): Xaa = Any amino acid
FRWYLCVWRGHGIWRGGQRRTQWVRLWETEMSEELGSEGRSSSRQGLXLDVEAEPDPGYSGPLHHDFLQHFLSRAHIDV

SEQ ID NO: 1938 - protein, 114 aa, Homo sapiens
  variant (1)...(114): Xaa = Any amino acid
XQSLPGRRPPFRAQLLAHLCLPKPDPLCSSLPSPPYAMAPPNTEIPSKLVSFSPYTSIPPPGFPIAEVFTLKPLEFGKPNTLVCFVSNLFPPMLTVNWQHHSIPVEGFGPTFVS

SEQ ID NO: 1939 - protein, 58 aa, Homo sapiens
  variant (1)...(58): Xaa = Any amino acid
PGSGSASTSXCSPCLEEDLPSEPSSSLISVSQSLTHCVLLCPPLHMPWPLQTQRYHLN

SEQ ID NO: 1940 - protein, 150 aa, Homo sapiens; identical to SEQ ID NO: 983
  variant (1)...(150): Xaa = Any amino acid

SEQ ID NO: 1941 - protein, 101 aa, Homo sapiens; identical to SEQ ID NO: 930

SEQ ID NO: 1942 - protein, 87 aa, Homo sapiens; identical to SEQ ID NO: 1515

SEQ ID NO: 1943 - protein, 113 aa, Homo sapiens [sequence omitted]

SEQ ID NO: 1944 - protein, 79 aa, Homo sapiens; identical to SEQ ID NO: 1517

SEQ ID NO: 1945 - protein, 54 aa, Homo sapiens; identical to SEQ ID NO: 1535
  variant (1)...(54): Xaa = Any amino acid

SEQ ID NO: 1946 - protein, 55 aa, Homo sapiens; identical to SEQ ID NO: 1536
  variant (1)...(55): Xaa = Any amino acid

SEQ ID NO: 1947 - protein, 61 aa, Homo sapiens; identical to SEQ ID NO: 1537

SEQ ID NO: 1948 - protein, 96 aa, Homo sapiens; identical to SEQ ID NO: 1538
  variant (1)...(96): Xaa = Any amino acid

SEQ ID NO: 1949 - protein, 65 aa, Homo sapiens; identical to SEQ ID NO: 1467

SEQ ID NO: 1950 - protein, 107 aa, Homo sapiens; identical to SEQ ID NO: 1468

SEQ ID NO: 1951 - protein, 74 aa, Homo sapiens; identical to SEQ ID NO: 1469

SEQ ID NO: 1952 - protein, 94 aa, Homo sapiens [sequence omitted]

SEQ ID NO: 1953 - protein, 61 aa, Homo sapiens [sequence omitted]

SEQ ID NO: 1954 - protein, 58 aa, Homo sapiens; identical to SEQ ID NO: 1083
  variant (1)...(58): Xaa = Any amino acid

SEQ ID NO: 1955 - protein, 139 aa, Homo sapiens; identical to SEQ ID NO: 1084
  variant (1)...(139): Xaa = Any amino acid

SEQ ID NO: 1956 - protein, 62 aa, Homo sapiens; identical to SEQ ID NO: 1220

SEQ ID NO: 1957 - protein, 86 aa, Homo sapiens; identical to SEQ ID NO: 1221

SEQ ID NO: 1958 - protein, 97 aa, Homo sapiens; identical to SEQ ID NO: 1593

SEQ ID NO: 1959 - protein, 57 aa, Homo sapiens; identical to SEQ ID NO: 1149

SEQ ID NO: 1960 - protein, 78 aa, Homo sapiens; identical to SEQ ID NO: 1150

SEQ ID NO: 1961 - protein, 65 aa, Homo sapiens; identical to SEQ ID NO: 1600

SEQ ID NO: 1962 - protein, 64 aa, Homo sapiens; identical to SEQ ID NO: 1601

SEQ ID NO: 1963 - protein, 79 aa, Homo sapiens; identical to SEQ ID NO: 1609
  variant (1)...(79): Xaa = Any amino acid

SEQ ID NO: 1964 - protein, 87 aa, Homo sapiens; identical to SEQ ID NO: 1515

SEQ ID NO: 1965 - protein, 113 aa, Homo sapiens; identical to SEQ ID NO: 1611
  variant (1)...(113): Xaa = Any amino acid

SEQ ID NO: 1966 - protein, 117 aa, Homo sapiens; identical to SEQ ID NO: 1170

SEQ ID NO: 1967 - protein, 117 aa, Homo sapiens; identical to SEQ ID NO: 1171

SEQ ID NO: 1968 - protein, 83 aa, Homo sapiens; identical to SEQ ID NO: 1172

SEQ ID NO: 1969 - protein, 67 aa, Homo sapiens; identical to SEQ ID NO: 1625
  variant (1)...(67): Xaa = Any amino acid

SEQ ID NO: 1970 - protein, 74 aa, Homo sapiens
IYDSLAYWNWSASKTGWLHRRTRQSRLFLCTDSETVLSGRSSGLPGPDTCPRESPEAWTVLLCFHRSGRGESPW

SEQ ID NO: 1971 - protein, 101 aa, Homo sapiens
KTIYRQFFTSLIFTDSTSYGMAYGLPPKYTILWHIGIGQPQRPAGYIVARDSPAYSSARTRRRSSAGGAQVSLGQTRAPESPQKHGQFCSVSIAQAGERVR

SEQ ID NO: 1972 - protein, 101 aa, Homo sapiens
KQSTGSSLQVSYLQIAQAMAWRMASLLNIRFFGILELVSLKDRLATSSHETVPLIPLHGLGDGPQREELRSPWARHVPQRVPRSMDSSALFPSLRQGRESV

SEQ ID NO: 1973 - protein, 74 aa, Homo sapiens
HGLSPLPERWKQSRTVHASGDSLGHVSGPGRPELLPLRTVSESVQRNKRDCLVRRCSQPVFEADQFQYAKESYI

SEQ ID NO: 1974 - protein, 64 aa, Homo sapiens
GPSPSPCRGISGTVSCDDVASRSLRLTNSNMPKNRIFRREAIRHAIACAICKYETCKELPVDCF

SEQ ID NO: 1975 - protein, 98 aa, Homo sapiens; identical to SEQ ID NO: 1188
  variant (1)...(98): Xaa = Any amino acid

SEQ ID NO: 1976 - protein, 66 aa, Homo sapiens; identical to SEQ ID NO: 1636

SEQ ID NO: 1977 - protein, 84 aa, Homo sapiens; identical to SEQ ID NO: 1637
  variant (1)...(84): Xaa = Any amino acid

SEQ ID NO: 1978 - protein, 64 aa, Homo sapiens; identical to SEQ ID NO: 1638
  variant (1)...(64): Xaa = Any amino acid

SEQ ID NO: 1979 - protein, 69 aa, Homo sapiens; identical to SEQ ID NO: 1651
  variant (1)...(69): Xaa = Any amino acid

SEQ ID NO: 1980 - protein, 57 aa, Homo sapiens [sequence omitted]

SEQ ID NO: 1981 - protein, 66 aa, Homo sapiens; identical to SEQ ID NO: 1653
  variant (1)...(66): Xaa = Any amino acid

SEQ ID NO: 1982 - protein, 67 aa, Homo sapiens; identical to SEQ ID NO: 1654
  variant (1)...(67): Xaa = Any amino acid

SEQ ID NO: 1983 - protein, 99 aa, Homo sapiens; identical to SEQ ID NO: 1655
  variant (1)...(99): Xaa = Any amino acid

SEQ ID NO: 1984 - protein, 50 aa, Homo sapiens; identical to SEQ ID NO: 1205

SEQ ID NO: 1985 - protein, 134 aa, Homo sapiens; identical to SEQ ID NO: 1206

SEQ ID NO: 1986 - protein, 67 aa, Homo sapiens; identical to SEQ ID NO: 1207

SEQ ID NO: 1987 - protein, 60 aa, Homo sapiens; identical to SEQ ID NO: 1208

SEQ ID NO: 1988 - protein, 64 aa, Homo sapiens; identical to SEQ ID NO: 1209

SEQ ID NO: 1989 - protein, 53 aa, Homo sapiens; identical to SEQ ID NO: 1210

SEQ ID NO: 1990 - protein, 62 aa, Homo sapiens; identical to SEQ ID NO: 1667
  variant (1)...(62): Xaa = Any amino acid

SEQ ID NO: 1991 - protein, 86 aa, Homo sapiens; identical to SEQ ID NO: 1668
  variant (1)...(86): Xaa = Any amino acid

SEQ ID NO: 1992 - protein, 185 aa, Homo sapiens
FDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPL

SEQ ID NO: 1993 - protein, 65 aa, Homo sapiens
ALVEDHLPLLPDEAAGVVAELGIFLFLHHHHLEGETSWPMTEEGDLETVTTAWLVSVLMKLGTLQ

SEQ ID NO: 1994 - protein, 112 aa, Homo sapiens
WAPCIYCRVPSFISTETNHAVVTVSRSPSSVIGHEVSPSRWWWWRKRKIPSSATTPAASSGRRGRWSSTRAHIIIISSRWRHGTPTPTRRHSVKTTSSPHGKSHWASATVIK

SEQ ID NO: 1995 - protein, 87 aa, Homo sapiens; identical to SEQ ID NO: 1348

SEQ ID NO: 1996 - protein, 55 aa, Homo sapiens; identical to SEQ ID NO: 1349

SEQ ID NO: 1997 - protein, 123 aa, Homo sapiens; identical to SEQ ID NO: 1681

SEQ ID NO: 1998 - protein, 191 aa, Homo sapiens; identical to SEQ ID NO: 1281

SEQ ID NO: 1999 - protein, 51 aa, Homo sapiens; identical to SEQ ID NO: 1282

SEQ ID NO: 2000 - protein, 51 aa, Homo sapiens; identical to SEQ ID NO: 1283

SEQ ID NO: 2001 - protein, 55 aa, Homo sapiens; identical to SEQ ID NO: 1284

SEQ ID NO: 2002 - protein, 95 aa, Homo sapiens; identical to SEQ ID NO: 1222
  variant (1)...(95): Xaa = Any amino acid

SEQ ID NO: 2003 - protein, 60 aa, Homo sapiens; identical to SEQ ID NO: 1699

SEQ ID NO: 2004 - protein, 57 aa, Homo sapiens; identical to SEQ ID NO: 1700

SEQ ID NO: 2005 - protein, 50 aa, Homo sapiens [sequence omitted]

SEQ ID NO: 2006 - protein, 53 aa, Homo sapiens; identical to SEQ ID NO: 1702

SEQ ID NO: 2007 - protein, 65 aa, Homo sapiens; identical to SEQ ID NO: 1703

SEQ ID NO: 2008 - protein, 64 aa, Homo sapiens [sequence omitted]

SEQ ID NO: 2009 - protein, 52 aa, Homo sapiens; identical to SEQ ID NO: 1705

SEQ ID NO: 2010 - protein, 67 aa, Homo sapiens; identical to SEQ ID NO: 1706

SEQ ID NO: 2011 - protein, 58 aa, Homo sapiens; identical to SEQ ID NO: 1710

SEQ ID NO: 2012 - protein, 76 aa, Homo sapiens; identical to SEQ ID NO: 1337

SEQ ID NO: 2013 - protein, 63 aa, Homo sapiens; identical to SEQ ID NO: 1712

SEQ ID NO: 2014 - protein, 156 aa, Homo sapiens; identical to SEQ ID NO: 1713

SEQ ID NO: 2015 - protein, 62 aa, Homo sapiens; identical to SEQ ID NO: 1248
  variant (1)...(62): Xaa = Any amino acid

SEQ ID NO: 2016 - protein, 86 aa, Homo sapiens; identical to SEQ ID NO: 1249
  variant (1)...(86): Xaa = Any amino acid

SEQ ID NO: 2017 - protein, 69 aa, Homo sapiens [sequence omitted]

SEQ ID NO: 2018 - protein, 102 aa, Homo sapiens; identical to SEQ ID NO: 1251

SEQ ID NO: 2019 - protein, 77 aa, Homo sapiens [sequence omitted]

SEQ ID NO: 2020 - protein, 60 aa, Homo sapiens [sequence omitted]

SEQ ID NO: 2021 - protein, 115 aa, Homo sapiens
  variant (1)...(115): Xaa = Any amino acid
PMWLVFSLQLARFHTLTSLSQPQETMIGLLLLGEKRTQDTHSEWLSSWTVYLHTPRVFHSLMVLSRDPXTICRLSEEKATLXTSLAWPTNXXVVVPVVRSQRRRVPSQEPERANW

SEQ ID NO: 2022 - protein, 50 aa, Homo sapiens
  variant (1)...(50): Xaa = Any amino acid
LDGFISRSXDNLPVVRGEGHTXHILGMAHKSXXGGARCEIPEAQGSIPGA

SEQ ID NO: 2023 - protein, 114 aa, Homo sapiens
  variant (1)...(114): Xaa = Any amino acid
QFALSGSWDGTLRLWDLTTGTTXXRFVGHAKDVXSVAFSSDNRQIVXGSRDKTIKLWNTLGVCKYTVQDESHSEWVSCVRFSPNSSNPIIVSCGWDKLVKVWNLANCKLKTNHI

SEQ ID NO: 2024 - protein, 74 aa, Homo sapiens
  variant (1)...(74): Xaa = Any amino acid
VWPSPLTTGRLSXDLEIKPSSYGIPWVCANTLSRMRATQSGCLVSASRPTAATLSSSPVAGTSWSRYGTWLTAS

SEQ ID NO: 2025 - protein, 62 aa, Homo sapiens; identical to SEQ ID NO: 1743

SEQ ID NO: 2026 - protein, 116 aa, Homo sapiens; identical to SEQ ID NO: 1744

SEQ ID NO: 2027 - protein, 87 aa, Homo sapiens; identical to SEQ ID NO: 1515

SEQ ID NO: 2028 - protein, 113 aa, Homo sapiens [sequence omitted]

SEQ ID NO: 2029 - protein, 79 aa, Homo sapiens; identical to SEQ ID NO: 1517

SEQ ID NO: 2030 - protein, 52 aa, Homo sapiens; identical to SEQ ID NO: 1748

SEQ ID NO: 2031 - protein, 115 aa, Homo sapiens; identical to SEQ ID NO: 1749

SEQ ID NO: 2032 - protein, 52 aa, Homo sapiens; identical to SEQ ID NO: 1750

SEQ ID NO: 2033 - protein, 56 aa, Homo sapiens; identical to SEQ ID NO: 1751

SEQ ID NO: 2034 - protein, 86 aa, Homo sapiens; identical to SEQ ID NO: 1221

SEQ ID NO: 2035 - protein, 62 aa, Homo sapiens; identical to SEQ ID NO: 1220

SEQ ID NO: 2036 - protein, 191 aa, Homo sapiens; identical to SEQ ID NO: 1281

SEQ ID NO: 2037 - protein, 51 aa, Homo sapiens; identical to SEQ ID NO: 1282

SEQ ID NO: 2038 - protein, 51 aa, Homo sapiens; identical to SEQ ID NO: 1283

SEQ ID NO: 2039 - protein, 55 aa, Homo sapiens; identical to SEQ ID NO: 1284

SEQ ID NO: 2040 - protein, 87 aa, Homo sapiens; identical to SEQ ID NO: 1515

SEQ ID NO: 2041 - protein, 113 aa, Homo sapiens [sequence omitted]

SEQ ID NO: 2042 - protein, 79 aa, Homo sapiens; identical to SEQ ID NO: 1517

SEQ ID NO: 2043 - protein, 106 aa, Homo sapiens; identical to SEQ ID NO: 1289

SEQ ID NO: 2044 - protein, 53 aa, Homo sapiens; identical to SEQ ID NO: 1290

SEQ ID NO: 2045 - protein, 55 aa, Homo sapiens; identical to SEQ ID NO: 1144

SEQ ID NO: 2046 - protein, 51 aa, Homo sapiens; identical to SEQ ID NO: 1292

SEQ ID NO: 2047 - protein, 51 aa, Homo sapiens; identical to SEQ ID NO: 1145

SEQ ID NO: 2048 - protein, 78 aa, Homo sapiens; identical to SEQ ID NO: 1307

SEQ ID NO: 2049 - protein, 134 aa, Homo sapiens [sequence omitted]

SEQ ID NO: 2050 - protein, 66 aa, Homo sapiens; identical to SEQ ID NO: 1309

SEQ ID NO: 2051 - protein, 141 aa, Homo sapiens; identical to SEQ ID NO: 1310

SEQ ID NO: 2052 - protein, 61 aa, Homo sapiens; identical to SEQ ID NO: 1311

SEQ ID NO: 2053 - protein, 51 aa, Homo sapiens; identical to SEQ ID NO: 1312

SEQ ID NO: 2054 - protein, 192 aa, Homo sapiens; identical to SEQ ID NO: 1790

SEQ ID NO: 2055 - protein, 75 aa, Homo sapiens [sequence omitted]

SEQ ID NO: 2056 - protein, 64 aa, Homo sapiens; identical to SEQ ID NO: 1792

SEQ ID NO: 2057 - protein, 104 aa, Homo sapiens [sequence omitted]

SEQ ID NO: 2058 - protein, 71 aa, Homo sapiens; identical to SEQ ID NO: 1794

SEQ ID NO: 2059 - protein, 115 aa, Homo sapiens; identical to SEQ ID NO: 1143

SEQ ID NO: 2060 - protein, 55 aa, Homo sapiens; identical to SEQ ID NO: 1144

SEQ ID NO: 2061 - protein, 51 aa, Homo sapiens; identical to SEQ ID NO: 1145

SEQ ID NO: 2062 - protein, 59 aa, Homo sapiens; identical to SEQ ID NO: 1321

SEQ ID NO: 2063 - protein, 64 aa, Homo sapiens; identical to SEQ ID NO: 1322

SEQ ID NO: 2064 - protein, 57 aa, Homo sapiens; identical to SEQ ID NO: 1323

SEQ ID NO: 2065 - protein, 51 aa, Homo sapiens; identical to SEQ ID NO: 1324

SEQ ID NO: 2066 - protein, 50 aa, Homo sapiens; identical to SEQ ID NO: 1332

SEQ ID NO: 2067 - protein, 51 aa, Homo sapiens; identical to SEQ ID NO: 1333

SEQ ID NO: 2068 - protein, 66 aa, Homo sapiens; identical to SEQ ID NO: 1811

SEQ ID NO: 2069 - protein, 83 aa, Homo sapiens; identical to SEQ ID NO: 1812

SEQ ID NO: 2070 - protein, 82 aa, Homo sapiens; identical to SEQ ID NO: 1813

SEQ ID NO: 2071 - protein, 53 aa, Homo sapiens; identical to SEQ ID NO: 1814

SEQ ID NO: 2072 - protein, 63 aa, Homo sapiens; identical to SEQ ID NO: 1818
  variant (1)...(63): Xaa = Any amino acid

SEQ ID NO: 2073 - protein, 70 aa, Homo sapiens; identical to SEQ ID NO: 1819
  variant (1)...(70): Xaa = Any amino acid

SEQ ID NO: 2074 - protein, 76 aa, Homo sapiens; identical to SEQ ID NO: 1820
  variant (1)...(76): Xaa = Any amino acid

SEQ ID NO: 2075 - protein, 67 aa, Homo sapiens
  variant (1)...(67): Xaa = Any amino acid
EXSSQPTVPIVGIIAGLVLLGAVITGAVVAAVMWRRNSSDRKGGSYSQAASSDSAQGSDVSLTACKV

SEQ ID NO: 2076 - protein, 70 aa, Homo sapiens; identical to SEQ ID NO: 1821

SEQ ID NO: 2077 - protein, 70 aa, Homo sapiens; identical to SEQ ID NO: 1822

SEQ ID NO: 2078 - protein, 64 aa, Homo sapiens; identical to SEQ ID NO: 1823

SEQ ID NO: 2079 - protein, 90 aa, Homo sapiens; identical to SEQ ID NO: 1334

SEQ ID NO: 2080 - protein, 52 aa, Homo sapiens; identical to SEQ ID NO: 1335

SEQ ID NO: 2081 - protein, 74 aa, Homo sapiens; identical to SEQ ID NO: 1505

SEQ ID NO: 2082 - protein, 66 aa, Homo sapiens; identical to SEQ ID NO: 1825

SEQ ID NO: 2083 - protein, 60 aa, Homo sapiens; identical to SEQ ID NO: 1340

SEQ ID NO: 2084 - protein, 95 aa, Homo sapiens; identical to SEQ ID NO: 1341

SEQ ID NO: 2085 - protein, 50 aa, Homo sapiens; identical to SEQ ID NO: 1342

SEQ ID NO: 2086 - protein, 62 aa, Homo sapiens; identical to SEQ ID NO: 1830

SEQ ID NO: 2087 - protein, 94 aa, Homo sapiens; identical to SEQ ID NO: 1831

SEQ ID NO: 2088 - protein, 76 aa, Homo sapiens; identical to SEQ ID NO: 1346

SEQ ID NO: 2089 - protein, 68 aa, Homo sapiens; identical to SEQ ID NO: 1347

SEQ ID NO: 2090 - protein, 87 aa, Homo sapiens; identical to SEQ ID NO: 1348

SEQ ID NO: 2091 - protein, 55 aa, Homo sapiens; identical to SEQ ID NO: 1349

SEQ ID NO: 2092 - protein, 120 aa, Homo sapiens; identical to SEQ ID NO: 1350

SEQ ID NO: 2093 - protein, 50 aa, Homo sapiens; identical to SEQ ID NO: 1368

SEQ ID NO: 2094 - protein, 93 aa, Homo sapiens; identical to SEQ ID NO: 1369

SEQ ID NO: 2095 - protein, 65 aa, Homo sapiens; identical to SEQ ID NO: 1370

SEQ ID NO: 2096 - protein, 73 aa, Homo sapiens; identical to SEQ ID NO: 1375

SEQ ID NO: 2097 - protein, 52 aa, Homo sapiens; identical to SEQ ID NO: 1376

SEQ ID NO: 2098 - protein, 64 aa, Homo sapiens; identical to SEQ ID NO: 1377

SEQ ID NO: 2099 - protein, 55 aa, Homo sapiens; identical to SEQ ID NO: 1378

SEQ ID NO: 2100 - protein, 87 aa, Homo sapiens; identical to SEQ ID NO: 1348

SEQ ID NO: 2101 - protein, 55 aa, Homo sapiens; identical to SEQ ID NO: 1349

SEQ ID NO: 2102 - protein, 50 aa, Homo sapiens
TLIIFVHFLQLFQGLLWWRLIIELAVQLIIVILLHMWLWGFFSHSDLFIQ

SEQ ID NO: 2103 - protein, 123 aa, Homo sapiens; identical to SEQ ID NO: 1681

SEQ ID NO: 2104 - protein, 69 aa, Homo sapiens; identical to SEQ ID NO: 1379

SEQ ID NO: 2105 - protein, 66 aa, Homo sapiens; identical to SEQ ID NO: 1380

SEQ ID NO: 2106 - protein, 58 aa, Homo sapiens [sequence omitted]

SEQ ID NO: 2107 - protein, 109 aa, Homo sapiens; identical to SEQ ID NO: 674

SEQ ID NO: 2108 - protein, 100 aa, Homo sapiens; identical to SEQ ID NO: 675

SEQ ID NO: 2109 - protein, 103 aa, Homo sapiens [sequence omitted]

SEQ ID NO: 2110 - protein, 55 aa, Homo sapiens; identical to SEQ ID NO: 1385

SEQ ID NO: 2111 - protein, 97 aa, Homo sapiens; identical to SEQ ID NO: 1386

SEQ ID NO: 2112 - protein, 55 aa, Homo sapiens; identical to SEQ ID NO: 791

SEQ ID NO: 2113 - protein, 89 aa, Homo sapiens; identical to SEQ ID NO: 677

SEQ ID NO: 2114 - protein, 89 aa, Homo sapiens; identical to SEQ ID NO: 678

SEQ ID NO: 2115 - protein, 59 aa, Homo sapiens; identical to SEQ ID NO: 679

SEQ ID NO: 2116 - protein, 71 aa, Homo sapiens; identical to SEQ ID NO: 696
  variant (1)...(71): Xaa = Any amino acid

SEQ ID NO: 2117 - protein, 97 aa, Homo sapiens; identical to SEQ ID NO: 697
  variant (1)...(97): Xaa = Any amino acid

SEQ ID NO: 2118 - protein, 52 aa, Homo sapiens; identical to SEQ ID NO: 698
  variant (1)...(52): Xaa = Any amino acid

SEQ ID NO: 2119 - protein, 70 aa, Homo sapiens; identical to SEQ ID NO: 699

SEQ ID NO: 2120 - protein, 97 aa, Homo sapiens; identical to SEQ ID NO: 700
  variant (1)...(97): Xaa = Any amino acid

SEQ ID NO: 2121 - protein, 72 aa, Homo sapiens [sequence omitted]

SEQ ID NO: 2122 - protein, 51 aa, Homo sapiens; identical to SEQ ID NO: 702

SEQ ID NO: 2123 - protein, 53 aa, Homo sapiens [sequence omitted]

SEQ ID NO: 2124 - protein, 67 aa, Homo sapiens; identical to SEQ ID NO: 1402
  variant (1)...(67): Xaa = Any amino acid

SEQ ID NO: 2125 - protein, 56 aa, Homo sapiens; identical to SEQ ID NO: 712

SEQ ID NO: 2126 - protein, 56 aa, Homo sapiens; identical to SEQ ID NO: 713

SEQ ID NO: 2127 - protein, 56 aa, Homo sapiens; identical to SEQ ID NO: 714

SEQ ID NO: 2128 - protein, 56 aa, Homo sapiens; identical to SEQ ID NO: 729

SEQ ID NO: 2129 - protein, 50 aa, Homo sapiens; identical to SEQ ID NO: 730

SEQ ID NO: 2130 - protein, 70 aa, Homo sapiens; identical to SEQ ID NO: 731

SEQ ID NO: 2131 - protein, 53 aa, Homo sapiens; identical to SEQ ID NO: 732

SEQ ID NO: 2132 - protein, 56 aa, Homo sapiens; identical to SEQ ID NO: 792

SEQ ID NO: 2133 - protein, 177 aa, Homo sapiens; identical to SEQ ID NO: 793
  variant (1)...(177): Xaa = Any amino acid

SEQ ID NO: 2134 - protein, 56 aa, Homo sapiens; identical to SEQ ID NO: 794

SEQ ID NO: 2135 - protein, 70 aa, Homo sapiens [sequence omitted]

SEQ ID NO: 2136 - protein, 53 aa, Homo sapiens; identical to SEQ ID NO: 796

SEQ ID NO: 2137 - protein, 146 aa, Homo sapiens [sequence omitted]

SEQ ID NO: 2138 - protein, 58 aa, Homo sapiens; identical to SEQ ID NO: 798

SEQ ID NO: 2139 - protein, 110 aa, Homo sapiens; identical to SEQ ID NO: 799

SEQ ID NO: 2140 - protein, 110 aa, Homo sapiens; identical to SEQ ID NO: 800

SEQ ID NO: 2141 - protein, 70 aa, Homo sapiens; identical to SEQ ID NO: 801

SEQ ID NO: 2142 - protein, 71 aa, Homo sapiens; identical to SEQ ID NO: 813

SEQ ID NO: 2143 - protein, 124 aa, Homo sapiens; identical to SEQ ID NO: 814

SEQ ID NO: 2144 - protein, 51 aa, Homo sapiens [sequence omitted]

SEQ ID NO: 2145 - protein, 51 aa, Homo sapiens
PRLIASRGSPSADQLNTNFFLLFSTWFGKSHSFQAPSVWRKYILKHPQFTF

SEQ ID NO: 2146 - protein, 66 aa, Homo sapiens; identical to SEQ ID NO: 822

SEQ ID NO: 2147 - protein, 75 aa, Homo sapiens; identical to SEQ ID NO: 823

SEQ ID NO: 2148 - protein, 59 aa, Homo sapiens; identical to SEQ ID NO: 824

SEQ ID NO: 2149 - protein, 94 aa, Homo sapiens; identical to SEQ ID NO: 844
  variant (1)...(94): Xaa = Any amino acid

SEQ ID NO: 2150 - protein, 57 aa, Homo sapiens; identical to SEQ ID NO: 845

SEQ ID NO: 2151 - protein, 93 aa, Homo sapiens; identical to SEQ ID NO: 846
  variant (1)...(93): Xaa = Any amino acid

SEQ ID NO: 2152 - protein, 121 aa, Homo sapiens; identical to SEQ ID NO: 847
  variant (1)...(121): Xaa = Any amino acid

SEQ ID NO: 2153 - protein, 54 aa, Homo sapiens; identical to SEQ ID NO: 848
  variant (1)...(54): Xaa = Any amino acid

SEQ ID NO: 2154 - protein, 59 aa, Homo sapiens; identical to SEQ ID NO: 849

SEQ ID NO: 2155 - protein, 67 aa, Homo sapiens; identical to SEQ ID NO: 850
  variant (1)...(67): Xaa = Any amino acid

SEQ ID NO: 2156 - protein, 55 aa, Homo sapiens; identical to SEQ ID NO: 851
  variant (1)...(55): Xaa = Any amino acid

SEQ ID NO: 2157 - protein, 123 aa, Homo sapiens; identical to SEQ ID NO: 860

SEQ ID NO: 2158 - protein, 71 aa, Homo sapiens; identical to SEQ ID NO: 861

SEQ ID NO: 2159 - protein, 62 aa, Homo sapiens
  variant (1)...(62): Xaa = Any amino acid
DLLGGMAPPGSSTVFLLALTIIASTWALTPTHYLTKHDXERLKASLDPPFHKVGSXVFYSIX

SEQ ID NO: 2160 - protein, 53 aa, Homo sapiens
PWDGSSDHWGPGQARPGLGQQGPGQRGRASFGGVEGYILGWCLHPGVQQDLFQ

SEQ ID NO: 2161 - protein, 83 aa, Homo sapiens [sequence omitted]

SEQ ID NO: 2162 - protein, 115 aa, Homo sapiens [sequence omitted]

SEQ ID NO: 2163 - protein, 165 aa, Homo sapiens
  variant (1)...(165): Xaa = Any amino acid
WQPSSTAISRXVVHRDIKDEXILIDLRRGCAKLIDFGSGALLHDEPYTDFDGTRVYSPPEWISRHQYHALPATVWSLGILLYDMVCGDIPFERDQEILEAELHFPSPCFPQDCCALIRRCLAPKPSSRPSLEEILLDPWMQTPAEDVPLNPSKGGPAPLAWSLLP

SEQ ID NO: 2164 - protein, 91 aa, Homo sapiens [sequence omitted]

SEQ ID NO: 2165 - protein, 66 aa, Homo sapiens [sequence omitted]

SEQ ID NO: 2166 - protein, 82 aa, Homo sapiens [sequence omitted]

SEQ ID NO: 2167 - protein, 118 aa, Homo sapiens; identical to SEQ ID NO: 883

SEQ ID NO: 2168 - protein, 66 aa, Homo sapiens; identical to SEQ ID NO: 884

SEQ ID NO: 2169 - protein, 86 aa, Homo sapiens
  variant (1)...(86): Xaa = Any amino acid
QVVAXIQHCHSRGVVHRDIKDENILIDLRRGCAKLIDFGSGALLHDEPYTDFDGTRVYSPPEWISRHQYHALPATVWSLGIXLYDM

SEQ ID NO: 2170 - protein, 60 aa, Homo sapiens
  variant (1)...(60): Xaa = Any amino acid
TYAVAVPNSLILVLVPCFMMNPTLTLMGQGCTAPQSGSLDTSTMHSRPLSGHWASXSMTW

SEQ ID NO: 2171 - protein, 51 aa, Homo sapiens
  variant (1)...(51): Xaa = Any amino acid
PCHRXGCPVTRQWPGVHGTGVERSTLGGCTPLSHQSQCRVHHEAGHQNQNQ

SEQ ID NO: 2172 - protein, 121 aa, Homo sapiens; identical to SEQ ID NO: 926
  variant (1)...(121): Xaa = Any amino acid

SEQ ID NO: 2173 - protein, 71 aa, Homo sapiens; identical to SEQ ID NO: 927
  variant (1)...(71): Xaa = Any amino acid

SEQ ID NO: 2174 - protein, 122 aa, Homo sapiens; identical to SEQ ID NO: 985

SEQ ID NO: 2175 - protein, 69 aa, Homo sapiens; identical to SEQ ID NO: 986

SEQ ID NO: 2176 - protein, 64 aa, Homo sapiens
ETTWAPPVTPVSGAPTCVLRCRNCRWKLPTSSWVPLAVCLICLTGDTCPPNTSRCLYWMKLTKC

SEQ ID NO: 2177 - protein, 179 aa, Homo sapiens
LVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTR

SEQ ID NO: 2178 - protein, 64 aa, Homo sapiens
HFVSFIQYKHLDVFGGQVSPVKHIKHTARGTHDDVGSFHLQFLHLSTHVGAPDTGVTGGAHVVS

SEQ ID NO: 2179 - protein, 52 aa, Homo sapiens
NWRIPSRVNSSFLTRIRMGSLMNFLVTSSTSEGIVADSKTTWVLLLSFWNMS

SEQ ID NO: 2180 - protein, 64 aa, Homo sapiens
IWSLNPRLNISSASSSTNILMYLGDRYLRLSISNTRPGVPTMMWGASICSFCTSARTLVPPIQA

SEQ ID NO: 2181 - protein, 134 aa, Homo sapiens
  variant (1)...(134): Xaa = Any amino acid
VIVRLEAFAVDDGGAGLVILLLADPHLLEGGQRGQDGAADPHGVLALRRSNDLDLHXAGCQGXDLLLHPVXNARVHGGAARQHXVGVQVFADVHVTLHDGVEGSFVDATGLHAQEGRLXXCLRAAEPLIANGDD

SEQ ID NO: 2182 - protein, 129 aa, Homo sapiens
  variant (1)...(129): Xaa = Any amino acid
KHLRWTMEGPDSSYSCLLIHICWKVDSEARMEPPIHTEYLRSGGAMILIFIXLGARAXISFCILSXMPGYMVVPPDSTXLAYRSLRMSTSHFMMELKVVSWMPQDSMPRKEGXXSASGQRNRSLPMVMT

SEQ ID NO: 2183 - protein, 129 aa, Homo sapiens
  variant (1)...(129): Xaa = Any amino acid
VITIGNERFRCPEAXXQPSFLGMESCGIHETTFNSIMKCDVDIRKDLYANXVLSGGTTMYPGIXDRMQKEIXALAPSXMKIKIIAPPERKYSVWIGGSILASLSTFQQMWISKQEYDESGPSIVHRKCF

SEQ ID NO: 2184 - protein, 55 aa, Homo sapiens
RSRSLLLLSASTPCGSAAPSWPRCPPSSRCGSASRSMTSPAPPSSTANASRRTMT

SEQ ID NO: 2185 - protein, 124 aa, Homo sapiens; identical to SEQ ID NO: 814

SEQ ID NO: 2186 - protein, 71 aa, Homo sapiens [sequence omitted]

SEQ ID NO: 2187 - protein, 64 aa, Homo sapiens; identical to SEQ ID NO: 1057
  variant (1)...(64): Xaa = Any amino acid

SEQ ID NO: 2188 - protein, 53 aa, Homo sapiens; identical to SEQ ID NO: 1058
  variant (1)...(53): Xaa = Any amino acid

SEQ ID NO: 2189 - protein, 51 aa, Homo sapiens; identical to SEQ ID NO: 1059
  variant (1)...(51): Xaa = Any amino acid

SEQ ID NO: 2190 - protein, 64 aa, Homo sapiens; identical to SEQ ID NO: 1060
  variant (1)...(64): Xaa = Any amino acid

SEQ ID NO: 2191 - protein, 94 aa, Homo sapiens [sequence omitted]

SEQ ID NO: 2192 - protein, 61 aa, Homo sapiens [sequence omitted]

SEQ ID NO: 2193 - protein, 58 aa, Homo sapiens; identical to SEQ ID NO: 1083
  variant (1)...(58): Xaa = Any amino acid

SEQ ID NO: 2194 - protein, 139 aa, Homo sapiens; identical to SEQ ID NO: 1084
  variant (1)...(139): Xaa = Any amino acid

SEQ ID NO: 2195 - protein, 123 aa, Homo sapiens; identical to SEQ ID NO: 1092

SEQ ID NO: 2196 - protein, 71 aa, Homo sapiens; identical to SEQ ID NO: 813

SEQ ID NO: 2197 - protein, 71 aa, Homo sapiens; identical to SEQ ID NO: 813

SEQ ID NO: 2198 - protein, 124 aa, Homo sapiens; identical to SEQ ID NO: 814

SEQ ID NO: 2199 - protein, 85 aa, Homo sapiens; identical to SEQ ID NO: 1132
  variant (1)...(85): Xaa = Any amino acid

SEQ ID NO: 2200 - protein, 56 aa, Homo sapiens; identical to SEQ ID NO: 1133

SEQ ID NO: 2201 - protein, 70 aa, Homo sapiens; identical to SEQ ID NO: 1134
  variant (1)...(70): Xaa = Any amino acid

SEQ ID NO: 2202 - protein, 82 aa, Homo sapiens; identical to SEQ ID NO: 1135
  variant (1)...(82): Xaa = Any amino acid

SEQ ID NO: 2203 - protein, 56 aa, Homo sapiens; identical to SEQ ID NO: 1136

SEQ ID NO: 2204 - protein, 57 aa, Homo sapiens; identical to SEQ ID NO: 1149

SEQ ID NO: 2205 - protein, 78 aa, Homo sapiens; identical to SEQ ID NO: 1150

SEQ ID NO: 2206 - protein, 63 aa, Homo sapiens
YCKGPLEFLKWLHRIEIISNNCKGTENLHRDEVGFPLGALKFDNKSSTSTGQYIDFGCLRPQD

SEQ ID NO: 2207 - protein, 87 aa, Homo sapiens
TLKYFIIGGNLWRLVASNLGASDTQNLYIDQWKLMICYQISKHLMETPLHLCEDFQFLYSYLKLFQFCGATSETPMGLCNIKMWRMH

SEQ ID NO: 2208 - protein, 174 aa, Homo sapiens; identical to SEQ ID NO: 1158

SEQ ID NO: 2209 - protein, 56 aa, Homo sapiens; identical to SEQ ID NO: 794

SEQ ID NO: 2210 - protein, 52 aa, Homo sapiens; identical to SEQ ID NO: 1160

SEQ ID NO: 2211 - protein, 54 aa, Homo sapiens; identical to SEQ ID NO: 1161

SEQ ID NO: 2212 - protein, 70 aa, Homo sapiens; identical to SEQ ID NO: 1162

SEQ ID NO: 2213 - protein, 50 aa, Homo sapiens; identical to SEQ ID NO: 1163

SEQ ID NO: 2214 - protein, 143 aa, Homo sapiens; identical to SEQ ID NO: 1164

SEQ ID NO: 2215 - protein, 115 aa, Homo sapiens; identical to SEQ ID NO: 1143

SEQ ID NO: 2216 - protein, 55 aa, Homo sapiens; identical to SEQ ID NO: 1144

SEQ ID NO: 2217 - protein, 51 aa, Homo sapiens; identical to SEQ ID NO: 1145

SEQ ID NO: 2218 - protein, 117 aa, Homo sapiens; identical to SEQ ID NO: 1170

SEQ ID NO: 2219 - protein, 117 aa, Homo sapiens; identical to SEQ ID NO: 1171

SEQ ID NO: 2220 - protein, 83 aa, Homo sapiens; identical to SEQ ID NO: 1172

SEQ ID NO: 2221 - protein, 70 aa, Homo sapiens; identical to SEQ ID NO: 1195
  variant (1)...(70): Xaa = Any amino acid

SEQ ID NO: 2222 - protein, 63 aa, Homo sapiens; identical to SEQ ID NO: 1196
  variant (1)...(63): Xaa = Any amino acid

SEQ ID NO: 2223 - protein, 50 aa, Homo sapiens; identical to SEQ ID NO: 1197
  variant (1)...(50): Xaa = Any amino acid

SEQ ID NO: 2224 - protein, 92 aa, Homo sapiens; identical to SEQ ID NO: 1198
  variant (1)...(92): Xaa = Any amino acid

SEQ ID NO: 2225 - protein, 50 aa, Homo sapiens; identical to SEQ ID NO: 1205

SEQ ID NO: 2226 - protein, 134 aa, Homo sapiens; identical to SEQ ID NO: 1206

SEQ ID NO: 2227 - protein, 67 aa, Homo sapiens; identical to SEQ ID NO: 1207

SEQ ID NO: 2228 - protein, 60 aa, Homo sapiens; identical to SEQ ID NO: 1208

SEQ ID NO: 2229 - protein, 64 aa, Homo sapiens; identical to SEQ ID NO: 1209

SEQ ID NO: 2230 - protein, 53 aa, Homo sapiens; identical to SEQ ID NO: 1210

SEQ ID NO: 2231 - protein, 185 aa, Homo sapiens; identical to SEQ ID NO: 1992

SEQ ID NO: 2232 - protein, 65 aa, Homo sapiens; identical to SEQ ID NO: 1993

SEQ ID NO: 2233 - protein, 112 aa, Homo sapiens; identical to SEQ ID NO: 1994

SEQ ID NO: 2234 - protein, 199 aa, Homo sapiens; identical to SEQ ID NO: 1216

SEQ ID NO: 2235 - protein, 76 aa, Homo sapiens; identical to SEQ ID NO: 1217

SEQ ID NO: 2236 - protein, 122 aa, Homo sapiens; identical to SEQ ID NO: 1218

SEQ ID NO: 2237 - protein, 56 aa, Homo sapiens; identical to SEQ ID NO: 1219

SEQ ID NO: 2238 - protein, 50 aa, Homo sapiens
LREGSGWVRGDGEGKGGVSIFILRIGVQSTSGVSAPPCPPVGLRRTGKRT

SEQ ID NO: 2239 - protein, 50 aa, Homo sapiens
RALTESSRNSGTVSRGPALHGPGPPPSPSPRPEPRATRSAAAAAWPGTIS

SEQ ID NO: 2240 - protein, 55 aa, Homo sapiens
  variant (1)...(55): Xaa = Any amino acid
SRPPALPGSTSPVHVLILHFAFYHKIFLWPGAFGPSASSCHQRGPSGSTWRPXVQ

SEQ ID NO: 2241 - protein, 75 aa, Homo sapiens
QRAAETLELFPEGLHCMDQGHHLLLHPGQNPVPPGLQPLQHGLEPSHDLVTKALPRLLGCGILNIRDRGSVASAP

SEQ ID NO: 2242 - protein, 103 aa, Homo sapiens
DWKEDMKSSDREQQKLWNCFQRACTAWTRATTFSFTQARTPCHQVCSRCSMAWNHLMTLSQKLSPGSSVAGSSTSGTGDLLPRHRNPSLSFSSRGVSSRCCSS

SEQ ID NO: 2243 - protein, 76 aa, Homo sapiens
QGHEMVPGHAAAAADLVARGSGLGEGEGGGPGPCSAGPLETVPEFLLLSVRALHVLFPVLRSPTGGQGGADTPEVL

SEQ ID NO: 2244 - protein, 194 aa, Homo sapiens
  variant (1)...(194): Xaa = Any amino acid
LEXLAAMCFPKVLSDDMKKLKARMHQAIERFYDKMQNAESGRGQVMSSLAELEDDFKEGYLETVAAYYEEQHLELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 2245 - protein, 87 aa, Homo sapiens; identical to SEQ ID NO: 1348

SEQ ID NO: 2246 - protein, 55 aa, Homo sapiens; identical to SEQ ID NO: 1349

SEQ ID NO: 2247 - protein, 119 aa, Homo sapiens
EKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVS

SEQ ID NO: 2248 - protein, 55 aa, Homo sapiens; identical to SEQ ID NO: 1237

SEQ ID NO: 2249 - protein, 54 aa, Homo sapiens; identical to SEQ ID NO: 1238

SEQ ID NO: 2250 - protein, 147 aa, Homo sapiens; identical to SEQ ID NO: 1239

SEQ ID NO: 2251 - protein, 135 aa, Homo sapiens; identical to SEQ ID NO: 1240

SEQ ID NO: 2252 - protein, 151 aa, Homo sapiens; identical to SEQ ID NO: 1241

SEQ ID NO: 2253 - protein, 60 aa, Homo sapiens [sequence omitted]

SEQ ID NO: 2254 - protein, 70 aa, Homo sapiens
  variant (1)...(70): Xaa = Any amino acid
GIRSQLSLNSQSPPWASLPNDLVALGASEVNPEILPPSTLGSDLCPSLXHKEISVKXVGTGGFRPCSKAT

SEQ ID NO: 2255 - protein, 77 aa, Homo sapiens
GERPRVGTGNLRRAGNGSLRFRKLLYKLRGWLGPKGCSARRASCELSKALGSQHPKSLWLQSCVCTTQSKGSFCFVF

SEQ ID NO: 2256 - protein, 115 aa, Homo sapiens; identical to SEQ ID NO: 1143

SEQ ID NO: 2257 - protein, 55 aa, Homo sapiens; identical to SEQ ID NO: 1144

SEQ ID NO: 2258 - protein, 51 aa, Homo sapiens; identical to SEQ ID NO: 1247
  variant (1)...(51): Xaa = Any amino acid

SEQ ID NO: 2259 - protein, 69 aa, Homo sapiens [sequence omitted]

SEQ ID NO: 2260 - protein, 102 aa, Homo sapiens; identical to SEQ ID NO: 1251

SEQ ID NO: 2261 - protein, 77 aa, Homo sapiens [sequence omitted]

SEQ ID NO: 2262 - protein, 60 aa, Homo sapiens [sequence omitted]

SEQ ID NO: 2263 - protein, 60 aa, Homo sapiens; identical to SEQ ID NO: 1778

SEQ ID NO: 2264 - protein, 55 aa, Homo sapiens
  variant (1)...(55): Xaa = Any amino acid
GIRSQLSLNSQSPPWASLPNDLVALGAPEXNPEILPPSTLGSDLCPSLCHKEISV

SEQ ID NO: 2265 - protein, 77 aa, Homo sapiens
  variant (1)...(77): Xaa = Any amino acid
GERPRVGTGNLRRAGNGSLRFRKLLCKLRGWLGPKGCSARRASCELSKALGSQHPKSLWLQSCVCXTHSKGSFCFVF

SEQ ID NO: 2266 - protein, 115 aa, Homo sapiens; identical to SEQ ID NO: 1143

SEQ ID NO: 2267 - protein, 55 aa, Homo sapiens; identical to SEQ ID NO: 1255
  variant (1)...(55): Xaa = Any amino acid

SEQ ID NO: 2268 - protein, 51 aa, Homo sapiens; identical to SEQ ID NO: 1256
  variant (1)...(51): Xaa = Any amino acid

SEQ ID NO: 2269 - protein, 101 aa, Homo sapiens; identical to SEQ ID NO: 1766

SEQ ID NO: 2270 - protein, 124 aa, Homo sapiens; identical to SEQ ID NO: 1767

SEQ ID NO: 2271 - protein, 100 aa, Homo sapiens; identical to SEQ ID NO: 1768

SEQ ID NO: 2272 - protein, 54 aa, Homo sapiens
RRTSQTDGTQAGWVLYPRSQEGRVSCTVVNRRAAWRQWLSQKVTQSSCLERESL

SEQ ID NO: 2273 - protein, 72 aa, Homo sapiens
LRIQRCWGEKSSIDSTFQDVHFGERSRWDPQENDGEHPRQMGLKQDGCYIQEAKKGEFRALWLTGGLPGGSG

SEQ ID NO: 2274 - protein, 55 aa, Homo sapiens
VPSVWDVLRHFLEGPTCSSPRNGHPGRWSLYCFSLPSNVESGVSLGSANNGCHLQ

SEQ ID NO: 2275 - protein, 74 aa, Homo sapiens
PQCTKLSLLGFLDIAPILLESHLSGMFSVIFLRVPPAPLPEMDILEGGVYTAFLSPATLNPESAWAPQTTAAIS

SEQ ID NO: 2276 - protein, 69 aa, Homo sapiens
  variant (1)...(69): Xaa = Any amino acid
SRWMEQKINLXLVRTPFWGCPLPSAKLVPLRRGSPCTATSLTWLATLKSSCQSRRSMSSMAVLMLATSW

SEQ ID NO: 2277 - protein, 120 aa, Homo sapiens
  variant (1)...(120): Xaa = Any amino acid
YEALELRDNDKTRYMGKGVSKAVEHINKTIAPALVSKKLNVTEQEKIDKLMIEMDGTENKSXFGANAILGVSLAVCKAGAVEKGVPLYRHIADLAGNSEVILPVPAFNVINGGSHAGNKL

SEQ ID NO: 2278 - protein, 100 aa, Homo sapiens
  variant (1)...(100): Xaa = Any amino acid
QLVASMRTAIDDIERRDWQDDFRVASQVSDVAVQGDPLLNGTSFADGKGHPQNGVRTKXRFIFCSIHLDHQFVNLLLFCDVQFLANQGRRNSFIDVLNSL

SEQ ID NO: 2279 - protein, 100 aa, Homo sapiens
  variant (1)...(100): Xaa = Any amino acid
EPPLMTLNAGTGRMTSELPAKSAMWRYRGTPFSTAPALQTARDTPRMAFAPXLDLFSVPSISIISLSIFSCSVTFSFLLTRAGAIVLLMCSTAFETPFPI

SEQ ID NO: 2280 - protein, 75 aa, Homo sapiens
LDNPGSGGGCKNLQKLEGAPQENKQQALFPLAHPPKNHPSHPSVWWCPVVSIFHSFPNYGSKVLLTRIRALGITE

SEQ ID NO: 2281 - protein, 51 aa, Homo sapiens
  variant (1)...(51): Xaa = Any amino acid
GPLTQKKKKKXSLGVTTGHYLPQNKESWAEAGKQLDPIWDPRLGERVPLLK

SEQ ID NO: 2282 - protein, 57 aa, Homo sapiens
NNPGRRREEGTLGTPLPTIRDYLHFSNWTIPAQEEVARICKSWRERPRRTNSKPYFP

SEQ ID NO: 2283 - protein, 68 aa, Homo sapiens
IIQAGEERRAHLELPSPQYVIIYILVIGQSRLRRRLQESAKVGGSAPGEQTASLISPSPSPKKPSIPS

SEQ ID NO: 2284 - protein, 66 aa, Homo sapiens
  variant (1)...(66): Xaa = Any amino acid
CVTPHWXLLLXPXKLSSYALTWARVLSFQYPSSFYFSKGTLSPSLGSHIGSSCLPASAQDSLFWGR

SEQ ID NO: 2285 - protein, 59 aa, Homo sapiens
FGKEWKMDTTGHHQTLGWDGWFFGGWARGNKACCLFSWGAPSNFCRFLQPPPEPGLSNY

SEQ ID NO: 2286 - protein, 50 aa, Homo sapiens
  variant (1)...(50): Xaa = Any amino acid
DSYSDDVSPHIGXSYYXHXNLVHMLLLGQGCFPSNTPVAFILVKGPFPLA

SEQ ID NO: 2287 - protein, 87 aa, Homo sapiens
  variant (1)...(87): Xaa = Any amino acid
PRVPYWVKLLTCLSPGFFILGEVMPCCYPKAXFFFFFLGEGTLLCYPKCSYSGEKNLTSIIWEGMEDGHHRTPPDTRMGWMVFWGMG

SEQ ID NO: 2288 - protein, 88 aa, Homo sapiens
TSVEPLSRGPWVPNTKIPTAERAADHLVRIPVAFISKINSPFLRLSESWVYALKKAELLDSLTSCHRVLNVSDHKGLHTFAVCSGATY

SEQ ID NO: 2289 - protein, 53 aa, Homo sapiens
VFLYWEPKVLCLVAQRLSTFPRLNACGALSTSTCSQGPPSLSSNAQDRVDLIG

SEQ ID NO: 2290 - protein, 51 aa, Homo sapiens
FSFFQGIDPRLRQPQERGVYFGYKGNRNPDQMVSSPLSSRYFCIGNPRSSA

SEQ ID NO: 2291 - protein, 81 aa, Homo sapiens
TQDSDNLKKGEFILDIKATGILTKWSAALSAVGIFVLGTQGPLLSGSTLVYLSKAQRLWSLVHKHLLPRASLPEFKRPRQS

SEQ ID NO: 2292 - protein, 125 aa, Homo sapiens; identical to SEQ ID NO: 1301

SEQ ID NO: 2293 - protein, 59 aa, Homo sapiens; identical to SEQ ID NO: 1302

SEQ ID NO: 2294 - protein, 100 aa, Homo sapiens; identical to SEQ ID NO: 1303

SEQ ID NO: 2295 - protein, 50 aa, Homo sapiens; identical to SEQ ID NO: 1304

SEQ ID NO: 2296 - protein, 131 aa, Homo sapiens; identical to SEQ ID NO: 1305

SEQ ID NO: 2297 - protein, 53 aa, Homo sapiens; identical to SEQ ID NO: 1306

SEQ ID NO: 2298 - protein, 78 aa, Homo sapiens; identical to SEQ ID NO: 1307

SEQ ID NO: 2299 - protein, 134 aa, Homo sapiens [sequence omitted]

SEQ ID NO: 2300 - protein, 66 aa, Homo sapiens; identical to SEQ ID NO: 1309

SEQ ID NO: 2301 - protein, 141 aa, Homo sapiens; identical to SEQ ID NO: 1310

SEQ ID NO: 2302 - protein, 50 aa, Homo sapiens; identical to SEQ ID NO: 2238

SEQ ID NO: 2303 - protein, 50 aa, Homo sapiens
RALTESSRNSGTVSRGPALHGPGPPPSPSPRPEPRATRPAAAAAWPGTIS

SEQ ID NO: 2304 - protein, 75 aa, Homo sapiens; identical to SEQ ID NO: 2241

SEQ ID NO: 2305 - protein, 60 aa, Homo sapiens [sequence omitted]

SEQ ID NO: 2306 - protein, 103 aa, Homo sapiens [sequence omitted]

SEQ ID NO: 2307 - protein, 177 aa, Homo sapiens
PWLLELLAAMCFPKVLSDDMKKLKARMVMSSLAELEDDFKEGYLETVAAYYEEQHPELTPLLEKERDGLRCRGNRSPVPDVEDPATEEPGESFCDKVMRWFQAMLQRLQAWWHGVLAWVKEKVVALVHAVQALWKQFQSFCCSLSELFMSSFQSYGAPRGDKEELTPQKCSEPQSSK

SEQ ID NO: 2308 - protein, 69 aa, Homo sapiens
CRAWQSWRTTSKRATWRQWRLIMRSSTQSSLLYLKKKEMDYGAEATDPLSRMLRIPQPRSLGRAFVTRS

SEQ ID NO: 2309 - protein, 76 aa, Homo sapiens
QGHEMVPGHAAAAAGLVARGSGLGEGEGGGPGPCSAGPLETVPEFLLLSVRALHVLFPVLRSPTGGQGGADTPEVL

SEQ ID NO: 2310 - protein, 50 aa, Homo sapiens; identical to SEQ ID NO: 1332

SEQ ID NO: 2311 - protein, 51 aa, Homo sapiens; identical to SEQ ID NO: 1333

SEQ ID NO: 2312 - protein, 63 aa, Homo sapiens; identical to SEQ ID NO: 1818
  variant (1)...(63): Xaa = Any amino acid

SEQ ID NO: 2313 - protein, 70 aa, Homo sapiens; identical to SEQ ID NO: 1819
  variant (1)...(70): Xaa = Any amino acid

SEQ ID NO: 2314 - protein, 76 aa, Homo sapiens; identical to SEQ ID NO: 1820
  variant (1)...(76): Xaa = Any amino acid

SEQ ID NO: 2315 - protein, 67 aa, Homo sapiens; identical to SEQ ID NO: 2075
  variant (1)...(67): Xaa = Any amino acid

SEQ ID NO: 2316 - protein, 62 aa, Homo sapiens; identical to SEQ ID NO: 1830

SEQ ID NO: 2317 - protein, 94 aa, Homo sapiens; identical to SEQ ID NO: 1831

SEQ ID NO: 2318 - protein, 76 aa, Homo sapiens; identical to SEQ ID NO: 1346

SEQ ID NO: 2319 - protein, 68 aa, Homo sapiens; identical to SEQ ID NO: 1347

SEQ ID NO: 2320 - protein, 59 aa, Homo sapiens; identical to SEQ ID NO: 1354

SEQ ID NO: 2321 - protein, 68 aa, Homo sapiens; identical to SEQ ID NO: 1355

SEQ ID NO: 2322 - protein, 58 aa, Homo sapiens
  variant (1)...(58): Xaa = Any amino acid
SATYGXQAGVVPWLSPXTSERPTLSSSPXINPETQAALIRGQDSTIAASEQQVAXXNS

SEQ ID NO: 2323 - protein, 60 aa, Homo sapiens
  variant (1)...(60): Xaa = Any amino acid
QHQNSKWXXRILDSXDXATVNPVEFNTEVATPPFSLLXTSNETXFLIGINEEXLEGXAIY

SEQ ID NO: 2324 - protein, 67 aa, Homo sapiens
  variant (1)...(67): Xaa = Any amino acid
IDCXAFQXLFINANQEXCFIRSXQKGKWWCCNLSIKFHRVYCCXIXGIKNSXXPLAVLMLLSWNPAL

SEQ ID NO: 2325 - protein, 158 aa, Homo sapiens; identical to SEQ ID NO: 1356
  variant (1)...(158): Xaa = Any amino acid

SEQ ID NO: 2326 - protein, 68 aa, Homo sapiens; identical to SEQ ID NO: 1357
  variant (1)...(68): Xaa = Any amino acid

SEQ ID NO: 2327 - protein, 64 aa, Homo sapiens; identical to SEQ ID NO: 1358
  variant (1)...(64): Xaa = Any amino acid

SEQ ID NO: 2328 - protein, 103 aa, Homo sapiens; identical to SEQ ID NO: 1359
  variant (1)...(103): Xaa = Any amino acid

SEQ ID NO: 2329 - protein, 123 aa, Homo sapiens; identical to SEQ ID NO: 1360
  variant (1)...(123): Xaa = Any amino acid

SEQ ID NO: 2330 - protein, 68 aa, Homo sapiens; identical to SEQ ID NO: 1347

SEQ ID NO: 2331 - protein, 64 aa, Homo sapiens; identical to SEQ ID NO: 1362
  variant (1)...(64): Xaa = Any amino acid

SEQ ID NO: 2332 - protein, 104 aa, Homo sapiens; identical to SEQ ID NO: 1363
  variant (1)...(104): Xaa = Any amino acid

SEQ ID NO: 2333 - protein, 73 aa, Homo sapiens [sequence omitted]

SEQ ID NO: 2334 - protein, 66 aa, Homo sapiens [sequence omitted]

SEQ ID NO: 2335 - protein, 59 aa, Homo sapiens
ALWADLPLTYYSRSAVTSWDLPLPASIPKSSPAITVGMSTQKLSQPHQDSCEKRGYVHT

SEQ ID NO: 2336 - protein, 68 aa, Homo sapiens
  variant (1)...(68): Xaa = Any amino acid
VEDXTPIPCRSIGRSKVSSMGRSTPYLLFQICSHFVGSAPPCFNTQILSSYNSRDEYPKAQPAPSGLL

SEQ ID NO: 2337 - protein, 58 aa, Homo sapiens
AQLGSECKKLSMVREACALIQVYSTLSGDQNPLLITPLQRGDWALPLFDKPLTQVLTP

SEQ ID NO: 2338 - protein, 68 aa, Homo sapiens; identical to SEQ ID NO: 1371
  variant (1)...(68): Xaa = Any amino acid

SEQ ID NO: 2339 - protein, 143 aa, Homo sapiens; identical to SEQ ID NO: 1372
  variant (1)...(143): Xaa = Any amino acid

SEQ ID NO: 2340 - protein, 64 aa, Homo sapiens; identical to SEQ ID NO: 1373
  variant (1)...(64): Xaa = Any amino acid

SEQ ID NO: 2341 - protein, 103 aa, Homo sapiens; identical to SEQ ID NO: 1374
  variant (1)...(103): Xaa = Any amino acid

SEQ ID NO: 2342 - protein, 162 aa, Homo sapiens
  variant (1)...(162): Xaa = Any amino acid
QMHLWAGGDLGLCWNWISELLLHLFSSHPGLFRAAVPSGASTGIYEALELRDNDKTRYMGKGVSKAVEHXNKTIAPALVSKKLNVTEQEKIDKLMIEMDGTENKSKFGANAILGVSLAVCKAGAVEKGVPLYRHIADLAGNSEVILPVPAFNVINGXSHAGN

SEQ ID NO: 2343 - protein, 55 aa, Homo sapiens
RKKQLPNDKCICGREGTWDCAGTGFLNCYYIFFPLIQVSSELLCPVVLQLVSMRP

SEQ ID NO: 2344 - protein, 66 aa, Homo sapiens
  variant (1)...(66): Xaa = Any amino acid
SRWMEQKINLSLVRTPFWGCPLPSAKLVPLRRGSPCTATSLTWLATLKSSCQSRRSMSSMAXLMLA

SEQ ID NO: 2345 - protein, 98 aa, Homo sapiens
  variant (1)...(98): Xaa = Any amino acid
VASMRXAIDDIERRDWQDDFRVASQVSDVAVQGDPLLNGTSFADGKGHPQNGVRTKLRFIFCSIHLDHQFVNLLLFCDVQFLANQGRRNSFIXVLNSL

SEQ ID NO: 2346 - protein, 100 aa, Homo sapiens
  variant (1)...(100): Xaa = Any amino acid
XPPLMTLNAGTGRMTSELPAKSAMWRYRGTPFSTAPALQTARDTPRMAFAPNLDLFSVPSISIISLSIFSCSVTFSFLLTRAGAIVLXMCSTAFETPFPI

SEQ ID NO: 2347 - protein, 73 aa, Homo sapiens; identical to SEQ ID NO: 1375

SEQ ID NO: 2348 - protein, 52 aa, Homo sapiens; identical to SEQ ID NO: 1376

SEQ ID NO: 2349 - protein, 64 aa, Homo sapiens; identical to SEQ ID NO: 1377

SEQ ID NO: 2350 - protein, 55 aa, Homo sapiens; identical to SEQ ID NO: 1378

SEQ ID NO: 2351 - protein, 87 aa, Homo sapiens; identical to SEQ ID NO: 1348

SEQ ID NO: 2352 - protein, 55 aa, Homo sapiens; identical to SEQ ID NO: 1349

SEQ ID NO: 2353 - protein, 50 aa, Homo sapiens; identical to SEQ ID NO: 2102

SEQ ID NO: 2354 - protein, 123 aa, Homo sapiens; identical to SEQ ID NO: 1681

SEQ ID NO: 2355 - protein, 69 aa, Homo sapiens; identical to SEQ ID NO: 1379

SEQ ID NO: 2356 - protein, 66 aa, Homo sapiens; identical to SEQ ID NO: 1380

SEQ ID NO: 2357 - protein, 156 aa, Homo sapiens
  variant (1)...(156): Xaa = Any amino acid
QKLLKCXRLVLALALILVLESSVQGYPTQRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 2358 - protein, 67 aa, Homo sapiens
  variant (1)...(67): Xaa = Any amino acid
RSYSNXVGLSWLLPSSWFWNPQFKVILRREPGTNGCAAIQTVILQTALKKKDQCSNYFQVNPTRSPV

SEQ ID NO: 2359 - protein, 64 aa, Homo sapiens
SSESGKIRFKSWILVFGKRSVLRRGILLDSPGSSSNIGPFSSRQFAELLSGLQRTHWYLALCVG

SEQ ID NO: 2360 - protein, 103 aa, Homo sapiens
GCHGKHHFRLLVGNPVPFPLGSHSQILIQSRSRSRSLIQSSPQKVGRYDSSPGFSSLEKGQSSDGGSCWIHLEVVRTLVLFLQGSLQNYCLDCSAPIGTWLSA

SEQ ID NO: 2361 - protein, 180 aa, Homo sapiens
GNDGAQRSFCQSCFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLA

SEQ ID NO: 2362 - protein, 72 aa, Homo sapiens
MVKGVSFFLLIVLSSIVSGTDRLIILQRTMPSPTALKRSFVFGFIGMTCRQSGSFSRALFIQLTKAYFSSSE

SEQ ID NO: 2363 - protein, 94 aa, Homo sapiens
ECWVPTLDCSEVPPIAQIPSFLLIAFLKVLATSVLFRPWKILINSSKLILPSWSRSPVAIRFSVISRTLYPGKGKQAALNKSFNSLKQLWQKLL

SEQ ID NO: 2364 - protein, 50 aa, Homo sapiens
QVDHFTKDNAISNSIKEIIRVWVHWDDMPTIRIIFQGFVYPVDKGILFFL

SEQ ID NO: 2365 - protein, 70 aa, Homo sapiens
AMENLDKLIKADPSILVQITCSHQVFCNFSYSIPRQRQASSLEQVIQLIEATLAKASLSSIISSSDTDPL

SEQ ID NO: 2366 - protein, 54 aa, Homo sapiens
NPDHHPGSHLHQHPEEGGLAHREDACSRFHCIRHAWRYGPKGTRRDYEGVSFWL

SEQ ID NO: 2367 - protein, 187 aa, Homo sapiens
QMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLDL

SEQ ID NO: 2368 - protein, 71 aa, Homo sapiens [sequence omitted]

SEQ ID NO: 2369 - protein, 84 aa, Homo sapiens
RSSRSVVIKTLLEPERNSLIITSRSFWSISPCMADTVKSRACIFSVSQSTFLRVLMKMTAWVMVRVSYKSHSVSSFHSSRSTLM

SEQ ID NO: 2370 - protein, 52 aa, Homo sapiens; identical to SEQ ID NO: 2179

SEQ ID NO: 2371 - protein, 54 aa, Homo sapiens [sequence omitted]

SEQ ID NO: 2372 - protein, 161 aa, Homo sapiens
QMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTGEETRVCLECRLGGGR

SEQ ID NO: 2373 - protein, 132 aa, Homo sapiens
TWNPQSLMKFALALTASSSTLSNSSQARKMLPITMPEGTTPLARRSLTSCWTEFASWLTSAPVFRASWFSTALVGELVLGSPRCSWNVSQLIMARSPSWSSPFTRRPRFPQERRPESAWSADWEGADDWGGA

SEQ ID NO: 2374 - protein, 123 aa, Homo sapiens
ETFHEQRGEPRTSSPTKAVENQEALKTGALVSQLANSVQHEVNDLLANGVVPSGIVIGSIFLACDELLRVEELAVSASANFINDCGFQVYKHCPGYMLASTRFTEEGVEGIISSPNGLVTWHL

SEQ ID NO: 2375 - protein, 57 aa, Homo sapiens
DRIITPEISSCSTPVICPLPVCTPGRLWSPLLWKPGAPGKWRTPAWTSCHNQLRDVP

SEQ ID NO: 2376 - protein, 53 aa, Homo sapiens [sequence omitted]

SEQ ID NO: 2377 - protein, 67 aa, Homo sapiens; identical to SEQ ID NO: 1402
  variant (1)...(67): Xaa = Any amino acid

SEQ ID NO: 2378 - protein, 51 aa, Homo sapiens; identical to SEQ ID NO: 1877
  variant (1)...(51): Xaa = Any amino acid

SEQ ID NO: 2379 - protein, 60 aa, Homo sapiens; identical to SEQ ID NO: 767

SEQ ID NO: 2380 - protein, 51 aa, Homo sapiens; identical to SEQ ID NO: 783
  variant (1)...(51): Xaa = Any amino acid

SEQ ID NO: 2381 - protein, 59 aa, Homo sapiens; identical to SEQ ID NO: 784
  variant (1)...(59): Xaa = Any amino acid

SEQ ID NO: 2382 - protein, 59 aa, Homo sapiens; identical to SEQ ID NO: 785
  variant (1)...(59): Xaa = Any amino acid

SEQ ID NO: 2383 - protein, 58 aa, Homo sapiens; identical to SEQ ID NO: 786
  variant (1)...(58): Xaa = Any amino acid

SEQ ID NO: 2384 - protein, 135 aa, Homo sapiens
  variant (1)...(135): Xaa = Any amino acid
XRSSPKPVLCHQSKERKPSAEMNRITTKEATSSCPPKSPLGETRQKLWRSLKMLPERGQRVRQQLKSHLATVNLSSLLDVRRSTVISGPGTGKGSQDHSGDPTSGDRGYTDPCAATSXKSPSQPQAPKXXKVPTR

SEQ ID NO: 2385 - protein, 50 aa, Homo sapiens
  variant (1)...(50): Xaa = Any amino acid
SQALGPEKAAKITQGIPPRGTEATRIPVRPHXXKAPHSPRHQXTXRSPPG

SEQ ID NO: 2386 - protein, 134 aa, Homo sapiens
  variant (1)...(134): Xaa = Any amino acid
EVLPKASPVSPIKGKEAVSRDEQNNHQGSHFLLPPKIPSWRDPPETLEEPQNAPRERPEGPAAAKKPPRHCELVVTLGCPEIHGDLRPWDRKRQPRSLRGSHLGGQRLHGSLCGHIXXKPLTAPGTKXXKGPHQ

SEQ ID NO: 2387 - protein, 84 aa, Homo sapiens
  variant (1)...(84): Xaa = Any amino acid
SWWGPXCXLVPGAVRGFXXMWPHRDPCSLCPPRWDPLSDLGCLFRSQGLRSPWISGHPRVTTSSQWRGGFLAAAGPSGLSRGAF

SEQ ID NO: 2388 - protein, 50 aa, Homo sapiens [sequence omitted]

SEQ ID NO: 2389 - protein, 86 aa, Homo sapiens
SWLPFPVPGPEITVDLRTSKSDDKFTVARWLFSCCRTLWPLSGSILRLLQSFWRVSPRGDFGGQEEVASLVVILFISADGFLSFDW

SEQ ID NO: 2390 - protein, 78 aa, Homo sapiens [sequence omitted]

SEQ ID NO: 2391 - protein, 51 aa, Homo sapiens
EPIRNNRFSNQDHCSSWRNPWIPLSLYLHYHSLGSSLLSQVANLDSIHRCR

SEQ ID NO: 2392 - protein, 50 aa, Homo sapiens [sequence omitted]

SEQ ID NO: 2393 - protein, 82 aa, Homo sapiens
AKWQIWTVSIDADEPHPGTGEVEDIEQLNQCLIQHFHLIKTSLIFLCFLFHGIHENLLTVGVSKEAYLMTSVNGKNKTKMLY

SEQ ID NO: 2394 - protein, 78 aa, Homo sapiens [sequence omitted]

SEQ ID NO: 2395 - protein, 64 aa, Homo sapiens
KFILFYNTFRFIEKLGRWYKEFPYIPYPVSPNNILHWYIMVVTIKWANIDTLVLTKVHTLFRFH

SEQ ID NO: 2396 - protein, 57 aa, Homo sapiens
NLNKVWTLVNTNVSILAHLIVTTIIYQCKMLLGETGYGIYGNSLYHLPNFSINLKVL

SEQ ID NO: 2397 - protein, 74 aa, Homo sapiens
  variant (1)...(74): Xaa = Any amino acid
KSRRTAASIGSGLKKKICSQSVLEVTSPTKLTPYAVLRRWRHQAQKRKFXISHWESKVPPSQNDNCTVAEQTPP

SEQ ID NO: 2398 - protein, 57 aa, Homo sapiens
  variant (1)...(57): Xaa = Any amino acid
LKVKKDSSKHRLRIKEKNLLTVCSGGHITNKAHALCSSEKVEAPGSKEEIXNFSLGE

SEQ ID NO: 2399 - protein, 58 aa, Homo sapiens
  variant (1)...(58): Xaa = Any amino acid
LQQTGWGPPTLGWSLFCHCAVIILGWGYLTLPMRNXKFPLLSLVPPPSQNCIGRELCW

SEQ ID NO: 2400 - protein, 59 aa, Homo sapiens
  variant (1)...(59): Xaa = Any amino acid
LQDSREXANIQLADDFAGKQRKXVKACLPARKLDTKXRFGARKQTQKAHSKRRKKPQNL

SEQ ID NO: 2401 - protein, 50 aa, Homo sapiens
DLELGNKPKRLTASGEKNPKICNLYHKAFISFRYKELLDINKKNANTPEK

SEQ ID NO: 2402 - protein, 50 aa, Homo sapiens
  variant (1)...(50): Xaa = Any amino acid
YRLQILGFFSPLAVSLLGLFPSSKSXLGVKFPGWETSFYXLPLLASKVIC

SEQ ID NO: 2403 - protein, 60 aa, Homo sapiens
LHLVHVGTPSPFQSTTSSSNQYFLESLGNVLHAFKQSPFLEIHYRVTINSATLRFHHYGS

SEQ ID NO: 2404 - protein, 75 aa, Homo sapiens; identical to SEQ ID NO: 1407

SEQ ID NO: 2405 - protein, 63 aa, Homo sapiens; identical to SEQ ID NO: 1408

SEQ ID NO: 2406 - protein, 68 aa, Homo sapiens; identical to SEQ ID NO: 1409

SEQ ID NO: 2407 - protein, 69 aa, Homo sapiens; identical to SEQ ID NO: 1436
  variant (1)...(69): Xaa = Any amino acid

SEQ ID NO: 2408 - protein, 50 aa, Homo sapiens; identical to SEQ ID NO: 1437
  variant (1)...(50): Xaa = Any amino acid

SEQ ID NO: 2409 - protein, 59 aa, Homo sapiens; identical to SEQ ID NO: 1438
  variant (1)...(59): Xaa = Any amino acid

SEQ ID NO: 2410 - protein, 68 aa, Homo sapiens; identical to SEQ ID NO: 1439
  variant (1)...(68): Xaa = Any amino acid

SEQ ID NO: 2411 - protein, 54 aa, Homo sapiens; identical to SEQ ID NO: 1440
  variant (1)...(54): Xaa = Any amino acid

SEQ ID NO: 2412 - protein, 100 aa, Homo sapiens; identical to SEQ ID NO: 1441
  variant (1)...(100): Xaa = Any amino acid

SEQ ID NO: 2413 - protein, 72 aa, Homo sapiens; identical to SEQ ID NO: 1442
  variant (1)...(72): Xaa = Any amino acid

SEQ ID NO: 2414 - protein, 72 aa, Homo sapiens
PHFTIKKLRLKRIKEFFRGETALPYRRIPSNKCECSLSRRWHLIPLSWSLTSLSDWLLMNKMGKRKNSNSTV

SEQ ID NO: 2415 - protein, 76 aa, Homo sapiens
ELLWFFSRPAPSLKCKAVPLMGFWHSVSRPPFSSEGLSGEQRKNQPVSKLARLRDWGPLPPVKDADFTALQYSRVK

SEQ ID NO: 2416 - protein, 52 aa, Homo sapiens
VPPSGEGAFTFITWDPSVRKSCFSSKKLFNPFKPQFLNCEMGLIPVSNQGSS

SEQ ID NO: 2417 - protein, 79 aa, Homo sapiens
RSHLTLLYCSAVKSASFTGGKGPQSLRRASLETGWFFLCSPESPSDEKGGLETECQKPIKGTALHFREGAGLEKNQRSS

SEQ ID NO: 2418 - protein, 61 aa, Homo sapiens; identical to SEQ ID NO: 817

SEQ ID NO: 2419 - protein, 61 aa, Homo sapiens; identical to SEQ ID NO: 829

SEQ ID NO: 2420 - protein, 103 aa, Homo sapiens; identical to SEQ ID NO: 830

SEQ ID NO: 2421 - protein, 63 aa, Homo sapiens; identical to SEQ ID NO: 809
  variant (1)...(63): Xaa = Any amino acid

SEQ ID NO: 2422 - protein, 52 aa, Homo sapiens
  variant (1)...(52): Xaa = Any amino acid
CSRAAAXXXXKMLTTSPXIPAVVRPVLFLEVPVTLSVTTLLCWAPRPLSSLT

SEQ ID NO: 2423 - protein, 90 aa, Homo sapiens
  variant (1)...(90): Xaa = Any amino acid
GRXXXLTLTRTVTRCSSGRKSSWFPSGPGVMQQSSSXYXXXDVDHQPXDSRSGKACSVPGSSCNIECHHFTVLGPQAIVKPHMSSFQNXL

SEQ ID NO: 2424 - protein, 56 aa, Homo sapiens
  variant (1)...(56): Xaa = Any amino acid
SGDTQCYRNFQEQNRPYHCGNXGAGGQHLXXXXCCCSAALRQGPKETRRTFCHWNI

SEQ ID NO: 2425 - protein, 91 aa, Homo sapiens
  variant (1)...(91): Xaa = Any amino acid
LQXILETTHVRLDNGLGAQHSKVVTLNVTGTSRNRTGLTTAGIXGLVVNIXXXVXAAALLHYARARRKPGGLSATGTSSHSPSECQXXXSS

SEQ ID NO: 2426 - protein, 78 aa, Homo sapiens
  variant (1)...(78): Xaa = Any amino acid
SPLRNPGDVLGPGVGAPCHWIRKPASQGFNWETGDSPAGPCILVRLRMRTCETKASRYGLGQXKSSTSMLLLPKGNFA

SEQ ID NO: 2427 - protein, 64 aa, Homo sapiens
  variant (1)...(64): Xaa = Any amino acid
SGRFXLPQTISTGLCFTCPHSQSDQNAGPCWTVTCFPVKALTGRFSNPVARCSHSRAQHISWIP

SEQ ID NO: 2428 - protein, 51 aa, Homo sapiens
  variant (1)...(51): Xaa = Any amino acid
AKFPLGRSSIEVEDLXCPRPYLLAFVSHVLILSLTRMQGPAGLSPVSQLKP

SEQ ID NO: 2429 - protein, 79 aa, Homo sapiens
  variant (1)...(79): Xaa = Any amino acid
IXHWQGSLGAILGSCVNEQMNAQDRILAVTMMLEVTYPTVLLSFSPNPPLLPGKKPSSLCLITFSTQHLQGTYSAVGQC

SEQ ID NO: 2430 - protein, 67 aa, Homo sapiens [sequence omitted]

SEQ ID NO: 2431 - protein, 70 aa, Homo sapiens [sequence omitted]

SEQ ID NO: 2432 - protein, 56 aa, Homo sapiens
  variant (1)...(56): Xaa = Any amino acid
LHICSDDKCLQPCPLQGCTGLHTGSCLRCLVSSLKGWGSGVSPVYLGKXLTLGXMK

SEQ ID NO: 2433 - protein, 50 aa, Homo sapiens
KSGLGGNAFLLLHVYFSCISVVMTNASSLVLCKAALGCIQAPVSGVWFPP

SEQ ID NO: 2434 - protein, 58 aa, Homo sapiens
  variant (1)...(58): Xaa = Any amino acid
FHXSKCQXLAQIDRADSAAPTFQGGNQTPETGACMQPSAALQRTRLEAFVITTDMQLK

SEQ ID NO: 2435 - protein, 78 aa, Homo sapiens
YLPASLSFTAGISSSADRERWVFFPILVPVASLYQENVTFPVPPATEQSRISFCPSVTCPPGARISKLTLEMGIPRWI

SEQ ID NO: 2436 - protein, 50 aa, Homo sapiens
RTKTDPALLSGWGYRKCHILLVQRGHRNQYGKENPAFPVSRAGDPSCERE

SEQ ID NO: 2437 - protein, 117 aa, Homo sapiens
SSHLLSYIHLGIPISNVSLEIRAPGGQVTEGQKLILLCSVAGGTGNVTFSWYREATGTSMGKKTQRSLSAELEIPAVKESDAGKYYCRADNGHVPIQSKVVNIPVRRPDGYRRDLMT

SEQ ID NO: 2438 - protein, 54 aa, Homo sapiens [sequence omitted]

SEQ ID NO: 2439 - protein, 58 aa, Homo sapiens [sequence omitted]

SEQ ID NO: 2440 - protein, 70 aa, Homo sapiens
  variant (1)...(70): Xaa = Any amino acid
VRGEGGXTGLGISAVWEMRSISHHHHLCYXHVSACQRATLSLPQVGGFIXQSVFFMYRSFHSSTLXLXSL

SEQ ID NO: 2441 - protein, 111 aa, Homo sapiens
  variant (1)...(111): Xaa = Any amino acid
FGERVVXQGLGYRQCGKCEAFLIIIISATXMFLHVSERHCPCLRLEVLSXKVFFSCIVRSIHPLXXLXAFERLGCSQAAVLRDLKRDLVSLGAESIYLGTLFQERPCLHFH

SEQ ID NO: 2442 - protein, 53 aa, Homo sapiens
  variant (1)...(53): Xaa = Any amino acid
DNASCVCSGRSSKWNACCTXPXRVXAMRPXDHTWGTNHXLXHXALESPLDRVP

SEQ ID NO: 2443 - protein, 138 aa, Homo sapiens
  variant (1)...(138): Xaa = Any amino acid
SGRGWXHRAWDIGSVGNAKHFSSSSSLLQXCFCMSASDTVPASGWRFYXPKCFFHVSFVPFIHSXPXQPLKGLVAPRLLFSGTLKGTWLVLGQRVSTWALSSKKDLVSIFIRTMLLVCVLEDLLNGMLVALXPXEWXP

SEQ ID NO: 2444 - protein, 101 aa, Homo sapiens
  variant (1)...(101): Xaa = Any amino acid
GXVXKXMIGPPSVVXRSHGXHSXGXSATSIPFRRSSRTHTRSIVLMKMETRSFLEESAQVDTLCPKTNQVPFKVPENSSLGATKPFKGXQXXEWMNGTNDT

SEQ ID NO: 2445 - protein, 61 aa, Homo sapiens
  variant (1)...(61): Xaa = Any amino acid
MERTIHEKNTLXDKTSNLRQGQCRSLTCRNMXVAEMMMMRNASHFPHCRYPKPCXTTLSPN

SEQ ID NO: 2446 - protein, 196 aa, Homo sapiens
DNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDPLELHCESLRGSFPILYWFYHEDDTLGNISAHSGGGASFNLSLTTEHSGNYSCEADNGLGPSTVK

SEQ ID NO: 2447 - protein, 114 aa, Homo sapiens [sequence omitted]

SEQ ID NO: 2448 - protein, 67 aa, Homo sapiens
AVPQGDILMIKSVQDRGRASQGLTVKLQQVPHHSVGPGSPEGEDRVRYRNSHGDSNPRAEDGAVNVI

SEQ ID NO: 2449 - protein, 65 aa, Homo sapiens
QSAGYIIGTKGLFQFLVNPLQQAPPDDVLIDALSGQSLAAHGKDIPLELRQLLFAAWLELAQHKR

SEQ ID NO: 2450 - protein, 50 aa, Homo sapiens
KDAETPASDEPPLRQPAVRFEFLQHAPPDSLQPLGSLVTVEGRRQTLVSQ

SEQ ID NO: 2451 - protein, 85 aa, Homo sapiens
MPSVVRAWLPTARTSPSNSGSSFLQPGSSWLSTKGKKMQRPQPRMNLLCANPLSDLNFFSTRPLTLSSLWAAWSQLRAVVRHWSA

SEQ ID NO: 2452 - protein, 116 aa, Homo sapiens
LADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTL

SEQ ID NO: 2453 - protein, 54 aa, Homo sapiens
PGCPEAGESQGARAEEIQIGQRVGAEEVHPRLGSLHLFTFCAEPTRARLQKGAA

SEQ ID NO: 2454 - protein, 50 aa, Homo sapiens
ISKSIVFEFVCSSLSLLVIVVFCFLFCFQCKCDVIFLFSLDQSWTGNCIV

SEQ ID NO: 2455 - protein, 53 aa, Homo sapiens
PLDGWGFTRETDTPGSILKTLSGFPGQQSSLILSSASEANLTSMCSSSSELVR

SEQ ID NO: 2456 - protein, 81 aa, Homo sapiens [sequence omitted]

SEQ ID NO: 2457 - protein, 50 aa, Homo sapiens
LCCQAVFRYWPQSVYVEQTGWYVAKVDSSLPHRWCNVRASAGVVCQSSSL

SEQ ID NO: 2458 - protein, 193 aa, Homo sapiens
  variant (1)...(193): Xaa = Any amino acid
PVAGPVNEVLIHSXQYLMEVTHDLRLRLKNYMMPAKGKKTDKQPLQKPSHCTIYVAKNYPPWQHTTLSVLRKHFEANNGKLPDNKVIASELSSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSN

SEQ ID NO: 2459 - protein, 58 aa, Homo sapiens
CQLKGRRLTNNPCRSPHIAPSMWQRTIHLGNIPPCLFYVNTLRPITENCLTTKSLLVN

SEQ ID NO: 2460 - protein, 109 aa, Homo sapiens
  variant (1)...(109): Xaa = Any amino acid
NGVAAKVASFSFFQNAQMHQFLNIHVKFENCTFGEIKFYIQLAIVQLCCSFSIKAKVFNMRKCDTFDTVWGGSGWAALGGTGPXTRLCPPRIHAGRREAEVSNXTSHQA

SEQ ID NO: 2461 - protein, 51 aa, Homo sapiens
  variant (1)...(51): Xaa = Any amino acid
PLGERXGLIPLPPSCQHGFWVDTALXKVQYHQELPIHSHPTLYQMYHIFSC

SEQ ID NO: 2462 - protein, 51 aa, Homo sapiens
LYIKFNLTECTVFKFHVYIKELMHLSILKERKRSYFSCHPILEKSLIFKLF

SEQ ID NO: 2463 - protein, 67 aa, Homo sapiens
  variant (1)...(67): Xaa = Any amino acid
EXWFDTSASLLPAWILGGHSLVXGPVPPRAAHPLPPHTVSNVSHFLMLNTLALIENEQQSWTIASCI

SEQ ID NO: 2464 - protein, 82 aa, Homo sapiens
  variant (1)...(82): Xaa = Any amino acid
ADSQNTFXIPEIRKINDKISVSQATNRCKIMKGVVGCAKFGKVVTASEKEAVRLNSWWLPSVTSRGSLQHRPRARRNTVAPM

SEQ ID NO: 2465 - protein, 65 aa, Homo sapiens
FLAFLSALLPSQEPGDAKHPECDGTRWGQGPHLPAEVRPGLLVPGQSPEPLCLVEQAPVCRIPTV

SEQ ID NO: 2466 - protein, 81 aa, Homo sapiens
HLCRKCVEFSVFFLCDFWPFYQHFSPPRSLGMPNIQNVMGQDGGRGLTSLQRSGQVSLSLDNLLSLSAWWSRHLCAEFPLW

SEQ ID NO: 2467 - protein, 79 aa, Homo sapiens
PQWEFCTQVPAPPSREAQEIVQGQGDLAGPLQGGEAPAPILSHHILDVWHPQAPGRGEVLIKRPKITQKEDRKLHALPT

SEQ ID NO: 2468 - protein, 50 aa, Homo sapiens
VLPYSYEHGACVEDSLWKLQKEATKSSASQPLSQMQSPLYQTWHIQPLLS

SEQ ID NO: 2469 - protein, 59 aa, Homo sapiens
HSGNSAHRCLLHQAERLRRLSRDKETWPDLCREVRPLPPSCPITFWMFGIPRLLGGEKC

SEQ ID NO: 2470 - protein, 107 aa, Homo sapiens
  variant (1)...(107): Xaa = Any amino acid
KGQKSHRKKTENSTHFLHRCYRIPTSTGPVLKTPSGSYRRKPPRVQPHSLFLRCSHHFTKLGTSNHSFHNFTPVCGLADRYFVIDLSNFRDXKCVLRICSALRDSVF

SEQ ID NO: 2471 - protein, 57 aa, Homo sapiens
GPCPHLVPSHSGCLASPGSWEGRSADKKAKNHTERRQKTPRTSYIGATVFLRARGLC

SEQ ID NO: 2472 - protein, 64 aa, Homo sapiens
  variant (1)...(64): Xaa = Any amino acid
RLPLEVTEGSHQEFSLTASFSDAVTTLPNLAHPTTPFIILHLFVAWLTDILSLIFLISGIXNVF

SEQ ID NO: 2473 - protein, 60 aa, Homo sapiens; identical to SEQ ID NO: 1146

SEQ ID NO: 2474 - protein, 74 aa, Homo sapiens; identical to SEQ ID NO: 1147

SEQ ID NO: 2475 - protein, 74 aa, Homo sapiens [sequence omitted]

SEQ ID NO: 2476 - protein, 60 aa, Homo sapiens
LLWPCPETTPNSWLVMRGGEYSAGLQMGRKREAAEALAQQCQAEGGRGDWGLSSAYRRNP

SEQ ID NO: 2477 - protein, 126 aa, Homo sapiens
SITTAWGPEGAITCCCLMEGPAWDTSQIIITGSQDGMVRVWKTEDVKMSVPGRPAGEEPLAQPPSPRGHKWEKNLALSRELDVSIALTGKPSKTSPAVTALAVSRNHTKLLVGDERGRIFCWSADG

SEQ ID NO: 2478 - protein, 97 aa, Homo sapiens
GGFFCRQSSGPSHLCHPQPGTVVPEPLLPLSSYPSADQQNILPLSSPTRSLVWFLDTARAVTAGLVLLGFPVKAMLTSSSRLKARFFSHLWPLGLGG

SEQ ID NO: 2479 - protein, 75 aa, Homo sapiens
GVSSVGRAQAPVTSATLSLALLCQSLCCLSLPTHLQTSRIFSPSHHQPGVWCGFWTRPEQSLRGWFCWASLSKQC

SEQ ID NO: 2480 - protein, 52 aa, Homo sapiens
RPALDSRPGSSPTCGLLGLEAEPGAPLLLAVQEQTSSHPQSSKPGPCRLDSR

SEQ ID NO: 2481 - protein, 153 aa, Homo sapiens
AELRPQSPLPPSAWHCCARASAASLFLPICRPAEYSPPLITNQEFGVVSGHGQSSHCGAGFAGLPCQSNANVQLSTQGQVLLPLVASWAWRLSQGLLSCWPSRNRHLHILSLPNPDHAVLTPGDDDLACVPCWALHQAATGYGSFWAPGCGDA

SEQ ID NO: 2482 - protein, 63 aa, Homo sapiens; identical to SEQ ID NO: 2206

SEQ ID NO: 2483 - protein, 87 aa, Homo sapiens; identical to SEQ ID NO: 2207

SEQ ID NO: 2484 - protein, 65 aa, Homo sapiens; identical to SEQ ID NO: 1600

SEQ ID NO: 2485 - protein, 64 aa, Homo sapiens; identical to SEQ ID NO: 1601

SEQ ID NO: 2486 - protein, 74 aa, Homo sapiens; identical to SEQ ID NO: 1970

SEQ ID NO: 2487 - protein, 101 aa, Homo sapiens; identical to SEQ ID NO: 1971

SEQ ID NO: 2488 - protein, 101 aa, Homo sapiens; identical to SEQ ID NO: 1972

SEQ ID NO: 2489 - protein, 74 aa, Homo sapiens; identical to SEQ ID NO: 1973

SEQ ID NO: 2490 - protein, 64 aa, Homo sapiens; identical to SEQ ID NO: 1974

SEQ ID NO: 2491 - protein, 136 aa, Homo sapiens; identical to SEQ ID NO: 1615

SEQ ID NO: 2492 - protein, 79 aa, Homo sapiens; identical to SEQ ID NO: 1616

SEQ ID NO: 2493 - protein, 73 aa, Homo sapiens; identical to SEQ ID NO: 1617

SEQ ID NO: 2494 - protein, 57 aa, Homo sapiens; identical to SEQ ID NO: 1618

SEQ ID NO: 2495 - protein, 89 aa, Homo sapiens; identical to SEQ ID NO: 1619

SEQ ID NO: 2496 - protein, 124 aa, Homo sapiens; identical to SEQ ID NO: 1620

SEQ ID NO: 2497 - protein, 123 aa, Homo sapiens; identical to SEQ ID NO: 1621

SEQ ID NO: 2498 - protein, 58 aa, Homo sapiens; identical to SEQ ID NO: 1647

SEQ ID NO: 2499 - protein, 71 aa, Homo sapiens; identical to SEQ ID NO: 1648

SEQ ID NO: 2500 - protein, 73 aa, Homo sapiens; identical to SEQ ID NO: 1649

SEQ ID NO: 2501 - protein, 88 aa, Homo sapiens [sequence omitted]

SEQ ID NO: 2502 - protein, 59 aa, Homo sapiens
SEVCSSGLSSPLLEQHKTNLIFYASGDICSANGKSGFNQPLPFLKTFCCTHRILSCTYL

SEQ ID NO: 2503 - protein, 171 aa, Homo sapiens
LLDSIWHQPIFNLLSIGQSLYAKAKELDRVKEIQEQLFHIKKLLKTCRFANSALKEFVGQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 2504 - protein, 100 aa, Homo sapiens
  variant (1)...(100): Xaa = Any amino acid
KLPLHMWLAVSCVKERALFVNFARIRLSSSHFRQQHVEDVQRAGLAFTNSASSPPSAPGVRGSQRGENFWKVWPLQQHDAPEYXEKDCSTCLMITPIXVY

SEQ ID NO: 2505 - protein, 55 aa, Homo sapiens
  variant (1)...(55): Xaa = Any amino acid
KMFSVQGLLSQTVLPVLRVPPVCEDHSEEKTSGKCGLCSNMMPLSTXKKTVQHAL

SEQ ID NO: 2506 - protein, 72 aa, Homo sapiens [sequence omitted]

SEQ ID NO: 2507 - protein, 58 aa, Homo sapiens
  variant (1)...(58): Xaa = Any amino acid
XQIGVIIRHVEQSFXQYSGASCCCRGHTFQKFSPRCDPRTPGALGGLEALFVKASPAR

SEQ ID NO: 2508 - protein, 53 aa, Homo sapiens
CTVSKPTGLQQLLDMEELLLNFLHSVQLLGFRIQALADAQQIENGLVPYAVEQ

SEQ ID NO: 2509 - protein, 52 aa, Homo sapiens; identical to SEQ ID NO: 1748

SEQ ID NO: 2510 - protein, 115 aa, Homo sapiens; identical to SEQ ID NO: 1749

SEQ ID NO: 2511 - protein, 52 aa, Homo sapiens; identical to SEQ ID NO: 1750

SEQ ID NO: 2512 - protein, 56 aa, Homo sapiens; identical to SEQ ID NO: 1751

SEQ ID NO: 2513 - protein, 57 aa, Homo sapiens
  variant (1)...(57): Xaa = Any amino acid
ATFINTDILELFTFLLFIFEFSVXYLVLIHCCIXNCTLISSSIKSIXLQFXGIIINL

SEQ ID NO: 2514 - protein, 75 aa, Homo sapiens
  variant (1)...(75): Xaa = Any amino acid
LIPPPVXHVYSRLADKALFGGPASVGSQKPNYCGLQRISRSFTKQTSLHPDCXFAXSGSQXMSXGAGSFWLLEKP

SEQ ID NO: 2515 - protein, 64 aa, Homo sapiens; identical to SEQ ID NO: 1325
  variant (1)...(64): Xaa = Any amino acid

SEQ ID NO: 2516 - protein, 100 aa, Homo sapiens; identical to SEQ ID NO: 1326

SEQ ID NO: 2517 - protein, 52 aa, Homo sapiens; identical to SEQ ID NO: 1327

SEQ ID NO: 2518 - protein, 50 aa, Homo sapiens; identical to SEQ ID NO: 1332

SEQ ID NO: 2519 - protein, 51 aa, Homo sapiens; identical to SEQ ID NO: 1333

SEQ ID NO: 2520 - protein, 87 aa, Homo sapiens; identical to SEQ ID NO: 1348

SEQ ID NO: 2521 - protein, 55 aa, Homo sapiens; identical to SEQ ID NO: 1349

SEQ ID NO: 2522 - protein, 120 aa, Homo sapiens; identical to SEQ ID NO: 1350

SEQ ID NO: 2523 - protein, 75 aa, Homo sapiens [sequence omitted]

SEQ ID NO: 2524 - protein, 59 aa, Homo sapiens; identical to SEQ ID NO: 1841

SEQ ID NO: 2525 - protein, 51 aa, Homo sapiens [sequence omitted]

SEQ ID NO: 2526 - protein, 72 aa, Homo sapiens
QMQKNKNKNTTQNATCKWWSMYLYITSPHTYIHSKQYYIIFLCEHTMSFWKNIQKLVTVANFRGESLIRVGR

SEQ ID NO: 2527 - protein, 52 aa, Homo sapiens
KDFSPFCKVGSTYLQKECISVLCVNIPLISKRFHEKIFEELHKHPLLCRQRW

SEQ ID NO: 2528 - protein, 75 aa, Homo sapiens
LLLPVFVCSSRRTLYVHIEKLYSIVLSVCMYVGMLCINTYSTIYMWHFVLCFCFCFFAFAIFICCSFKLCSVELE

SEQ ID NO: 2529 - protein, 93 aa, Homo sapiens
GFVPSHHLCLHSKGCLCNSSKIFSWNLLEINGIFTHNTEIHSFCKYVLPTLQKGLKSFHLPTLIKDSPLKLATVTSFCMFFQKDIVCSHRKII

SEQ ID NO: 2530 - protein, 53 aa, Homo sapiens
FFFLHRIGRGGRFGRKGVAINFVTEEDKRILRDIETFYNTTVEEMPMNVTDLI

SEQ ID NO: 2531 - protein, 58 aa, Homo sapiens; identical to SEQ ID NO: 1787

SEQ ID NO: 2532 - protein, 67 aa, Homo sapiens
  variant (1)...(67): Xaa = Any amino acid
XPIXQQRALHRKLSSQELNKVSHIHGHLLHCSIVESLNVTKNPLVFFSNKVYSHTFPPKSTPSANSV

SEQ ID NO: 2533 - DNA, 175 bp, Homo sapiens
  misc_feature (1)...(175): n = g, a, c or t
cctcgggaggagntnttnngattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcag

SEQ ID NO: 2534 - DNA, 393 bp, Homo sapiens
  misc_feature (1)...(393): n = g, a, c or t
ccaaggccccagtgaaagcagctaccacccctacccggaagagttctagcagngaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcaacagagagctcttcagacagctcagactctgacagctctgaggatgatgaagctccttctaagccag

SEQ ID NO: 2535 - DNA, 284 bp, Homo sapiens
  misc_feature (1)...(284): n = g, a, c or t
ccgggcacgtaaggaagncgtgntggcccctaancctttgnttcatgctacagnactgaggggtatgtgtccccaatgcacacnnaccngcacacaactnaatgagcttcctgggaaacactattcccccacctccaccttaagtggctgccccagttttccaaccactggaatcagtccctnacctgctgcctctagtctccaccccaaaagttcagtcgtctctgtcttggagggcactgtcgggcccctcatgttgaagctcaacactcctcaatgagcag

SEQ ID NO: 2536 - DNA, 239 bp, Homo sapiens
  misc_feature (1)...(239): n = g, a, c or t
cccagaagttaagtggaaagnngccccattatctatngagtcagagaagaaatccagactccccaangggtctccactgataccacaggggtcagaggtgaggcgctgctntnaatacanccntctctgacaccaccctggtggaggggggctttgggacacttctttacagcttggtaacagtagacatctaggctctctactcagtcttcgctggnggaggtgggatagggccntag

SEQ ID NO: 2537 - DNA, 297 bp, Homo sapiens
  misc_feature (1)...(297): n = g, a, c or t
aaaaataatccattntctagcttcatgtatcaggaatagccctacattaatggtaccaggagcctgggcctctgttgctgaaaggtcctggaccttttacctctaaaatttcatgatacttattttaacatgaaaagcctttattgaattgtgcattctttaatccccaccccttttgcctttcagcattaaactgaagaaaagatgtccctgtacgatgacctaggagtggagaccagtgactcaaaaacagaaggctggtccaaaaacttcaaacttctgcagtctcagcttcag

SEQ ID NO: 2538 - DNA, 283 bp, Homo sapiens
  misc_feature (1)...(283): n = g, a, c or t
cctgcccacacgttttgtttgagcgctcggaagtgaaggatcgccacctggnggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccag

SEQ ID NO: 2539 - DNA, 390 bp, Homo sapiens
  misc_feature (1)...(390): n = g, a, c or t
ctgtgtggatctnnagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagttt

SEQ ID NO: 2540 - DNA, 271 bp, Homo sapiens
  misc_feature (1)...(271): n = g, a, c or t
ggggaactggctgtnagccacagcagccccacacagacagtggtctctgaacttcaggaaagccatggacagaaaaaaaaataaaattcttttccatcattctattttcaaagaggtcttggcgttttcctacatcttttgtttagaggggaaaaaaaggtttcatttgctgccatttcagaaaggttatgctatcctgttttttccaagcagttgtgagtcaggaactgcctgggcagtgtgcatcaactttgtggccgaaccattacag

SEQ ID NO: 2541 - DNA, 297 bp, Homo sapiens
  misc_feature (1)...(297): n = g, a, c or t
ctcgcatgtgcaggtcaagtgtacagtagtgaaaacaacatgcaatgtcttcactgcagaatcataatacagctaggacattggtgttcttncnntcccaccccaaattaaaaactaattgctaaaaaaaattgcattgccaaacggcactggagtgaaagcttggcggtactctacgataaatgctcagtttccagtgcatgaaataaaactatagcaaatgggaggctttggtggcatccaaagaagaaaaaggcaaaccagggggaaagagctgcagtctaaagtttgatcttt

SEQ ID NO: 2542 - DNA, 273 bp, Homo sapiens
  misc_feature (1)...(273): n = g, a, c or t
atgccccaagttgttcaacnaaggttcccatttgtcaactgttacctcgtncccaattgctttaattttttccaaagcatcaagaaaccatttttcggctgttttccattctccattctgaaatgcaaccacgccgacctcatgcataacaaaagggtcttccggtgcaatgctcagagcttggctgaagaacctttcagctagttttgagttattggtcaaaccatattctaatccaatatacagcataggcaaatgacaccctttcatcag

SEQ ID NO: 2543 - DNA, 256 bp, Homo sapiens
  misc_feature (1)...(256): n = g, a, c or t
aatgtagtatcgttgtgcctgaaatgaccattcngggntgtttagaatccagaatcatcaaaagccatgtggtatgaggaagtaataaatatcctcttgaatcttcttaccctattttgcacaaatggatggctgcatgaacagctcttgtaaattgctctgagtccacaccaatagaaacctgcactcatnctatagctgcagagggnttgttggcttaaggcnnctntatcatctcagcattaatttccctttt

SEQ ID NO: 2544 - DNA, 271 bp, Homo sapiens
gatcggtcagacccttcaccagattgtggaagggcagacgaactcctcgcaggatctcagctatgactcctccagtctggcagttgtaccctaactcctcctgtattgcggcaccaatcttgggatccccaactcccaagagtactttcttctttttggacggcaggtgggtctccaagagcaggcggaggtcctcatgaacaacccctcaggggaaagaacacagttcccactaacaggctgaaggacgatcaactctaacatccctcag

SEQ ID NO: 2545 - DNA, 236 bp, Homo sapiens
ggtgtaaccacctctcgcaaggccacggcttctccaactttccccaaaacatctgagcggtttcagaaactatcacttcctccagagagcacgtggctgcccgatgagtaaacagcagctttcccgggcctgcctccaggcggtaagtccacgagtctccaggctgcccgcaactccaagactcatccttatccatcactcatttgcatacacgtctgaaggccctagggagtcag

SEQ ID NO: 2546 - DNA, 324 bp, Homo sapiens
  misc_feature (1)...(324): n = g, a, c or t
tctgtgccaaactagatatttcagatgaattgaggaaaaaaatctggacctgctttgaattctccataattcagtgtcctgaacttatgatggacagacatctggaccagttattaatgtgtgccatttatgtgatggcaaaggncacaaaagaagataagtccttccagaacattatgcgttgttataggactcagccgcaggcccggagccaggtgtatagaagtgttttgataaaagggaaaagaaaaagaagaaattctggcagcagngatagcagaagccatcagaattctccaacagaactaaacaaagatagaacca

SEQ ID NO: 2547 - DNA, 328 bp, Homo sapiens
  misc_feature (1)...(328): n = g, a, c or t
ctttacaacctccagccctatagtctaaggatanggggccctgggagacaccgagggaccaaggaaagaggccccctgtagaaagcaagcagaaattccttgtagacccactgaccagagttgctcgctgtccttgaccccaccgagaggggtgcaaccctgactcagcatcacctcctatctgtcatagcggggagagctttccccaaaggccagcaggggaaaacccaaccttacttggaggagccagggaagtatctcgcagatcccgcaaaaaggcacccacgtctacagctcggcgggctggaggtctgcgggccaagccagg

SEQ ID NO: 2548 - DNA, 158 bp, Homo sapiens
aaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaagg

SEQ ID NO: 2549 - DNA, 191 bp, Homo sapiens
ggggccaccctgacctacacataccgccactgctagcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacag

SEQ ID NO: 2550 - DNA, 413 bp, Homo sapiens
  misc_feature (1)...(413): n = g, a, c or t
gttttctcttcatgtaagtccttggaattaaagtgctaagaacatcaccttagaatcaattcctgncaaattttttgttctccccttctgccatcttaaatgtaagctgaaactggtctactgtgtctctagggttaagccaaaagacaaaaaaattttactacttttgagattgccccaatgtacaggattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcag

SEQ ID NO: 2551 - DNA, 286 bp, Homo sapiens
  misc_feature (1)...(286): n = g, a, c or t
caagcatgagctctgtgttactttctggctcagncactgcctccaggcagccctcctgttaaccacagtgcacgaaactctcccttcttggcttcttggatatagcacccatcctgcttgagtcccatctgtctgggatgttctccgtcattttcttgagggtcccacctgctcctctccccgaaatggacatcctggaaggnggagtctatactgcttttctctccccagcaacgttgaatccggagtcagcctgggctccgcaaacaatggctgccatctccag

SEQ ID NO: 2552 - DNA, 139 bp, Homo sapiens
  misc_feature (1)...(139): n = g, a, c or t
tatcaccatcccctcagtgcccagaattccagaggggaagtgataccgttttagagttaaaatnccnggcctcacgcgtgtaatcccagcactttgggaggccggatcacttgaagtcaggagcgtcagaccagcctgg

SEQ ID NO: 2553 - DNA, 303 bp, Homo sapiens
cctctaacctatgcaggtctccccattatgcatatagaaaatgctagtatgttttgttcacttcatatgtaacaggtgcccttatgttgtgctgtatcctgtgctttttctgtgggaccattccattcaggagcaaagagcaccatgattccaatcttgtgtgtgtttactaacccttccctgaggtttgcgtatgttggatattgtggtgttttagatcactgagtgtacagaagagagaaattcaaacaaaatattgctgttcttcagttttgtttgtggaatttgaaattactcaaattt

SEQ ID NO: 2554 - DNA, 274 bp, Homo sapiens
gcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacattt

SEQ ID NO: 2555 - DNA, 152 bp, Homo sapiens
  misc_feature (1)...(152): n = g, a, c or t
gggcttcgcagccttgcttgttttctctgaacagcaacagaacagtgttcacagcgattcaaagggnggcattgggttggacgttctgggtacaagccaacctagtcccacgttgtacgtgaatgttnaatgngctctcaaaacatggaaaa

SEQ ID NO: 2556 - DNA, 439 bp, Homo sapiens
  misc_feature (1)...(439): n = g, a, c or t
cggccgcagtgtgctggaattcgcccttagcgtggtcgcggccgaggtaaatagaaccatgtttnccatttctgtaggtaaaaggacaaagaagaattacaaacactttgggtctttcccgaattctctcccctttctctggtcaactccacccaccttcactctcaaaggaaaggcacagggggaaggaagtgagtgagggggctcagaagagtctgtgtggctcctaccaccccaaacatattctggtttcccgaagataagaggcaaggcttgctctgatctttcccagttctcagagtccagcaggccgctgtgctggacacatacatggatccaccaacatacatcagtccttctgtgttctctcctgcatggtagaggctggaagcctaagagctatattcctcagaatttcctgccagccaggatttgcttt

SEQ ID NO: 2557 - DNA, 244 bp, Homo sapiens
  misc_feature (1)...(244): n = g, a, c or t
tacgcctgtctccttccacctccacgtatggtgacatcactttgatagcttgacgtcagccactgggggactatttacatcatggatatgggcaaaagacaccaatctgagcttttgtccttttcttttttttggagtgcctgcacacccgtgagcctttccaacctcgtaacctattattttcctgacgagatagttttttacagatgagaaagtngaggcacagagaattgaagggacttgg

SEQ ID NO: 2558 - DNA, 241 bp, Homo sapiens
  misc_feature (1)...(241): n = g, a, c or t
ccagggctctccccatgagagaatcagagggnnngcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtca

SEQ ID NO: 2559 - DNA, 533 bp, Homo sapiens
cctcccacggtgaagctcctaatgctcctggtataaaaaattttgctagcttagtaaaacgaattggaaaacttgactatgatctggaacagataagcaagaaggaacacataagtaagctgctttgctgccaggaaaataaaaacgaagtagctactatcaggtctcctaactaccctagtctgtaaaggaaaaataaaagtctttataaaattaaaataaaaatgtaattgcctatatccttattgccttaacctattttatttttctatatttcctacagatataagtattattcatagttccaagcaatgaacataatgtattttctccaaataggaattgtttatattcataattattccgctctcttgctaaacacatagttccacttaggttttttcttcttgctacttgttttataaaaaatactatatttttgaagcaaaaaaaaaatttacaccagcagcattaggagccctggaaggaggctttgggagccaaggcccatttgggatgcatgcaggactggg

SEQ ID NO: 2560 - DNA, 494 bp, Homo sapiens
  misc_feature (1)...(494): n = g, a, c or t
ctgggcttcctttgtcgagtaggggttcagaaagctgtgaaacactcatttcccgcatcaggacttacttcggtcctggatgaagagtactgaagatacatgcctaaaatattcctaacaccaggatttgtgcatgtgtttccttccccaagaaagctataaacagcaaaaattctgctgtaagcttccctgtgtcctctctccctctcttccttccccctcccctaaaactaaaaggaatgttaaaagaccctttttctgtgaccagcggaccttatctatgctcccaattccaattccttgtgaacatactttgtaaagtcctgtaaaatcctgtctcttttgccatgctgctgcaaggtcataaagtagataaaattagataaaacctaagttgcaattctgtttttcctcaaaatctaagacatgtcacaaaataatttactggccnttgtttctctctctggnaacatcttcccaccaccatgtatttc

SEQ ID NO: 2561 - DNA, 282 bp, Homo sapiens
  misc_feature (1)...(282): n = g, a, c or t
ctgcagagncctctgtttgcgagcccactcagtcactgcacaggtgcttagccgagaggcggcacagtcggggttggcacctgcacccataccagccctgcctcctgttcgctgtgtggcctgagtggctggacctcactgtatctcctggtgggattgctcagaggtctcagcaaggcttggtgtggttaggatgagttattagagcagtgctgagctgtggcaagcacccgacatcagccactgcttgtgatatactgagcacctcctctagagagaaat

SEQ ID NO: 2562 - DNA, 167 bp, Homo sapiens
  misc_feature (1)...(167): n = g, a, c or t
gccatntctggggatgtaaaaaggttgtggaaaatagaatgcccagacccgtctacaaaaggtttttagagttgaaatatgaaatgtgatgtgggtatggaaattgactgttacttnctttacagatctacagacagncaatgtggatgagaactaatcgctgatcg

SEQ ID NO: 2563 - DNA, 285 bp, Homo sapiens
  misc_feature (1)...(285): n = g, a, c or t
ctgagacccctnccctgtgagcccttctatccccacaagttgtcaggacaatcccttgtggttagggggaggggcggggagagagctctatttctcagccagtgccaagctaccctccctcctgggctgtgatttcatttgtgcaatgggggtgtgcaggagtcactagcttctcggggcctgtcccgcacatacacgcacttatgcgacatccagacatttgctacattttccaaagggcttggcctctcccctccagccttcaaaagggagggcaggacacat

SEQ ID NO: 2564 - DNA, 382 bp, Homo sapiens
ctgcagaccgtccctcaccaacccagagaacctgccttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcaccctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccag

SEQ ID NO: 2565 - DNA, 230 bp, Homo sapiens
cctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatact

SEQ ID NO: 2566 - DNA, 293 bp, Homo sapiens
  misc_feature (1)...(293): n = g, a, c or t
aaaagtcttannattgtgaaaacataaacaacaaacctggttgccacattctgttgaagtttgaatccccttggaaattcccatgattgtttggaccagattccattgtagacatatcttgtccatttggcatcattcctggtggttgttctaccatgctttgctgtcctgaagcttctctttgggcaatccaagcttgggccaatgcacccaatcaatctggcttggatcctgttggtgcttggaatgactgcatccattggtgctggttcaagggccactgctgcaagggc

SEQ ID NO: 2567 - DNA, 293 bp, Homo sapiens
aaaatctctggtatttaaggtcaacaggaagaaattgtcctgaaaccttccatccagctttaccaggccctaaccactctcgccaggcggcagcaggctcctgcccagccccaatccagcctcacagttatgatggagctgcagaaacacgagcccttttcaagggggcatttggagtggaaagccctgggaaggtaacgctcacactccaaggccacactcctccatctggacaaacacacaagcacccccaattgtattggaagtactgtcaagagctcaaaatgcccacc

SEQ ID NO: 2568 - DNA, 309 bp, Homo sapiens
  misc_feature (1)...(309): n = g, a, c or t
ctgctgctgccnttgaccatcctgaactctgggggagaggaggagtcagcctggcttgcagacggccgacccagaacatggctgtctgtggtcatttccttccttcacacccagtgggatgggcacagagcccagccttggtctcaccagctcccccaccctcctctgcatcagcatccagctcacacagctctccagaagagtttgatcttagctgcagccttggggtacatcactctacacccagtctcttccctgcgcttctttcaaccaacagaagcaaacatcaaaagcacccacacctactgg

SEQ ID NO: 2569 - DNA, 295 bp, Homo sapiens
  misc_feature (1)...(295): n = g, a, c or t
cctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaangcacttagaatctcccaccactaactggtgttaggtacattaaggagaatagcccttgtgtgactccagtttctacagctacgcatagcttgagtccgtcttcacaccatgctgacagg

SEQ ID NO: 2570 - DNA, 290 bp, Homo sapiens
cctttctactcaggctaatgacaaacacaataaaggcagatatgctagtttaacataattggctgattttatacagcacttatatcttttagtccacaagtatattattaaatgatagagaacatctaatacaaccatttctacagaactaggaaataaatttctaagaaagaaagattttacagaccccatcttttatacccaccccaacagtctaactctaaagaggataaagccaatgactttcctcacaagagctcacgactaacgtcggcttttgctatcaaaaa

SEQ ID NO: 2571 - DNA, 301 bp, Homo sapiens
ctgttaggtatgttaacctgtaattaaaaggctgtggcaacttcagttccatgacgacctccgactttaacacagtctcgaggaaatttgtccaattgttcatatgccagccgcccatcttctcccagagacaagagggtttctgagccacatttctgatttcttcagtatcagattgacacaatgtcaccagcattttaatgctttcagtagcctcaagggattttcagagcccagcaagcttgcttttcttggagcttggaggtttgtcttttgttagtgcttcacagtaatagaagca

SEQ ID NO: 2572 - DNA, 292 bp, Homo sapiens
  misc_feature (1)...(292): n = g, a, c or t
aaatgaacacnttccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgacttttggtgatgttctccccagtgcagaagacttgctttcagaaattagacaacctcagtgggcgaagtntttctcctgcctgcgtaagctgcagcnctgtcnanaanagcttgaaccagagccagcag

SEQ ID NO: 2573 - DNA, 307 bp, Homo sapiens
  misc_feature (1)...(307): n = g, a, c or t
ctgcctctgtaacctaggccgagcatattgctgaggaacggggggtacaaggtgccanaggattgggtctggtggacaagaaacaagacttgtggtcacaattggcctctggccttggagaaagctgtaaatcttatctgaagcagagactataaagaagtttctccctgctgtcaagggtacattgttgacaagcaaatggtgtttcggttantaacggttctaagtgcaatgagttgtgttgaagcctccgtctcccatccttgcctgtagcccgtagtcacttgtgcagtgaggacatcttttt

SEQ ID NO: 2574 - DNA, 103 bp, Homo sapiens
  misc_feature (1)...(103): n = g, a, c or t
ctgttaattgcagttactctgcggaatttccacttctgctttgtacagttccttgtgtgaatttttacatcatgtattacttttgtagntggggaaaaagcaa

SEQ ID NO: 2575 - DNA, 306 bp, Homo sapiens
gagcttgaagaacagattgagggctgtacgcagcaccaggatcatgtgcacaggctgcaggtttgagtgggtgaaataggctgccatctcacagatgcgcttctgctgttctagagtctctttgggcagcttcttcctttctgtctccacggacaaacccacaatgtactcacggcaaatggtgatgagctgctgggcctctgcaatctcttgtttattgccacaacaagaagtggcacactgagaaggatggaacggaatttttccacagcctcctcaaatttgccaactgtggtgagctggtag

SEQ ID NO: 2576 - DNA, 311 bp, Homo sapiens
acttaatgtgtattttgcattgtgatatttaatcaagacattaacatgagtagaaggttgttgatttaagacaagtttgagatccactaaaattaattgttgtatgtttgtccttctggtggctgtggaagcttcatattttctttggacatcattagacgtcttagctcttgaagtacaactttaatgctatatgaattttgccattttgctaacactggtatgctccgggcatccaccatcccactggaattatttattccgttcatattaatttttgttacaaatctaactgacggaggagcttctgg

SEQ ID NO: 2577 - DNA, 263 bp, Homo sapiens
  misc_feature (1)...(263): n = g, a, c or t
aaaatgttcttantgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacag

SEQ ID NO: 2578 - DNA, 217 bp, Homo sapiens
ctgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctgg

SEQ ID NO: 2579 - DNA, 467 bp, Homo sapiens
ctggtacacggcagggtcagggttctggatatcaggtaaaacagtcaattgtgtcccagatccaaaggtcagttgccttgcagaaccagaagactccatgtcacccacgaggcagtagtacacagcagtgtcgctcagggaaacccggggcaggctcagagtgctggactttctgtcggcagggataaacagggaggccacttcgtttgtaacttttgtcttgtatccttgaataataaatcgtggtccttggctgggaaactgttggtaccacgtgatataatcatttgtagcaatgttgttgtggctacaggttatgttcacttcttgtccttcatatgagtccatggagatgggctgggtggtcttagcaaggctcaaagtactcagggtcaggaacacgatcactctcccacttgcctcatattctaggtgcaaactaggacccaggttctaggctcttttgc

SEQ ID NO: 2580 - DNA, 221 bp, Homo sapiens
ccatcttctggtgggtccacacagtcttctccatgtgtatccttccttcagtttcccttatagggacaccagtgatgtcagattagggatcgaacccaacaacctcatttgaagttactcacctgtttgaaaaccctatgtccaaatacagttatagtgtaaggaactaggacttagggcttacaaatatggagtggggcatcatccagaccataccattt

SEQ ID NO: 2581 - DNA, 231 bp, Homo sapiens
ctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataatattctgcattgaaattc

SEQ ID NO: 2582 - DNA, 485 bp, Homo sapiens
gaatgaaccaactgcaacaaggaggtcacctgtgtgcactgctcatcgctcaggttggctctctcttgggtcaaactaggtgattcacttctgtctgccgccatgatgccagccatggtcacagcaccaataatcccaatgagcttgtacttgaatacggtgctagagagctgctttcttatcaccaagtgcatgtcatcctggatgtggctgctggcttcattctgtttgctaaatgccagtgtgctgagaacatagaagagttttcgtatttgctgaggggatatgttatccagataatctaaaatgccctttacaaagacagcattcatcatcatagcagatggatttaacactaccaactctagaagggacatctaaaggcagtatcaacttcagcttcattcccactgcagatatgggtcactaaggcaccaaccactttctgctggcagtacgtgtcaaaaaacttaaatgcatatttg

SEQ ID NO: 2583 - DNA, 247 bp, Homo sapiens
cctggaaggtgtgcaggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaagg

SEQ ID NO: 2584 - DNA, 234 bp, Homo sapiens
ccaggatggtctcaaactcctgacctcaagtgatccatctcagctcccaaagggctggggttataggtgtgagccactgcgcccagccagctattggtattgcctatctttttgacagacttccttgtggttttgatttgtatttccctgaagattaataattttgagaatcttcttgtgcttattggctgctaacttatctttttcagagaaatgtctgttcagatcctttgg

SEQ ID NO: 2585 - DNA, 237 bp, Homo sapiens
gcgtgggatggggattggggtgagatggatgggagccagctggagctcgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttgg

SEQ ID NO: 2586 - DNA, 138 bp, Homo sapiens
  misc_feature (1)...(138): n = g, a, c or t
ccatgttgaacaatacatgtaggttctttttccacncaatgtaagaacatgatatactgtacgttggaaagcatttaccttatttatatacctgaatgttcctactacacaaataaacatatattaaattctaaaaaa

SEQ ID NO: 2587 - DNA, 320 bp, Homo sapiens
ctgccacttcaggcacttacagtggtcacccaggattcaggagatgcatattataagtaactcagttctgtaagagctaggagttagttcacactgcttgggctctcactaagtaagcctgtgcaatgcaggcaggaagggggaaaatgcttacaaaaaagaaatgagtagattcttgccttaggaaagtcaacgggatacaattcctgatggaagagcagttgctattctaagagctaattaacaagaaacaatgctgcaaaaaacttgggagacaggacggcagaacacacccagatggcctgtgggaaattcccagg

SEQ ID NO: 2588 - DNA, 247 bp, Homo sapiens
ccttcccagtccccacaggtccccgtcctgataggtccctggagctccactggccctcaggtaaactccaagcgccacactactgtctacaaacgctggtgatctggacctgcagcccttctcgccttggtggaggcccctccccacgctctggaaagtgcctcaggccctctccgctctggtctctgcaccttccattcccctcacctagatcactcctctaccaaactcctgcacaccttccagg

SEQ ID NO: 2589 - DNA, 145 bp, Homo sapiens
  misc_feature (1)...(145): n = g, a, c or t
aaattgtgttttatttatccgtagaatttatatttatttcattcctttcatctcactgaaaactgtctgcaggccctttgatttggattanatgtgtgaagtactgtcttttgccaaaaacctcaaattacctgttcttttcaac

SEQ ID NO: 2590 - DNA, 174 bp, Homo sapiens
cctttccttgagctgcacgtgaacctgtgtgggcaggcagcgtttgcaggcgtgtttacgggcaggcagcgtttgcaggcgtgtttactggcaggcagcgtttgtaggcgtgtttacatgcaggcgtagcaccatgtgagaccactggtccagggtttcagaggtcctgctcag

SEQ ID NO: 2591 - DNA, 189 bp, Homo sapiens
ctgctggtggatcagatatacgagaacgccatgattgctgctggacttgttgacgaccctagggccatggtgggccgcttgaatgagctgcttgtcaaggccctggagcgacactgacagccggggggccagaaggactgacaccacagatgacagccccacctccttgagctttatttacctaaattt

SEQ ID NO: 2592 - DNA, 235 bp, Homo sapiens
ccggcttgcttgttctctctttcctagcccaggagtcgggtccttgggtctaaagcacagggccaagttctcaaggatcaacatcccagacagctcccatggtctggggcttggagctggtatgaagggtgaaccaggttccatcctggactgtttatggttggagggcctgggcccctggcaccaggacctcagctccctctcctagtaagagctgggatcacccacaggccag

SEQ ID NO: 2593 - DNA, 131 bp, Homo sapiens
atgaggacaccctcggcacgggaacccattcacttagcgtttgctccagtagctttccctctgctaccaatgcagataaacgcggcttgttttactcaggcaagagaatgtgaatagtgccaagaaaatcc

SEQ ID NO: 2594 - DNA, 271 bp, Homo sapiens
  misc_feature (1)...(271): n = g, a, c or t
ctggnggccagtggagccaggatgaggctgaggccatgagtaatggatggaaccatgcaggcaggtctggggcacaacatcccctgcaggagggtgggcagcagtggctggaagtttctcttgattttgggatggacaacagaaaaaaacaaaaagccagtcacagggacccagagagaaggaagggagatgtgggcaggagacagacacagagcatgtgtatgggcaaggaagacncagggagactatgtgtgagcttcagaactgcaga

SEQ ID NO: 2595 - DNA, 136 bp, Homo sapiens
  misc_feature (1)...(136): n = g, a, c or t
aggcagttcctaccatgtacccctctcaggctgcctgcctgacaaggtcagcatcatttgctctcctgaatttatgaggtttatttatttttctctttnctactcctattaaagaacctcgtcccagtgaaaaaaa

SEQ ID NO: 2596 - DNA, 101 bp, Homo sapiens
aaactaaaagccttaattaaagtggtgcaattttgtataacttagcatcagtagttcaataaatttggattgccatgcaagggcttgcattataaaaaaaa

SEQ ID NO: 2597 - DNA, 101 bp, Homo sapiens
  misc_feature (1)...(101): n = g, a, c or t
tggcttcatttcaggtttagttgatttctccaccaaatgcatgtcatgtattctcaataggctgtattcccagcagncaataaatnaacacccgtaaaaac

SEQ ID NO: 2598 - DNA, 109 bp, Homo sapiens
tgtttgctgatgggcagggacacccctgcagggtctcgggctctgagcccaggacattccctgccccttgctcaccttggctgtgggctgtgaacattccgggaccctg

SEQ ID NO: 2599 - DNA, 239 bp, Homo sapiens
ctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgactcctgggctaggaaagagagaacaagcaagccggggct

SEQ ID NO: 2600 - DNA, 96 bp, Homo sapiens
gagactccatctgccctgggcaggttcctgagccttgggggaccagttcaccctacatcccaggcttctgttgtcccttgcctgcctgtaaggaat

SEQ ID NO: 2601 - DNA, 506 bp, Homo sapiens
cctgaggagactgctcactgcaggaatgaaccaactgcaacaaggaggtcacctgtgtgcactgctcatcgctcaggttggctctctcttgggtcaaactaggtgattcacttctgtctgccgccatgatgccagccatggtcacagcaccaataatcccaatgagcttgtacttgaatacggtgctagagagctgctttcttatcaccaagtgcatgtcatcctggatgtggctgctggcttcattctgtttgctaaatgccagtgtgctgagaacatagaagagttttcgtatttgctgaggggatatgttatccagataatctaaaatgccctttacaaagacagcattcatcatcatagcagatggatttaacactaccaactctagaaggacatctaaggcagtatcaacttcagcttcattcccactgcagatatgggtcactaaggcaccaaccacttcctgctggcagtacgtgtcaaaaaacttaaatgcatatttg

SEQ ID NO: 2602 - DNA, 105 bp, Homo sapiens
ctgcggccactgcagcagccatgaagggcagtgggtagaggagtgcaggcaccctgaccagcagagattgctgcagaaataaagtctgcttggctcttgggaaaa

SEQ ID NO: 2603 - DNA, 190 bp, Homo sapiens
aaatttcaattaccatacattagtctattctaataatcttccaataatgcaaacttttactcaggatcttggtagaatatcaggaaaaccatttcctggtataatgattctctgtaatagagaaatcctatacatcgtgtagggtgaagggtagtttttatgtaatagttcactttgagctgtctagcag

SEQ ID NO: 2604 - DNA, 256 bp, Homo sapiens
ctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatg

SEQ ID NO: 2605 - DNA, 349 bp, Homo sapiens
ctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgaagtctgtttgggatcccgctgtggtacttctcgcagtccccgcgcgtggtcatccagcctgacatttaccccggtaactgctgggcattt

SEQ ID NO: 2606 - DNA, 463 bp, Homo sapiens
aaaacctgaactactgctggcaatagtctataaactgggctcaaacttttattgattttctgtgtctggttataaaaataggaagggtccaaggcaacaattttagaaaataaaaccagaaatcagttgggatattccagcccaaagactgccacctaatagactgttccccagtttttcaccattactaaagtgaatgcaaaactttcgtatcactgtattcttacctaaggcttcccactgcctataggataaagtataagccccattcagggagcatttacctactttcccagtcttatgacctgcaattccaagagtatcatcctcacagatactctttgctaacacctctccctttatctgctatgcagactcctctaaatcctaacactgctcaaaagttacctcttgtgtgaaatatccctggcttctctcctgtctcactgtgtcctctccttta

SEQ ID NO: 2607 - DNA, 218 bp, Homo sapiens
ccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcaaaaaaa

SEQ ID NO: 2608 - DNA, 359 bp, Homo sapiens
  misc_feature (1)...(359): n = g, a, c or t
ccacgggaagnnatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgcgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcag

SEQ ID NO: 2609 - DNA, 227 bp, Homo sapiens
  misc_feature (1)...(227): n = g, a, c or t
cctctcctcctgctcgcnaagcctctccttttgcccacngttcaggagactgatgcactgattgttttccacctgagcctggagctctcctgccactctctccagctccttcctcaggtcttgcagctccacctcagaggacactgctggggcatccgggggcagtggctcanccatctggnttttgagtctggacaagctcctctccagctcctctacccgatgcg

SEQ ID NO: 2610 - DNA, 318 bp, Homo sapiens
  misc_feature (1)...(318): n = g, a, c or t
ctggctcanggaaagcacacggggagcgctcggtgctgcgagctgaaatagccgctgttttcacagaacgcccttttcacttgcaagagcgctggggaagctagttattcagtgttgggtatttggtagacgtctgattaaaaatgaatgatgtaagcctgtcacttcaaagaaaacaacacgactatttgctgccaatgatgccatctgagactttaagcaaaaatcagaattttggaaaacttacacttgccactgtgagcttgaaagagttctgatgctccaagccctccctgagagatcacaaatgcagatttt

SEQ ID NO: 2611 - DNA, 421 bp, Homo sapiens
ccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgca

SEQ ID NO: 2612 - DNA, 323 bp, Homo sapiens
  misc_feature (1)...(323): n = g, a, c or t
aaaggaaaantnttttgacatttacatgtcaagacagtagaatcccctacgtaagagatcaatggcttgtttttcccatgaagttcagggactttgaaattaaatgttcccctttgttccttttcctctcgaaagaaacaagaataacttcccatttgtttgctattaatgatggtgaacctgtattgggtatacaaggtgcttcctgttgcactgacaagataattattctcaagttgttcaccatcttttttccaagtcacatttactgcattcaaatccccagatgttgtgaactggcatgtgagatttacattagaagg

SEQ ID NO: 2613 - DNA, 269 bp, Homo sapiens
ctgagctgcggctggagagccctttacagtgcttctgtcctgccacgcacagccagtactccccacctctcacatcctgcccacctccgcccagcctcctggacagatgtcctagagccacagaggagagatgcccagcgtctcatcagcgtttccctcgtcctcccaggggagcctgtggtgcaggctggtgggatgctgcctgatggggagtgtagccccttgagaaagtattgagaccctaataaccccacaccctcaggaggcag

SEQ ID NO: 2614 - DNA, 533 bp, Homo sapiens
gtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattg

SEQ ID NO: 2615 - DNA, 441 bp, Homo sapiens
ccaaggcatcatggtgcgtggtccccttgagagacttgccgttgatggaaagaacctcattgcccttctgaatagtcccttcctgggaggccagcccatttggaaacactctgtgaaccgtaatcaccttgttttctagatctgctcctcctgccaagctgaacccaagaccagcaccttcctccttgtgtaagatggtgacatggatgccgtctaattgctttaatgttgcttcatccagaaccttcacctcctcgatgagttttttaattcttctgagctcagcagggagataacggactgaccagactgaagggaactgtggtccccatcatcgtcttccttggcttccgtgagaccctctgtatattctctcagccctgaaaggttgagcgagaaccctgtgtccaaggcagatgtttcaagcagaaccatttgcag

SEQ ID NO: 2616 - DNA, 302 bp, Homo sapiens
  misc_feature (1)...(302): n = g, a, c or t
ctggaccacagccgcagcgtcatgagcagattaaacccggccactttcaggaggaggattcggaacccaatcactgacaggttttganagtttaggttcgtatctgtttcaaagcttttctcgaccagcttgacatcacaggaactttctgggctggggaagaaggtgtcttctggaataatgctgttgttgaaggcgtttgcacatgcaaagtcagatttgttgctccaggccacagcactgttgctcttgaagtccatagacctcatgtctagcacaagttttgtctgngatatacacat

SEQ ID NO: 2617 - DNA, 369 bp, Homo sapiens
cctgtggctgaccacagataccagccagcagtggggaaccaaacgctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctattt

SEQ ID NO: 2618 - DNA, 341 bp, Homo sapiens
cctggttcacccttgaaagaaaggatggctaggggtaaacaagacgagcaagtccctggaatgcagggagccaagaagggcagccgaggataaggctctgcctccccaccggcgagggtttcctttccttctggtcattaaaactgcacagcccccggggagatgttgaacatggcagggtcgaatcgctggcctcggaagggagaaccttcagcatcccaccccttcttcagcatctcatggactttcagctcatggctctgtggcttgccctgcagcttctggtggtaagtcaaaggtaagcctgtccaacaccgcctgttcctcctcatccacggtgg

SEQ ID NO: 2619 - DNA, 354 bp, Homo sapiens
ccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcaagttaacccccgcttgctcctcccctctataccaagctcttctggtttttcac

SEQ ID NO: 2620 - DNA, 211 bp, Homo sapiens
  misc_feature (1)...(211): n = g, a, c or t
ccagaggtcccggcccgtggatgcttctgtggatgaacccctcccagacnccccaggcccttttggaggaggactgtgtgcagctcangctcccggctccagccagccaccctcacgctnctatgctgtnaanacgtcctcagggtccaagctcaagtctttttgccccctactactctgtgccaggcatcattctaagtgcttgtttgtt

SEQ ID NO: 2621 - DNA, 358 bp, Homo sapiens
  misc_feature (1)...(358): n = g, a, c or t
ctgacagttctccatggcaactcantcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcggggaagggaactcag

SEQ ID NO: 2622 - DNA, 352 bp, Homo sapiens
ccaggcacaccagtgtggccttttgggtgtgggagatctctgcttctgatggctcaaacacagcgacctcgggtgggaacacgtttttcaggtcctctgtgaccgtgagcctggtgcccggcccgaagtactgctcgtaccccgcgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctg

SEQ ID NO: 2623 - DNA, 395 bp, Homo sapiens
ctgtcagcgtccagttgggaggagtgtgcagaatgatgggggaggtacttgaacagcctgacgtcgggcagggggagatacccggcgaagagcggcatcacttccatgtggaccctgtgagtggcccgagcagccactggcatggagatgacaccgcagcttttcccacacactgcccagttgctactgttgtcgacaacttcatacataagctttgtcgaaaaatgctcatcagattcagtcagtgcttcatctttatccacctccaagaggtctgagagccccgtgatcaaaacctccagggagcagagggagcctgttctgcaatactccattcccgaagggggaaagatctcagccttcacgttgtataatgtaaaaaaattttccacctt

SEQ ID NO: 2624 - DNA, 284 bp, Homo sapiens
ccatactctagccaaatgttaggacaaatgtaatccttcacggctttctcaaagaggtcatacacgtgctctctgtccaggccatcctgggccatgctgatctcgtcatgcagccactccagccagagctcttcagtcaagggaaagatttcactcatcttctggcgggccatcctcaccttggtaagctccccttccagcctgagcagtctgatcaagtccacatggcagttgtagtcatagacgttgatagacaactgctcctccagtctctcaatctccag

SEQ ID NO: 2625 - DNA, 326 bp, Homo sapiens
ccactgcatgaccagggctggcaagaagctgtgtaacagagggctgcctttagtttgtggcaggcgtcatcgttccatttgcctgcatctttgtttctcttgatatagatctccacgcagtcctccttgttcttcttgttgttgggctcaccatctccccagttctctgcttcttcagtaagagatttgttggttcccacccaccgtccatattcctcctatcttccggattcctatccaagtagtaagaacgactgaaaggcagagtcttctccagaaactcaatttccgccctgttttgtatggcaactaaatctgtgtaattg

SEQ ID NO: 2626 - DNA, 376 bp, Homo sapiens
aaatatcagtaatagttcattaagtaacatagtagctaagaacatggactatattttcacagcacagttcagcttaggcacacctttagtttggattattggcattctcttacgtaggaattatatcattgtagatatgtaattatggtaataagcaattttcataaccatgctcactcagactatatcatttgaaactaccatgtttccatttttgacaattcatgttcacaaaacaacaggaacaatttcctatttggtataaagagcaaaatttccaactttgccccaaaatgccatgggtggcatattgccatatgattatatcatatatttaatcatgtatgggaaagattttggattttttttcttattt

SEQ ID NO: 2627 - DNA, 266 bp, Homo sapiens
ttgacaacgacaacagtttgcaggtaaatgctcttgtctttcagtcttcctaatttctctaatattgccaaattttctttttcaattccttcatcctccaactttttcccactaatgggctctgctttcatctcgtagtgatctaagtcttctatatcctgtggagggggctggtgaaggagttttcagtcccgggcaccctgggctgtgctgaaagcctctgcgtcacactgccgtgagttagctgggaaagagagctcccactg

SEQ ID NO: 2628 - DNA, 179 bp, Homo sapiens
  misc_feature (1)...(179): n = g, a, c or t
cctgaaggacccagggccctctggntggatgcgtttgcctatcaggacccnccaattacttacagacctgtttagggctaggcttggcctctttcttgagctcatctggaggggngtggcaacactcattcttcatccttattctccctggctgtgggcaacactggncctcagtgtca

SEQ ID NO: 2629 - DNA, 160 bp, Homo sapiens
  misc_feature (1)...(160): n = g, a, c or t
atgagaccgngacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccag

SEQ ID NO: 2630 - DNA, 338 bp, Homo sapiens
  misc_feature (1)...(338): n = g, a, c or t
aaaagctaagcttaccagaaagcanagagatttaatatgtcaacttgtccacaataatgccaagatgaaaaatgacaatgagtcttaattattttgagtcaaatatttcagttcaagaaaatacaactacaggatttcctacaccacacaccaatgggattcatattcattatgcaaactatggtgacagacactcagggctgtaaagtaatttgccttgagtgtttcagtgactttcaccaagtttttggatcctggagtaatcagtgcaaacaagccataaagcttcagtagcaaattactgtctcacagaaagacattttcaacttctgctccag

SEQ ID NO: 2631 - DNA, 167 bp, Homo sapiens
aaagcagccgcaaacatggtttccacaactgcattcctgaagcgcatacccagagttacttcttgtaacagcactttcttccagatgactgagatgcgtctgctggtgataagatcagattaacctatttcaacttgatagctagattctgacacactgaagaaaaa

SEQ ID NO: 2632 - DNA, 201 bp, Homo sapiens
  misc_feature (1)...(201): n = g, a, c or t
ctggcgagcagnatctcttctgggaactgagatgccatttcaggaagaanccactttctttagtttgcatgtaacttacgagagtgtctctcaggctccactgagggcggaagcgctcctcggnttgggtttgggggttctttanttncaagattatcatttcgtgcagctctagcaggaaggcgtctaggccantctgat

SEQ ID NO: 2633 - DNA, 265 bp, Homo sapiens
ctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgctttttt

SEQ ID NO: 2634 - DNA, 349 bp, Homo sapiens
ctgagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatctt

SEQ ID NO: 2635 - DNA, 283 bp, Homo sapiens
aaatttggattcaaagtacttagattttctggaatcccattctacaatcttctggtcgaaagtataaaaccaggttagttgtttgtagttctcaggcaggctctcagagatgttcagagtcacgttgctgccggagaccacggtcatatgtaccaagtgaccttgaatgctggtcaccaggagtgacagaggcagcagtagcaatcccagagccagacacgaatcccaacctctggagcacatgcttccttccagaacttcccagcaacgcaggagacagttg

SEQ ID NO: 2636 - DNA, 307 bp, Homo sapiens
cctgtcatgaataatcaccgttctcctttcgtctcgctcccctcgtacttctcgcctgtctgattctctaagttcatttcttggtggtggaggctcatttcttctggagtcactgaaatttttgggatatctttcgaagcttggatcttcccttcgtgcagtaggtcgtgcttttttcccctcactttgaccaacaaagcggtcccgcctttcaaaagatgaagactgtactgctgaactctcaggaaacctgcccctctctcggtgatcaaagtcattaaatctgttctgttggcgagagtagtcg

SEQ ID NO: 2637 - DNA, 177 bp, Homo sapiens
gaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagttttt

SEQ ID NO: 2638 - DNA, 233 bp, Homo sapiens
  misc_feature (1)...(233): n = g, a, c or t
ctgaagagccangagcccaggcnggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggataccgtgtgtcctgctgcagtcctcaggga

SEQ ID NO: 2639 - DNA, 455 bp, Homo sapiens
  misc_feature (1)...(455): n = g, a, c or t
ctgttaacacattattgattaaataagtatatgcctaaatctggaagaacaaacgaaattatcatgacttctcggtaacactgtgaaaggaaatatcctttttcattttacattctgcactgtaaaaaattcaaaccagcaatgtttaatagctttcacatttgttaaccataaacacaaatttatcaaggtttaatagccaccacccatggcatggtgaatatgtccctggagtctacagaaccagatttgaattttatctctaggccacatgcaagtcacatgatctctgaatcttgctttcctagtccacaaatctaagtgagataggtacggngtctaagccaatgcctagcatgcagattatttcagtacatgtaaccctcccttcaatttacatgaatatgagacatattgctaaagatcaagtaccaactgggtatgactacagagag

SEQ ID NO: 2640 - DNA, 184 bp, Homo sapiens
  misc_feature (1)...(184): n = g, a, c or t
ctggaccacagccgcagcgacatgagcagattaaacccggccactttcacgangaggattcggaacccaatcactgacaggtttngaaagtnnaggntcgtatctgnttcaaagcttttctcgaccagcttgacatcacaggaactttctgggctggggaagaaggtgtcttctggaataatgc

SEQ ID NO: 2641 - DNA, 172 bp, Homo sapiens
ccaggtagcggtccagactgatgaaggccaggatgaggacactgctgtagaggttgactgtgtagatgacatggactgccttgcataggaagttcccaaagtaccagtttgccacggcatcaactgcccagaagggaagcgtgatgacaaagaggaggtcggccactgacag

SEQ ID NO: 2642 - DNA, 230 bp, Homo sapiens
aaacagcatcttgctacagatttccaatccaataaataccaggaatgaaggacttttgccccaaagaagtatttcacatgaattctgaactttggatatggaaacttatagaaaaactgaagaccctgagacacatgcaagtaagagtcttctggcaaaaatacaatttaattttccagtttctctcctcccaaaaactccagaagatacctttagtaggcacagagttt

SEQ ID NO: 2643 - DNA, 389 bp, Homo sapiens
  misc_feature (1)...(389): n = g, a, c or t
ctggaccacagccgcagcgtcatgagcagattaaacccggccactttcaggaggaggattcggaacccaatcactgacaggttttgaaagtttaggttcgtatctgtttcaaagcttttctcgaccagcttgacatcacaggaactttctgggctggggaagaaggtgtcntctggaataatgctgttgttgaaggcgtttgcacatgcaaagtcagatttgttgctccaggccacagcactgttgctcttgaagtccatagacctcatgtctagcacanttttgtctgtgatatacacatcagaatccttactttgtgacacatttgtttgagaatcaaaatcggtgaatacgcanacagacttgtcactggattnacagnctctcaa

SEQ ID NO: 2644 - DNA, 186 bp, Homo sapiens
  misc_feature (1)...(186): n = g, a, c or t
ctgacagnccnccatggcaactngnggcctccagcagacccctgcatacnnaaaggcgcaaaccaacaagatggtgatgctgncctgcgaggctaaaanctccctcagnaacatgcgcatctactggcnganacagcnccaggcaccgagcagggacagtcaccacgagnccctggccctcnggga

SEQ ID NO: 2645 - DNA, 263 bp, Homo sapiens
cctgagcctgcctctctgccttctcagcagagcggccggccgctgtgaccactgctctcaggagagtgggggatgagaggccagaggtgatgcaggctcagaccccggcttcaggagctcggggtggggtcgtgggaccgtgcgcgatagcatcagcccacaggggcaggcagaggcggtgtggagatgccacggggaagccacctgcccacgggggtccacgggagtccaggctacaggcagaaagccttgaactcaggcca

SEQ ID NO: 2646 - DNA, 254 bp, Homo sapiens
  misc_feature (1)...(254): n = g, a, c or t
ccagtgtcangagggcaatgggctctggaaccccttgctgaagnntgncctcaatggccgttgcacccagcagcatcatgtngntctcaacctcctcatagatgctagccagcctgtcctcccggctgtcctgggccaggctggcctggaggcgtcgctcagcccactcctcgtagtactcttcatccagatccttgtaagccagcaccagggtcctcagcccttcccctgcgtactcattaaggtggtccatg

SEQ ID NO: 2647 - DNA, 195 bp, Homo sapiens
  misc_feature (1)...(195): n = g, a, c or t
ctggatcccagggaaatatcagncttgggcaactgcagtgaccaggggcaccggctgcccacagggaacacattcctttgctggggntcagcgcctctcctggggctggaagngccaaagcctggggcaaagctgtgtttcagccacactgaacccaattacacacagcgggagaacgcagtaaacagctttccc

SEQ ID NO: 2648 - DNA, 323 bp, Homo sapiens
  misc_feature (1)...(323): n = g, a, c or t
aaacttgacaatcattacactaaaacagatttgataatcttattcacagtngttattgtttacagaccatttaattaatatttcctctgtttattcctcctctccctcccattgcatggctcacacctctctgtctgttaaactgacgaccacggacaccttgtctcaatgttgtctgaagtcttactcgtctgaaaggctttggttgactactactagtatctacagatgagctggaaggaggatcctggctggtggaggggagatctgactcatcagatgcttgaaccggctcttcttcctgctggctatcgatttctagg

SEQ ID NO: 2649 - DNA, 441 bp, Homo sapiens
  misc_feature (1)...(441): n = g, a, c or t
ccaaggcatcatggtgcgtgggccccttgagagacttgccgttgatggaaagaacctcattgcccttctgaatagtcccttcctgggaggccagcccatttggaaacactctgtgaaccgtaatcaccttgttttctagatctgctcctcctgccaagctgaacccaagaccagcaccttcctccttgtgtaagatggtgacatggatgccgtctaattgctttaatgttgcttcatccagaacctttacctcctcgatgagtttttttaattcttctgagctcagcagggagataacggactgaccagactgaagggaactgtggnccccatcatcgncttccttggcttccgtgagaccctctgnatattcnctcagctctgaaaggntgagcgagaaccctgtgtccaaggcagatgtttcancagaaccatttgcag

SEQ ID NO: 2650 - DNA, 432 bp, Homo sapiens
  misc_feature (1)...(432): n = g, a, c or t
aaaaacgaaacaaagttatggggntaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccattctttgcacaaaactgttctcgctggtttggaataggctcccgtgcttttttaatgntattgcagcatggatgttcattacagaattcagataaaatttgctaatgctctgctatgatgtttgatcncatcttaatcacagggagctcttccatagctcaata

SEQ ID NO: 2651 - DNA, 245 bp, Homo sapiens
ccttgcacgtggcagtgtctatcctgtcagatttgggaggtcagctattaattagatcagctattaatcagactgttctcctaacactttaacttcatggatgtaccttccttcctttcctaatgccaactctgtttcccgggtaggtgtttcactgcctgaatgaaatcctagatctctgtcacagtttttgttcgctggtcagtcagaacctaggcccactggatgagcgtggagccgcccag

SEQ ID NO: 2652 - DNA, 191 bp, Homo sapiens
  misc_feature (1)...(191): n = g, a, c or t
ccatagatttgccttgtggtgntggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaaggcctgacttggaaaaaa

SEQ ID NO: 2653 - DNA, 420 bp, Homo sapiens
  misc_feature (1)...(420): n = g, a, c or t
aaatcttgaaacaaatcaagaaancttttgttaaccaaaccagaaaagnnccagcttactgggagacttctcaaatttgtcatttttccatgaattcagtttgtgctgtttaagaccttcctggtccacgaattcagtttgtgctgtttaagacctggntatttcccatgagccacacatgcttccaatctttcttgaagtagtgcacatgttccttcccagagctagtttctatttgcccatctcagttaagtccatatacatagaattgcattcattgacaccattccgnactttataaatgtataccaacttcaccatcctcagggcaatgttacatccctcttccagaattaaacattccggaggntgtctcccacacactcacacacacacaagccttgggacacaacgatcaaa

SEQ ID NO: 2654 - DNA, 226 bp, Homo sapiens
ccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcag

SEQ ID NO: 2655 - DNA, 310 bp, Homo sapiens
  misc_feature (1)...(310): n = g, a, c or t
aaaaaaataataaaacgaacaaanctttacttgttgccacatcagataacacggaaaaagccttgaaattactccagatgtgcaccctccccttccctcagtgcctgagtctttttcttccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgcttttt

SEQ ID NO: 2656 - DNA, 389 bp, Homo sapiens
ctggaccacagccgcagcgtcatgagcagattaaacccggccactttcaggaggaggattcggaacccaatcactgacaggttttgaaagtttaggttcgtatctgtttcaaagcttttctcgaccagcttgacatcacaggaactttctgggctggggaagaaggtgtcttctggaataatgctgttgttgaaggcgtttgcacatgcaaagtcagatttgttgctccaggccacagcactgttgctcttgaagtccatagacctcatgtctagcacagttttgtctgtgatatacacatcagaatccttactttgtgacacatttgtttgagaatcaaaatcggtgaataggcagacagacttgtcactggatttagagtctctcag

SEQ ID NO: 2657 - DNA, 308 bp, Homo sapiens
  misc_feature (1)...(308): n = g, a, c or t
ctgagagactctaaatccagnganaagtctgtcngcctattcaccganncnnanacncaaacaaatgtgtcacaaagnaaggattctgatgtgtatatcacagacaaaactgngctagacatgangactatggactncaagagcaacagtgctgtggcctggagcaacaaatctgactttgcatgtgcaaacgccttcaacaacagcattattccagaagacaccttcttccccagcccanaaagtgcctgtgatgtcaagctggtccgagaaaagctttgaaacagatacgaacctaaactttcaaa

SEQ ID NO: 2658 - DNA, 123 bp, Homo sapiens
  misc_feature (1)...(123): n = g, a, c or t
aaaacctgcngactaaacagtaaggaatttatatttgtgaaaaatgccacccgncctagtgatttctgatgtaaataatgntgnttatatagtatgtattaaattttcctacattgtaaaaaa

SEQ ID NO: 2659 - DNA, 306 bp, Homo sapiens
ctgctgcacccagagctcctttgggtctgcacatagctctgcctgagagcgcttgcggggcaagaacaggatagctgggatggagcagcctaagcttggttcctgcttccggtagctgcggacaaccttggcgggaatcttcctttggctgtacttgaggcaacagtcctgagcccctccatcactgccttgggtcctggggatgccaaaggccagaaccaggataaggaggctcagagccagtgactgagccatgtctgtggtagagggtgagtcagaggccagagctgagggtgaggtgggcag

SEQ ID NO: 2660 - DNA, 240 bp, Homo sapiens
  misc_feature (1)...(240): n = g, a, c or t
cctgaaggacccagggccctctggggggatgcgtaagcctatcaggacccncanttacttacagacctgttnagggctaggcttggcctctttcttgagctcatctggaggggtgtggcaacactcattcttcatccttattctccctggctgngggcaacactggtcctcacngtcaccagatggncctcctctgggcccatgaccccncagcagccaaggctggccctgccagataaa

SEQ ID NO: 2661 - DNA, 280 bp, Homo sapiens
  misc_feature (1)...(280): n = g, a, c or t
ctggaccacagcctttncgtcatgagcagattaaacccggccactttcaggaggaggattcagaacccaatcactgacaggttttgaaagtttaggttcgtatctgnttcaaagcttttctcgaccagcttgacatcacaggaactttctgggctggggaagaaggngtcttctggaataatgctgttgttgaaggcgtttgcacatgcaaagtcangatttgttgctccaggccacngcactgtttgctcttgaagnccatagacctcatgtctagcac

SEQ ID NO: 2662 - DNA, 192 bp, Homo sapiens
  misc_feature (1)...(192): n = g, a, c or t
aaagcttcttgtttttattaaaaacaagcacatattaacagccacatgtgaatgccaaatgattaaaacaaaaaacaaaaacaagagccatctacactgcagctagggaaagcaaacttcttggcttaagagaagtgagggatgtgtgtacgtgtgtgtgtgtgtgtgtgtgtgtgtgtgtgtgtgtgngtg

SEQ ID NO: 2663 - DNA, 504 bp, Homo sapiens
  misc_feature (1)...(504): n = g, a, c or t
ccaggccacctcctnaggagttagatcacttatccgtctctccctggcccacccttctctgtcacatggcttctttgctgaccgtgatacacaccacacttgtcttctctacctggaagttgtattccccatacccacatggctcacttcttcacttcattcaagtctctgctcagatattaacctcttcagagagcccttccttcacacactgtcttgcatagcagcctctcctacaagttgtcttctttctccttaacttttgngatggttaattttaggtgtcagcttgacttggattaaagaatacctagagaactggaaaggcattatttggtagtgtgtctgtgagggtatttccagaagagattgatatatgactgattgggctaanaggaaccatncgccctcaacgtgcagttggcttggaaacaaaaacngaagaaaggcaaattggtcttactctcttggagctggaataaccccttccattcctggcccttg

SEQ ID NO: 2664 - DNA, 389 bp, Homo sapiens
ctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgttgtcagccacagcttcctgccgtagagaatgatagagcag

SEQ ID NO: 2665 - DNA, 492 bp, Homo sapiens
  misc_feature (1)...(492): n = g, a, c or t
ctgcagtcaacagtttaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgctaaatccaaagaaaaangggctgccgggccaggcgcggtggctcaccgcctgtaatcccagcactttggcanggccgangcaggtggatcacctgacgtcagtagtttgagaccagnctgg

SEQ ID NO: 2666 - DNA, 337 bp, Homo sapiens
  misc_feature (1)...(337): n = g, a, c or t
ctgcataatgctcnnacatctgtagatagagccgctctagttccattgtgtattgtttggtgttgaacagagggctagatattctttgcttccagactttgccacgaactttcttcaggtattctagatcagttcccagcttcacagctatgtcttcatattcttgtctgtttttagcaataagctcaagacaacctaagcaagtgagctgggatgctgcaactcgagaagcaagagtctctcctggcatagtcaccatgggggtccctgcccagaggacatccatccctgtggtgtgcccattacagagtggagtgtccaagcagacatcagccag

SEQ ID NO: 2667 - DNA, 405 bp, Homo sapiens
  misc_feature (1)...(405): n = g, a, c or t
aaaagtcgcannttctgacaatcaacaaataaactctaatgagaatcataaagcttgttcccagagaaccatgatacagggtgggacagtacgcaaataatgggctcctgttgtcagacttcatggtgattacgcttgtgctttctccagtatctttcttcctattgtactcctgaagcactcagaatgataaagataaatttctgatcattcctacaaagagtgcaggcaaagttaagatttaactgtgattgctggttgtttcatctcgaattcaaaatcctggatttccgaaacaatggagcttgatgtcacatttggctatcttgcctttgtctcctcttctggaaagaacaaatcatcttcctgaaaattacaggagacacttagtatgacaaaataagg

SEQ ID NO: 2668 - DNA, 332 bp, Homo sapiens
  misc_feature (1)...(332): n = g, a, c or t
cgcggncgtaaggnttgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattccaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaagggtcta

SEQ ID NO: 2669 - DNA, 302 bp, Homo sapiens
  misc_feature (1)...(302): n = g, a, c or t
ccacctcaccctttnntctggcctcttactcaccctctaccacagacatggntcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcag

SEQ ID NO: 2670 - DNA, 398 bp, Homo sapiens
  misc_feature (1)...(398): n = g, a, c or t
ccactctgtctgcangatgttttagtggaatgttgtagccaaagttagatctgaagttggaagcttcttctcttgctatgtctgctaaagaacgagcatctgccaacaaacctgctactgccattccaacatgccgatcaacattaaaaagtcttttgttggaaccttcttcataaagtttagaaaggactaatttttctaccccaaagacaacaccatctttgcatctgattccaatagctgtactactattttccacagccttcatagcatattcaacttgaaaaactcttccgtcaggagagaatgtagaggctgacaggtcatacccagtgccgattgagctcatcgtgctaaacccaaagggacgcgtagggattccaggcccggagcgcttc

SEQ ID NO: 2671 - DNA, 352 bp, Homo sapiens
  misc_feature (1)...(352): n = g, a, c or t
cctgtgaggtgcagagtgcccagaactggactcaggatgcccagggccactctgcctctgcctgcattctgccgtgtgccctcgggcgagtcactgcctctccctagccctcagtttccctatctcgaacatggaactcattcctgcctgtctcctttgcaggctcatagggaagacctgctgagggaccagccaagagggctgcaaaagtgagggcttgtcattactagacggttcaccagcctctcttggtttccttccttggaagagaatgtctgatctaaatgtggagaaactgtagtctcaggacctagggatgttctggccctcncccctgccctgggatgtccac

SEQ ID NO: 2672 - DNA, 423 bp, Homo sapiens
ctagaacctgggtcctagtttgcacctagaatatgaggtactttgagccttgctaagaccacccagcccatctccatggactcatatgaaggacaagaagtgaacataacctgtagccacaacaacattgctacaaatgattatatcacgtggtaccaacagtttcccagccaaggaccacgatttattattcaaggatacaagacaaaagttacaaacgaagtggcctccctgtttatccctgccgacagaaagtccagcactctgagcctgccccgggtttccctgagcgacactgctgtgtactactgcctcgtgggtgacatggagtcttctggttctgcaaggcaactgacctttggatctgggacacaattgactgttttacctgatatccagaaccctgaccctgccgtgtaccag

SEQ ID NO: 2673 - DNA, 188 bp, Homo sapiens
  misc_feature (1)...(188): n = g, a, c or t
ttggtgagggtacaactgccaaaggagaggtccctgatggctacaatgtctccagattaaaaaaacanaatttcctgctggggttggagtcggctgctccctcccaaacatctgtgtacttctgtgccagcgcggggtacgagcagtacttcnggccgggcaccangctcacggtcacagaggacctg

SEQ ID NO: 2674 - DNA, 242 bp, Homo sapiens
ccaacatggtgaaaccccatctactaaaaataccaaaaaaattagccaggcgtggtggcaggcgcctgtagtcccacctactctggaggctgttgcagaattgcttgaacccgggaggcggaggttgcagtgaaccaagatcgcgccactgcactccagcctggcgacagagcaagactccatctcaaaaaaaaaaaaaagacttgaatagctacagaaagtcccttacctctgatcaaagg

SEQ ID NO: 2675 - DNA, 376 bp, Homo sapiens
gttttggtggcggtacagacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtggacactccagggctctttgacaccaaggagagcctggacaccac

SEQ ID NO: 2676 - DNA, 284 bp, Homo sapiens
ctgtccggaaccaggaagggcaggaaagccatggaggcctttcaggcatctgggcagggtagggaggggccgtaaggtgctcacctgtcacacgaggtccccgagcgccgaggaagatggtggcgggcagcgggcggcagcagtggcgtgatctccgaagcccacagtacactcatccataaagtaggaaacactacaccctccagtgctgttagtagtgctttctactttatgggtgactgcactgtctgtctgcccgtcggcgtgtactcttcaggctgccc

SEQ ID NO: 2677 - DNA, 284 bp, Homo sapiens
  misc_feature (1)...(284): n = g, a, c or t
cagaggacccctccatcctgcagttcctgccatgagcctcgggctcctgtgctgtggggccttttctctcctgtgggcaggtccagtgaatgctggtgtcactcanaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaangagaggtccctgatggctacaatg

SEQ ID NO: 2678 - DNA, 252 bp, Homo sapiens
cctggagccttcccctgcctcttccgacctgcatctcagcagccaccctacccagtgaccaggagtccttaggctacctggatgcaagtcttgcgggggtgacgggccacccccttccttcttctcccatccaatcccactggttcctggatcccaggccctcagctctgccctaaaggaactctgagcaatccatgatgagtgtgtgctacacacatcctttctctcttccaaataagggacttccccttt

SEQ ID NO: 2679 - DNA, 269 bp, Homo sapiens
ccaatttcttaacccccttcagcgtccgtttgtttgcacagtgaaatggaaacattaatacttaccttgccaggctggtgcgaggatgagatggggttgtgtatgagaagtcagcacagagctggcaggtggtgccatgcaggtgtcagcagagttaagggattgttgatgtagtagacgtggtccgctccactacaccttgccagaccacctgcagggcacctcagctccaattcacagacgcgcctacagcttcctgcaccaagcag

SEQ ID NO: 2680 - DNA, 322 bp, Homo sapiens
  misc_feature (1)...(322): n = g, a, c or t
tgctcatcttcagcagacggaaaccaagcgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccanaggtagtaccggtggaactcttgtgcgtgccttctcctgcctctcaaggggacctgcatacnaagcctttggggactgacgatgacttctggggccccacggggcctgtggctac

SEQ ID NO: 2681 - DNA, 151 bp, Homo sapiens
  misc_feature (1)...(151): n = g, a, c or t
ggcagccatcaccagccacagttaagccaagccccccaacatgtattccatcgtgctggtagaagagtctttgctgttgctcccgaaagccgtgctctccagcctggctgccagggagggtgggcctcttggttccangctcttgaaatag

SEQ ID NO: 2682 - DNA, 254 bp, Homo sapiens
  misc_feature (1)...(254): n = g, a, c or t
ctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctgnagcaacaaatctgactttgcatgtgcaaacgccttcaacaacagcattattccagaagacaccttcttccccagcccagaaagttcctgtga

SEQ ID NO: 2683 - DNA, 252 bp, Homo sapiens
  misc_feature (1)...(252): n = g, a, c or t
cctttctcccagggtcttattgaagtttgggttttggcataagagatctaagggttgccctaggaggcagaggatggttccctgatcttaaaggctctcaacctctcctctctcctcccttcccccacagtgtgccacagctgtgtggagctggatccagccaccgtggctggcatcattgtcactgatgtcattgccactctgctccttgctttgggagtcttctgctttgctggacatgagactggaang

SEQ ID NO: 2684 - DNA, 356 bp, Homo sapiens
ctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatcttttt

SEQ ID NO: 2685 - DNA, 375 bp, Homo sapiens
aaaaactaatgtccattgtttttcccaatctgaatatgtttccatacatgtatgtatttgcaatttctattttccaatatgtaaaaagttggtagacaatgaagtagtgtgcaaatttttaggagagaaaacaatccctactggtttactaccaaactctcacagttatatagaatctattagcactataaactaactcaaaatgcaggcttcagaaaaactgcttcaatagcctccctatcaatctgtcgccttctatgaagtcttcacctgctattattccacaggctgagaattacttctgaaagaaatggtcaattttttcaacagcttggtatgttgacagcttagcaacggtacttcaatcacctcttt

SEQ ID NO: 2686 - DNA, 309 bp, Homo sapiens
agtggatccaaagcacctgataaaagttaataatctcttgttaggaaagctgtccattaataaggccagtcttcagcaaaactaaaaccattttgttcgtttagctttcctagtctgacaacgcaatactgttgaaccacagtcaaatataatgacaacattggatggatagatcagtaccattggttacagctgttaaacaggttcgttcttggcgccacataaaaacaagccaataacatcgaataaatcatggcttttttttctttatcacaattcactaagtgatgttaattatggtccttgtca

SEQ ID NO: 2687 - DNA, 320 bp, Homo sapiens
ctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatgg

SEQ ID NO: 2688 - DNA, 171 bp, Homo sapiens
  misc_feature (1)...(171): n = g, a, c or t
naaactcaacagtagtatttaccatggngtcaaattaancatttatcttgagttcacaaactgagttcactaattttgtctccgtttttcaaatttctagcatttatagactactataacaaccatactcttttaggctaagtgttggaaaanagtaatagatttctggct

SEQ ID NO: 2689 - DNA, 610 bp, Homo sapiens
aaaaaatgggaaattttaatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagagcccattcataatctggacagcccccaaagtcttagattccctcatgaagaagctttgcgtggggcccaccagtgaagacatcctcctgaagagtggttttggaccagattgcatagcaatagggcctttcattggctctgccgggaaagtcccatttactgaatttctgggtgttgtcattttgctctcaaaactcctaaaaataaaacaaataacaaaatgaggagagcaagaacaagatttttggcagtcttaccttgtgtcatgcatctgaatgcttctctcagcatttcctccatgagtgtcattgagggtagacatggcctcttccgagtgaccttggatctgag

SEQ ID NO: 2690 - DNA, 357 bp, Homo sapiens
  misc_feature (1)...(357): n = g, a, c or t
aaagngcctnangggtcccctgaaactaattttctatttctggnatnccctgnattcattatatgaganggtgacatgattagaggaattcttttttagtatgaaaatngtcccttntcttcttcactacttgcctccttgctggcnttgaattaacacagggacaaaatttggttaatnntttatttctaactctcccaacaaacccctgntgcccantatttgtttggtggcctttaaccacctgagggaaaaaatgagcttattcaagctgccaatatttatctatgggctgtancacntacactgaattgtactgtgccagggatattgagatgctctgggggngaatngtat

SEQ ID NO: 2691 - DNA, 320 bp, Homo sapiens
ctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtgacatttctaccagttgtttcagtagcatattggtcttggcatttcttggcactgtggttctgctgtattatttgtgatgtcttattgtttgtgagcttttgttttttttt

SEQ ID NO: 2692 - DNA, 357 bp, Homo sapiens
  misc_feature (1)...(357): n = g, a, c or t
ctgctgccacatggggttggagcctccaacagcatcatccctgagtagacctggtccactgagtcccacaggtcggctctctgcagcctttccctgcaggtcaccaccctctacaggcaatggcaaggacgcgacatcacaggtagacagcccacatcctctcatccttccggtctcctggactggagttgtcccggtgccctggagacccagtcactgccgcctctcccctgcctggactcagcaggggaaagactggaggccctgctcctgccctttggctctgccagcacccccgaccagccctatatctcctcctccaccttcaagatcatccctganaanacctcnancccc

SEQ ID NO: 2693 - DNA, 197 bp, Homo sapiens
ctgtatccactttagcacaaagaaaaacaaggatgctaaatacgtatatactttatcaagcagtgatgtttcacaaagaatttcttaatgcctcttacactgaaggacaccataattcaatttatacaactggttaatagattcaagggaataaatcccaccttaggaaaatagtaccaatcgtgtcatttaagtgg

SEQ ID NO: 2694 - DNA, 223 bp, Homo sapiens
ctgagggtacagctctgagaattggcgctggaaacagttcttggactgtgatagccacaacagatgctgtttctgggatcccaggaccagggctctggaagatgccactgcagtggtagtgcccgctgtctgccttttgtaccacggtgatggagaattccctgttaggcccggggggacccagagctgagccgtctcggtagaaggtcacctgagtcagtgg

SEQ ID NO: 2695 - DNA, 484 bp, Homo sapiens
ctgccaggatgaccaccagcatgccacaggctgggcatattcaacaggacccagtcaccacaaacgtagtctgagaccactaagagaaacccaatatgcatacattgcaggcccaaaccttcctgctttcctgtagtggtgtacttttgacaggaggaaaaccacgtcaggcttagagatagcacacaaatagggaatgacaggaacagggccagaggtgacaaaccactggagatgagtcagaggccacgccgctggactggtctttgtggacttgggagtgcctactgatcaaaaaccccaaaacccacatgccacccgcttccccgcagccaggaacacaattgtttgtgactgtaatagcatttgtatccaataaatagtcttaaccataatggtggacttattttgcctcagagaccaaatgtgctgaattatggatgggagtgagcctcacctgcttccactcattgacacaaaaaat

SEQ ID NO: 2696 - DNA, 196 bp, Homo sapiens
  misc_feature (1)...(196): n = g, a, c or t
ctgctggctggctgggcccccgtanctggactggtttgacaaacccatgcctcctaacatttggctaccgnaagcaccaccgcttgctnctgctgtanaattcaagaanaattctacatatctgnggtgcatatttgntttgtcttttganatagctgncacaaacatcttcatgaattgccgaactcnanatctg

SEQ ID NO: 2697 - DNA, 342 bp, Homo sapiens
  misc_feature (1)...(342): n = g, a, c or t
aaatggatttcccaggcttcttcggcaaccaccttatctggccttncatctgcgtcttttaattgtatatatgggtttttcctaattctattcaaatcctcatgtaatccatctaataggaaagctaaccgttcttgacagtcttgctgctgatatccagagaactgaggtgcaaaacgtcctacctgtgtcttaaaggctcttggggtgacgtagctaaactttccagaccacatttgcttgatcagttcggcataagatttagctatttcacctctcattcctaagggattgtcaaaattcagttcttcttgatacttatcattgangaaatactcanta

SEQ ID NO: 2698 - DNA, 447 bp, Homo sapiens
  misc_feature (1)...(447): n = g, a, c or t
aaattcatgagcatggagtgcctttttacttatttgcgttgtctctattttttttcagcagttttgtagttcttgttgtagagatattttacctccttgatttaatgtattactaggtacatatttttttgtttgtagctattgtaaatagaaccatgttctttttttctcagcttgaatattattggtgcacagaaatgctactcatttgtgtatgttgattttgtatggtgagactttgctgaagtcattatttaggcttanaaatcttttggtgaaatctttttcggtgaagtttcccaggtagagaattatatcaccagtgaagataatttgacttcctctttttctatttgaatacattttattgctttatcttgttaaattgctgnggctacgactttcaggactatgttgaatagaagtgtttanagtggatacncttgt

SEQ ID NO: 2699 - DNA, 356 bp, Homo sapiens
  misc_feature (1)...(356): n = g, a, c or t
aaaaattggcttttttaggattctttttctccccctcccatcttagtcttaccttgagggaacagtcatatgagaaggaactttgtcacatctaagctgtggtgtcttccccatgtgtgtgtacaacactggtgactccaggaaccattttcacctattaccagtgttccctggggactcctcttaatgtttccaaatgggaaggacagttgatttccaacatgangttttttgttttttatccagaaatattttcagcaaaactttccaactgagtggagtctgattaaggatttatttgaaaatggtgggattcattggcccataggtacattggaaaatgtatatctcttcaa

SEQ ID NO: 2700 - DNA, 225 bp, Homo sapiens
ccatacgtcgtcataccttagacaaacggagaacgggatggcaggtccatgctagagcgcttctctggaaaggcagcttggctaacaaagtctgacgccctcagacggtgatggaagctggagacccccaagtgagatgatggcaggttccagccagtttactacagtccccagggaagggcagactgccatgatgagaagactccagattattatcatgcccag

SEQ ID NO: 2701 - DNA, 180 bp, Homo sapiens
ctgtttgatagctctactgagatgaagaaagaaagagaatacctgctcagctccagagacacgtaaagggacagagattgggggacagaaggaagtgcattaattccttccacgacccctgaagagcagcggtgggtctgagcatcctatctccaggaagcaggccagcaggcaagccag

SEQ ID NO: 2702 - DNA, 411 bp, Homo sapiens
  misc_feature (1)...(411): n = g, a, c or t
aaagtgcacatgtcacctaacgacaacgactgagatgactggaattganagaagacgcagtctccttccaggaagctcactcgattctggaaatctgggggctctggataggaactccatctttcccccaaaacttaagcacagtttcatgcacgtgatttctttagcttgatggataacatggtgtcccggcgtggaaacagtntggggaattcagtccgagtcaccccannaaaacaaccccttctcatgtnanatnaaccnagacagggccattagatccagcaactagagcactgtcaagggcatgagcaaaagcacaggcagccgccatcccaggtaaatccccaggacaggaacaaatccccctgnngacaacttccaaggggggaagagagatgacnaaggtct

SEQ ID NO: 2703 - DNA, 423 bp, Homo sapiens
  misc_feature (1)...(423): n = g, a, c or t
gtgatttaacaaatcaattgatgagccttacctaacaactcttgttctcatggtggtatttgtaggccacttatgctgaacagatttctgtaaacacccataaatatatctcaatgtcctgccaaaataacacaatcatctnaacacanaaagcaagtgaaaacactgatctcctagcagncaaaagcttaatttacccaaatataccacagntcaatanaactggccttttacccaaaaaagtattttgccacaggtaatgaggcatttancaaggggtaaggaaaactttatccactaagtttatcatcaattnattcagttaacctnctgacatttactttcagatatngngaacgaaccagaccntgcccgggccggacgctcnaatggtaaagttctgcacatatncatcacactnnc

SEQ ID NO: 2704 - DNA, 280 bp, Homo sapiens
  misc_feature (1)...(280): n = g, a, c or t
ccagcatcaggagccccgcgttgccggctctggtcatcgcctttctttttgtggcctgaaacgatgtcatcaattcgcagtagcagaactgccgtctccactgctgtcttataagtctgcagcttcacagccaatggctcccatatgcccaagtttccttcatgtccacccaaagnacccgtctcaccatttacaccccaggtctcacangttctccttgggtgtgcttgcccgaanggaggnaagtaatacngatggtgctggccccacattntctgga

SEQ ID NO: 2705 - DNA, 146 bp, Homo sapiens
ctgattgtggtggctgaaagtctgtgtgataagcttctctgccatcccttcttctcctccaatgaaaaagtctgttttgcgtcgaaggaagctgaagaaggtgttcacaagctcctgcacgccgccctcgtgctgctgagccatgg

SEQ ID NO: 2706 - DNA, 336 bp, Homo sapiens
  misc_feature (1)...(336): n = g, a, c or t
cacatagcgttcccctagggctctttccccggggagaatgtaggatacaggcccagcctcctggcctttctccatcagggactcagttgtctgggcccccccgtcactttatctgctagggtcccagaagtccagggtccccagctctgtcctnctcagggggcgntgaggtctccacagtctcctgatcccctanaacccaanagtccaggtacctcttcccttcctttctcctctagggcccaccanctctgagcagatcatgaagacaggggcccttttgcttnagggtttcatccatgatcgagcaggggcnaatgggggggggaggntccn

SEQ ID NO: 2707 - DNA, 347 bp, Homo sapiens
ccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcaca

SEQ ID NO: 2708 - DNA, 221 bp, Homo sapiens
  misc_feature (1)...(221): n = g, a, c or t
ctggtgctcccgagcttgggagagggcagcctgggcattcagagcgggattatctttatccacgtctgagtcgagttcctgacaagccacgcagtagattttccgctgtttgtcttggaggaggatcgtcccgcagtccgcacacgtctcgcccancatgcggtaaccgcgcagcagatagtcgcccatgagccgggagatgcgatcttgccgnatcccgt

SEQ ID NO: 2709 - DNA, 113 bp, Homo sapiens
ccactcgtgctgtacactggctaagaaactttatactcttctccagcttcttaatgatttcctgtgcctggttgtcatcttcacacagaggtgttaaagactctaatagtttt

SEQ ID NO: 2710 - DNA, 200 bp, Homo sapiens
ggcattaatactaacacagaatacttccttgaacattctgcaaaagtaggtgcagagacagaattacttcttcatttccagattaccagtatctataggactattttgagaaaagctgggaggcggagcacctcccctccccaatgtcattttctttgtcaaagcagaagagtcgaaggggtttaggtggaggagggcag

SEQ ID NO: 2711 - DNA, 254 bp, Homo sapiens
cttgaaaccttggaggaacccatgctacaatcaattgctaactaaaagcaattgtacatgtatttaacattttaccagtttctgcttctaaatttaatatagtaattccaaccaaaaaaatagtatctctgtaacattttatctatgtccactgcaagctgcagagtctctgttgccaagatttcttgacacatttaatgttttacctaaaattgtggtcagattgagcaatatcattatcctaaattatgttt

SEQ ID NO: 2712 - DNA, 243 bp, Homo sapiens
  misc_feature (1)...(243): n = g, a, c or t
ctgtagcttctgtnngacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatganacacaccagtgtggccttgttggcttgaagctcctcacaggagggcgggaacanagtgaccgangggggc

SEQ ID NO: 2713 - DNA, 344 bp, Homo sapiens
ggtgcaaagcacaagaagtcagtctaaactgcagtgaaaacacaaagattttagaaagggtttcctgaagatagatagatagatagatagttaaaccttggaaggttaccttctcttcccagttctactgaggaacatcagaaactcagcccataagccctacccagcatggtaggtctttctcatagatgagaaactcctaggttttctctccagatatgagttgagtagttagttgagtaaaaggagggggcaaaggttctgaaggcccagagagctgcccacctcacaagcccctgggctccagaaccagccagttctcagtgaccatctgcacatcctgg

SEQ ID NO: 2714 - DNA, 368 bp, Homo sapiens
aaaccattaaagtaaaatccataattttctacagagtacaacacaagttcacacaaaaaagacattttcttttgcaaatcaaaacaggaaagaaaggaaaagctcaaacaagataaaggaaaagcatttctacggctgaatcacgactgagttgattgaatcccgttgttgctgcagaacagactgtgcgtttggtcatagtggcaatttttttttctcttcacattgtgaaatcactttacattgttttctagtagaaaaggcaaaaaactgtacaaaacccctagtgttaaatacaacgtttgtaccaataaaaaactcacacaggtttgtctccaaaatgtaaagtttcttttttttttcttttt

SEQ ID NO: 2715 - DNA, 356 bp, Homo sapiens
  misc_feature (1)...(356): n = g, a, c or t
atgagggtccccnctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 2716 - DNA, 396 bp, Homo sapiens
  misc_feature (1)...(396): n = g, a, c or t
ccaacaatttttttanaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggnagataatatgctctggtctcgcctggcggtgag

SEQ ID NO: 2717 - DNA, 352 bp, Homo sapiens
  misc_feature (1)...(352): n = g, a, c or t
ccttaggacaatgggggctgtggcatgcgtcaggttacctgccttgatatgggatcgtgacaggcccctccctatgtgcaggagacaagcagcccaaggaacaggagaaaaacccagtgttggtgtccccagagtttgtggatgaagctctgtgcgcntgcgaaggagnaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcanacctnggccn

SEQ ID NO: 2718 - DNA, 484 bp, Homo sapiens
  misc_feature (1)...(484): n = g, a, c or t
ctgagtaaatggattactgcagtttagacctggtgaatcaagaaggtggcattcagtagtgagacttttattatcaaatagttctgactgagaaattttagtttccccttcttctaagatgctattttgtgaagctgtatttttttcagggctactcatcaaaacatcctgtgatgtaattgaagaattcagttccattccttccacaacatctgaaattccttcttttttgttagtattaatatcatctgctactccaccagcaagaagaggcaaactcattctctcactggataaacaatccaccttcaagtctgtcttatttacaacatggntttcttcaattaaatctggtaatccaggacactgagcatcttctatgctgctcctgctttcaggaatactcaaaaacaaagtcttcttcacatgttcacttttcgtattctgaggaccggcattttctggnggatgtagtttgttgtgg

SEQ ID NO: 2719 - DNA, 244 bp, Homo sapiens
  misc_feature (1)...(244): n = g, a, c or t
nctgtgcgtgctgtncngaaagcctcccgccctccctgcagctccccgccctnngtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttcttt

SEQ ID NO: 2720 - DNA, 287 bp, Homo sapiens
  misc_feature (1)...(287): n = g, a, c or t
ccatgtccccntntttgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggctgaggcaccaccagtgctg

SEQ ID NO: 2721 - DNA, 523 bp, Homo sapiens
  misc_feature (1)...(523): n = g, a, c or t
ctgagtttccttccnagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccatgcccacacatctccagccagccagggccctgcccagcttcaatttacagacctgactctcctcaccttcccccctgctgtccagagctgaacatagacttgcacttggatgtcacctggagtgtcacatgggagtgttatggnagcatcataccaaggacctgc

SEQ ID NO: 2722 - DNA, 284 bp, Homo sapiens
ctgggcagactgtcgggaatccataggtgagctggggacccatgtacccatggctgctggggctggggcagggaaggtggcggtgaggagaaggaagggccagcctggaagaccacgcccactccatctcgggagcaagtcttggaagggcagcagttaagggagagaccttcgtgctgagtgtccaccctggggcttccaacaagggcaggaagtgctctcactactcctaaaaagtgctgggaagcaaaatggatatatcagggagaaaagctgaaaagcac

SEQ ID NO: 2723 - DNA, 423 bp, Homo sapiens
ctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccagg

SEQ ID NO: 2724 - DNA, 301 bp, Homo sapiens
  misc_feature (1)...(301): n = g, a, c or t
aaaggaagtctttntgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgagg

SEQ ID NO: 2725 - DNA, 149 bp, Homo sapiens
cgaacttccgcttggtgaacgtcacctgccgattcctttggtccaggatgcgggagatctggatttttttcctccccatcgtcccaggctgagtggaatgatctttgtctgctcggcctgggccctgggacgctgggcgcacggacccg

SEQ ID NO: 2726 - DNA, 591 bp, Homo sapiens
ctgatggggtggtgccatgaagaaaaagagacgcttcaacagtattgataggttgatgagttgataacattctccagggcatgacttgatcagatgagccactatggtgacatggtgtgcacacagttcagcagtcccatatcgagcaaggaagcaccatgcatccatagctaacaaagaggtgatcatattagcactaagtacagcattcagcagagcagcatccagttcagcaaacagtgagggatgaaaggaagtaataaatgtacacagatgaacacaaacatgctgatacaaggtgacagccacctcagctttccccttactctttaatccctgtaaatgaacaggtagagagagttcaccagaacactgctcaaaactgtagaaaacggctttgagtagagatatcctggttgtccgtttctgagacctggctgtctgtgcaccacagggtttgcacttccttagctgagatggcagcttatccatgacaacaaccagaagaagacattgtggaaaccgcagttcacatggcaggtctaatttactgtccaaaaccacctgcatgaaaggctgaaatgtgagcag

SEQ ID NO: 2727 - DNA, 420 bp, Homo sapiens
ctgagaaccatgggttaagacccaaatagaaagtttaataaaatgttaaaataaacacctagccaaaccctgcattcagtattccagcaaagctatggtcatgctatcatcaatcctgcctgtccaacgtctcatgacatttctccctcttctgttaataacacaaacagattcaatacaaactgccaaaataccatttttagccacgagggctgagccctgtgctctttgccaatagcagcaataaagctgggcagaagctaagcccaggactgcatggaatattggctatctgtggtagtagcacaaaataagatgtataactgaatagtctatcattttgacaaatctggacttcaaaaaggatgctgggttttttttctcttaaaaagatttattatcaaaaagtttgctcccttt

SEQ ID NO: 2728 - DNA, 298 bp, Homo sapiens
  misc_feature (1)...(298): n = g, a, c or t
ccgatgagttacagnctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcccacctgttttgtggtcag

SEQ ID NO: 2729 - DNA, 476 bp, Homo sapiens
ccatagctgtcacttcctgttgcatcgtgtaagcaggtacataatgtctgatggtcctcctttctgtgatcttaagattggttggtgggtccaggggtggtcagcctaatccctccattatgcagtccctgggtgccttattcttgatctgtaaaatgtgactagattaagcacaggggtctctactccacagggatcttatgtgaatgaaatggtataacagattagaaagcactttgttttaaggagcccatagcaatcagaccaattctggacttctgctatagagtcagatctgaagggcacaccttttcctctaaggtccacagctttttttcactgttgactttctaaccatcatcattttgggggtttggcttttagctgcagtgttgtggtataaatggcacgagtgattggaccaagtggcccaccagcatcttgcccctcagatcgaaaagtggaggtaattttgt

SEQ ID NO: 2730 - DNA, 196 bp, Homo sapiens
  misc_feature (1)...(196): n = g, a, c or t
ggtccaggctgtgttggnctatatcctncatactgntgaccttgtccctgtgggtagttaggatactgaggacctggaccaccctgtgaaggaccgtagccctgctgctgtcctgggtaaccttgctgccctgngtactgctgctgctggggtggatatcccatgttgtggaggtggtccctggtatgcatcttgc

SEQ ID NO: 2731 - DNA, 284 bp, Homo sapiens
ctgtggtagagtgctgatcttagcatgcttcgatgtggcatacttgttcttgacagtcatgtgctttgtaagtccttgatttaccatgactacattcttagccaggtgctgcataactggaagaagagattcttcagtatatgacaggtaatgttgtagagttggtgtccattcaccattatccagaattttcagtgctaagcaaaaagctcctgctgcaatttgagaaggaggaaagtgcaccatgtcatagtccaacatagttagttccatcaggtatttgg

SEQ ID NO: 2732 - DNA, 115 bp, Homo sapiens
aaaaacatcaaacatactcaaaaacaggcaagctggaaagataaacaacatgacaggattcccagtttaagtcaaattcctcaataaaacaataaatgcccacgtgtttaactgg

SEQ ID NO: 2733 - DNA, 144 bp, Homo sapiens
  misc_feature (1)...(144): n = g, a, c or t
gccgccgtggantccaaaatttcgggagctgtgaccctttcctcatgtaaaacgagtagtcttggacggtgagcggacagttgccttcaacttttgggaagagctgccggttcggtggaaaagctgtggctgggaatcaggagg

SEQ ID NO: 2734 - DNA, 202 bp, Homo sapiens
  misc_feature (1)...(202): n = g, a, c or t
ctcaactgtggttgatntntctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaagg

SEQ ID NO: 2735 - DNA, 356 bp, Homo sapiens
ccactcttcaggaggatgtcttcactggtgggccccacgcaaagcttcttcatgagggaatctaagactttgggggctgtccagattatgaatgggctcttccacattgccctggagggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccatttttt

SEQ ID NO: 2736 - DNA, 332 bp, Homo sapiens
aaagaactaatttgtaaattatgacacaaaattttattaacaaggaaatatccattaattgactactacagtaaaaactttataatgcttgtatcacgaagaaagaccttccttttccttatatattaattgaactacataggcttgctgtacattttgttattcatgttataagaattctagattccattgcttttgaaatatgtttctttttaggaactaaaagtcaacttatagtttgatttctgttttatttgtactgtgtttctgattttgtgggtttctaaataaaaagatcaaacccaccactttcaatatactgttttctattt

SEQ ID NO: 2737 - DNA, 354 bp, Homo sapiens
ctggctggcaagatcacgggcatgctgctggagattgacaactcagagctgttgctcatgctggagtctccaggatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatc

SEQ ID NO: 2738 - DNA, 119 bp, Homo sapiens
  misc_feature (1)...(119): n = g, a, c or t
ctgtatgctctggganccctcaaccaccttggggagctcaccacgtctggtcgaaagatggcagagctgccggtggaccccatgctgtccaaaatgatcttagcctctgagaagtacag

SEQ ID NO: 2739 - DNA, 438 bp, Homo sapiens
  misc_feature (1)...(438): n = g, a, c or t
cttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgtcacttgcaccccaccagctccctttttggaatgggctacaccccagattacatagtgtatcacgagttggtcatnaccaccaaggagta

SEQ ID NO: 2740 - DNA, 332 bp, Homo sapiens
aaaggtccactttcatgaattgttttaagtcctcactttattttcttcaataattaaagatcatatgcatatttattggtaaaatacagtttgggtagtcaataaactcaccctggagttcccaaatgacattaaattcaaatctattcaggaaagaatctgggaatacaaccttcccatattcagaggttcaactatgctagattaaggtctactagaagcatctctagtaacccaagtaaaatgctatcacaaacaccaatttctaataagtttattacaagaacataaattgatctgtgcatatgatctttaatttatatcccagattt

SEQ ID NO: 2741 - DNA, 492 bp, Homo sapiens
ccacaagatatgttctagagacgtccatgagtcctcttgctgtgtgggagcggcatccacagacttctggaataattggcctgtgaggaagctcatcaaagctgcaaacagtacaatgaatgcaatagagagccagagggccttattagcctttctgatggaggacttgagatttgttgcccaggaagctattgtgtcataaactgaagagacatcccactttgatggattatttttcttttcagaaagacttggcttccttgtcctttctactgtttcttctccagatggctctgagtcatctttagtttttagttcacatttttcttcttcagcatctgcccaggaataggtgctaataaatcgaggtaatgagggacggtgttcactctgctttgaccccaaaatacgccaactgcttgaccttctactgaatcgatcattattttccatcccagccaccattcctgcatttccaatatttctgggtaa

SEQ ID NO: 2742 - DNA, 495 bp, Homo sapiens
  misc_feature (1)...(495): n = g, a, c or t
ctgcgtttctgtggnctctaaccgaagggcaatgcagccctcgccataggattcgtcgctgtcagaggacttgatgctgatgaggatgtgctggtctagcaggtactcagggtcagagataatgggcttcagctttggaagagtctcaccaaacttcaccaccagctccccctcacttccttcttcattttctccttcctgactcttgacaaaactctccaagcagctcgagtggaactccaggtagaatttggtctgggacttggtcttcaatgtggcatagcacctgagaaactcaatctgtccttggctgtcaacagtcccgggaccgttcttggagacaaactgggaagtgactcctgcctcaaatgtggcaaagacagggctgtggtcactcgtcatgatgtcgctggtactgccataagactgacacaccacgtgcaccaggggataagacttccagangactcggtcacaccaggaaggcaagttgta

SEQ ID NO: 2743 - DNA, 275 bp, Homo sapiens
  misc_feature (1)...(275): n = g, a, c or t
ctggagggaagaantcttttgttgcctntgagtccctgcctccccttctgatggggtcctggctgtgaggctgtcaagctgcttctgcaacttgtaccttcgggcggctaacagaggtagctggatctgcgggtccaccaggccctgcagctccatgtagacttgagccgtgtcactgagtggagcctgggcccagccggagggagctgctgcgcctgggggtaacaggcccacanccccacagtagcccagggtgcccaggggctccaagaagg

SEQ ID NO: 2744 - DNA, 257 bp, Homo sapiens
  misc_feature (1)...(257): n = g, a, c or t
ctttcatactcacggcagcaagatggaaacgtgctgtgaatctgctccatgacctccgtgagatccgtgctggtgtcgtgcggtggggccagcaggtcctctcccgctgcctggtggaactgtgggccggaggcatctggatcaagcgagtagctcantgcagaatgctgaggagaagcccatggggaaacaccattgattcgggaatcagattcaggctgctccatcagacctgcccgggcgagcgctcggagccc

SEQ ID NO: 2745 - DNA, 288 bp, Homo sapiens
ctgctgggaggctctggccccactagtccctcatggccctactgaactggctgggaggctgctggaatggcccttggtccacagctctccacaggcaagaggtcaactgctgcttgaaagaggtagacaaaagttaggttgatggcgaaatgtctctgggttacccagtcttctggagcagcaagctgagctttaatgggctaagcattagggtgttacagaaaatttcaaatgcagccatctcccttggggcagatctacctagttcatgacagtatgtgcggctgg

SEQ ID NO: 2746 - DNA, 175 bp, Homo sapiens
  misc_feature (1)...(175): n = g, a, c or t
aaaaattgattcanaaaaacttgacacctgtcatgtaggccacaaaatagtagcgaactatactaagtggtatagcccactgtggagtgtggtcttttactcttccaaatagcccaagttggcaaaggttacttaaaaacctgccccccaaaaagctaacttttggtagattttt

SEQ ID NO: 2747 - DNA, 448 bp, Homo sapiens
aaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagacctcgc

SEQ ID NO: 2748 - DNA, 145 bp, Homo sapiens
  misc_feature (1)...(145): n = g, a, c or t
cagtatgagggggagaagggtgggttctcatggatcgaagtgaccttcaagaaccccctggtatgggttcacgcatcccctgaacacntggtggtgactcggaaccnaagaagctctgcgtacaanttggaaggagaccctattc

SEQ ID NO: 2749 - DNA, 274 bp, Homo sapiens
ccagtgacacttttgcctgaatttttgtcatacatgtggaaagaatgaaatatgcagccatgtggaggataaacaagacaaagtctaatttcattaaacattagagcatctcagaggagacccccagtgagtacctcctctctgtaggcaagtagactggttgagtgttcagctctaagcagagagggtagctcctccctacagccggtcgtcctgtggtcttcccatttctcaggagagagggtagcttctccctgcagctagtcgtcctgtc

SEQ ID NO: 2750 - DNA, 405 bp, Homo sapiens
  misc_feature (1)...(405): n = g, a, c or t
taatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagagcccattcataatctggacagcccccaaagtcttagattccctcatgaagaagctttgcgtggggcccaccagtgaagacatcctcctgaagagtggcnttggaccacattgcattncaanagggcctntcattggctctgccgggaaagtcccattttact

SEQ ID NO: 2751 - DNA, 448 bp, Homo sapiens
ttttgtgtaccttgatgggcatgtttctagagtcagaactatatcacactgtgtcagggggagaattgcaaaaaaagaaaaaaaaccctacacaatattcacacaggggcagcttctttgacacttgagtgtctccctgagctaaaggaagcctcacttcaaaaacacctgagtcctgtcacaaaatcagctatacccagggaacacccagcactttcacggttttgtctgattctttatttacatatgcataattctatagtgttaatctgcatgatcacagtaagcacactgaaaacagcacctcagagtgagggctagatttggggtcgggtgtccagcctgtaccctcctgtcaccttctgtggtgcccccgtgccctgctcctcagcttgtcactagggagtcagcctgcggctccgctcctgacccatggagcgtcaatcag

SEQ ID NO: 2752 - DNA, 331 bp, Homo sapiens
  misc_feature (1)...(351): n = g, a, c or t
ccagtgatcattgnaaatgttagccatacagacttttaatgcaagtagtgctagtctcaacagacttgagagcttcccactccaactgccccgttgggatgccaattgtagactctttctgtaacacatctctgcagctctcatcattccttgggattgatacacatgtgccagccactgccaagctggaacagaggttgagttggacatgactgttttttgtagttcttcaagtacagcgtctgggagtggcttttgtgactccaggagtggtttacactgaacttgtctcaaaagtaagataacggctggctgatcagggttacttttt

SEQ ID NO: 2753 - DNA, 233 bp, Homo sapiens
  misc_feature (1)...(233): n = g, a, c or t
ngagctctaggagggaccacattggaaattccatccacccactcatccacccatctgatcattcaatcatctgtttatccaatcattcatccattcatccatccacccacccattttctgggctccaattttctgctaggccctggaaacaaaacacacaaaacccccaaacaaacaaaaaaacaaaagagtaaaagcctcatagaaaaaaagctgtttagtgaccagcctgg

SEQ ID NO: 2754 - DNA, 434 bp, Homo sapiens
  misc_feature (1)...(434): n = g, a, c or t
ctgcccctcctgggccgcttggtgagaggtttggtttgatacctctgcctccctcctgccagcatggattctgggtggacacagcctcgtggaaggtccagtaccaccaagagctgctcatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccangcccctcctctgtgtgccccag

SEQ ID NO: 2755 - DNA, 293 bp, Homo sapiens
  misc_feature (1)...(293): n = g, a, c or t
actccctcagtgactccaaatcccgctttcccttgnactgatccacctggccgagacacgggcacgcggctgagtgagtccactgaggtgttctgaatcacttaagccttcctgcaacccctgcttgcccgggtcagagctcccagatgtcttagcggtggtgcaaagtctgcatgttcatatttagacgggaatgtagagaggataactgaatgcctcggctttggtgagagaactgtacaggcccctcttccctccacggggttacacatcacagaagtctggggnagagg

SEQ ID NO: 2756 - DNA, 344 bp, Homo sapiens
gggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggttt

SEQ ID NO: 2757 - DNA, 105 bp, Homo sapiens
  misc_feature (1)...(105): n = g, a, c or t
ctggaactgcacntagtcccagctctcctcggccgcggtctcctcggggntggtgccgtacttttggatggttttctctacnacntcccgcaagcttccntccag

SEQ ID NO: 2758 - DNA, 492 bp, Homo sapiens
  misc_feature (1)...(492): n = g, a, c or t
cctagcattttgttagggaccatgggagatgtgaaggaagttatctcacacatgatatgtcttcaaggagctaaaaatgccagtggataaaagcaaaacacatggaaaaacaaagtacaaataataatccgtgtatattgtcaaaaggaacattttatcaaaaggtaggattgtagctaaggttggcttgccttcttccctcttttattcaacaaacatttaatgaaggcccactatgtgccaagcacttggtacatgatggtgaataaaacaaacaaggtttctgccctcatttacagcctggtaggggagacagaaatgaacaagtaaaagtagcatatatataaactgcaataaatgcaatgaggggaaaagacaagatgtggtgacagacacagaagtagactgctcanggactgaagggcccgggaattgtcaagacttgaggaagaaggacaccacctgagtcaagagtggtgggggtggagagct

SEQ ID NO: 2759 - DNA, 209 bp, Homo sapiens
  misc_feature (1)...(209): n = g, a, c or t
natcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 2760 - DNA, 231 bp, Homo sapiens
  misc_feature (1)...(231): n = g, a, c or t
cattatcatttttcctttgaccaaacacttcctggagtntttctccgttgctgccannagngatccggaaataatatacatactgcctccccaganagggtaccacacatgcacacagatgggtgcatagatccctgctgggatcatcaagaagaccccccagggcaatgtggaagagcccattcntantctggacagcccccaaagccttanattccctcatgaagaagc

SEQ ID NO: 2761 - DNA, 408 bp, Homo sapiens
  misc_feature (1)...(408): n = g, a, c or t
ctgtctcatatntccagcaccgggcaacgttacgaatggtgtaaccaccgcctcccagcatcagcataggcaggttaaagctcttgacaaattccacacacttggcgtgtcctttgatagttagattgaagcaacctaaccgatccccagatagggagtctgagccacactgtaagaccaccgcactaggctggaacatctccattactttggacatgacctaaaatgatacatcctggtcaccaccaacctcaagaaagcaatacgaggtttggagtggaaaggctgggtgcaacactttcccacccactcctacctttccactctccctcatgctatgtgggagagaaaagggagtgctaggctggagcccttgcttgcccacttgggatttcaattttccaattt

SEQ ID NO: 2762 - DNA, 277 bp, Homo sapiens
  misc_feature (1)...(277): n = g, a, c or t
ggtgcctcagccatggcctggaccgttctcctcctcggcctcctctctcactgcacagactctgtgacctcctatgtgttgactcagacaccctcagtgtcagtggccccaggaaagacggccaagattacctgtgggggaaacaatattgggagtaacaatgtacactggtattaccagaagccaggccaggcccctgtcctaatcatctcttttgataacgaccggccctcagggatatctgaacnattctctggcttcaattctggggacatgg

SEQ ID NO: 2763 - DNA, 370 bp, Homo sapiens
  misc_feature (1)...(370): n = g, a, c or t
caagtcacagtttccagcgtgctgctcagccctccgagtgtgtgtgctcatccttttcatagaagtcccatcggccatggagagggttgggctgcagagctgtgattgccagaggcccttccttgagaactgtggggaaggaggccctgggggtttcttctgtaggcagagctcaggccccagtcacctctgccaccctcagcctggcactgttgtgccagagcctctgctgcctctctcttcctacccatctgcagaccagcagaatattctccccctctcatcaccaaccaggagtttggtgtggtttctggacaccggccagagcantcactgcggggctggntttgctgggcttccctgtcaaagc

SEQ ID NO: 2764 - DNA, 198 bp, Homo sapiens
  misc_feature (1)...(198): n = g, a, c or t
gatgaagccttcctggcccgtggncagggactgngccttccaccactcgccgctctgctccaggatgcggagctgttcccccttctcaaagcccagatctccgncgtgagagggctcatagctgtgcagagcgataaccaggttgncttgcngnggggaanccggcggantggagccttcgaangnaaccnggggggg

SEQ ID NO: 2765 - DNA, 411 bp, Homo sapiens
acattatggagcagcgtccctgaactgcaggaggagaacctgcaggactcctgggtaggattgcacttttgcaataatggaaatgggagcaatgtttcagcctaagtttctatttataatggtgacaaaaaaatactgctggattcccattatgggtctcgatagagtgccaaagagttctcattgtgacagcccaactcactcagaaacaccatgagacacttttgggtgtcccttctgaagacagacactgaaagcattgaagagaaaaacagctctcagtctgaataaaattgtattacgaggttaaaagcatctgaaagagaaattcagactacatataatattagccaagtcgaccagaaaatactcccctgagaaagtttctctctaaatacccaaaatgcacag

SEQ ID NO: 2766 - DNA, 458 bp, Homo sapiens
tatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggag

SEQ ID NO: 2767 - DNA, 372 bp, Homo sapiens
  misc_feature (1)...(372): n = g, a, c or t
ntcacgtggaccttggtcaatgttggaggtagattcagacatcaaaggctctccagttttagtggatacctgaggatcttgagactgtacattattctgaaatgatgaaggtctaggcaacagcatgtcttcagtaagaccagaataatcctcttcaataaagagtccaggaatagaagggaaaatccagtatcgtctatacatgcggtcgcgacccaagggaaagatattggtacaggctatggcactttggattttttctaagagctctttctcttttcgttggtgttcctgttttaatgcttcttcctcatcagcagtaagaggctctcttgttacacagttgatctgttcttgccttgtaaattcttt

SEQ ID NO: 2768 - DNA, 375 bp, Homo sapiens
  misc_feature (1)...(375): n = g, a, c or t
nactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccnagatgtcggtgatggcctggatgctgtaaccac

SEQ ID NO: 2769 - DNA, 290 bp, Homo sapiens
ccatgtccccttaattgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggctgaggcaccaccagtgctgctt

SEQ ID NO: 2770 - DNA, 504 bp, Homo sapiens
aaaagcccagattctactcataaaaatatgaatggagaaaagcaagtagtgtctgtgcaacacagtgcagtatattgtacagaatatttttaaggccatggcagtctataaattaaaactgatattcattaaaagaacttactgttgactacactctgagtgctcaacacatttggaaatgcagtctacataagtgctgcttaacaaaagaaacaaaatcacacacagtgtgaggcaacacataagcaggtgtaccatagagttttatctactacagtggtctatatgaataataatttacaaatgaaccagtattaatatgtccctttatgtatacggaagtcgctaaactacaaaacatgtccatttgaagtttttagacatctctgtatcatagaagcaaacaaacagcatcagttcctcagttctctgtgtgactgattattaaacaacctgtagacattgagcatgattacattagataaagcaggcaggtctagagtt

SEQ ID NO: 2771 - DNA, 189 bp, Homo sapiens
ttatcttcatttgagttaacagcacacaggtaagagtcagagacatttctaggtctttgtaggtgtgcacgtgtgacatgtcttatcaatgcagacccaccatgtgtgcaggggtggcctgggccccgctggttgggtgtccagctccttgcttttccctctttctgttttccccctgcgtccttccag

SEQ ID NO: 2772 - DNA, 272 bp, Homo sapiens
  misc_feature (1)...(272): n = g, a, c or t
tgaagccagagaatcgctcagatatccctgagggccggtcgttatcaaaagagatgattaggacaggggcctggcctggcttctggtaataccagtgtacattgtgactcccaatattgtttcccccacaggtaatcttggccgtctttcctggggccactgacactgagggtgtctgagtcaacacataggaggncacagagtctgtgcantgagtgaggaggccgangaggagaacggtccangccatggctgaggcaccaccagtgctg

SEQ ID NO: 2773 - DNA, 299 bp, Homo sapiens
  misc_feature (1)...(299): n = g, a, c or t
nagccctaaattttttccagtattggtcaacactgagggtanaanggttgggtgaacanaatattaacaaggtaaatgatctctaatcangaaggaaatgatcatcccagatgctgaattntccttgctataatactacatcctatcttctccaaaaatcacttttgaaaaangcncaccccctagattagnacttgcatacnanacttgaggacctgcccgggcggccnctctaannggcnaattctgcanatattcatcacactggnngccgctcgagcatgcatctanagggccca

SEQ ID NO: 2774 - DNA, 203 bp, Homo sapiens
  misc_feature (1)...(203): n = g, a, c or t
tcacgctggaccttctgcactaacatgtgatttcttatgattgaaggatcgtgcaagattctcttggtgtaatgcttagtctgagagctgacagatttcacaagcttatcttttttactactaaagtcatacatgctaattgtagaatatttggggtaaaaaaagaaaaaaattacattaataacatggtctttccagncttt

SEQ ID NO: 2775 - DNA, 368 bp, Homo sapiens
atgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaacttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttcttta

SEQ ID NO: 2776 - DNA, 271 bp, Homo sapiens
  misc_feature (1)...(271): n = g, a, c or t
tcacgtggaccttggtcaatgttggaggtagattcngacatcaaaggctctccagttttagtggatacctgaggatcttgagactgtacattattctgaaatgatgaaggtctaggcaacagcatgtcttcagtaagaccagaataatcctcttcaataaagagtccaggaatagaagggaaaatccagtatcgtctatacatgcggtcgcgacccaagggaaagatattggnacaggctatggcactttggattttttctaagagctctt

SEQ ID NO: 2777 - DNA, 398 bp, Homo sapiens
agctagcaaaccctcccttgccacctatgattctagaagggattcctcggtcacatcaactaaagtagctaagctactgtaatgatttgaaagtttgttatgagagaattatgctttgtcaagccaactataaggcagctttctacaacagttctgcaaaatgtttccaccacattgagcaaagctgacactagacactagctacacgtgggaataggaagatgggccagactcagagccgccgcaaaggatgaagtccactcagatttgaggcaatcctggggcaaagcactgagcaaagcaacttctctggtaatctcctcctcagccattctctacccaggatttcagaacacagaacagaagaaactgcaaaagccctgcaggatatatcacag

SEQ ID NO: 2778 - DNA, 214 bp, Homo sapiens
tttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataaaatataaaac

SEQ ID NO: 2779 - DNA, 215 bp, Homo sapiens
  misc_feature (1)...(215): n = g, a, c or t
cttcagaatatttgtaaatctacttctagatgtactacacatgatctgcttttaaactggatttgngtctatggaataaacttaagtcccaaagatagatttcagtgattccctcaatttgagcccttaggatttaggtgtttttttgntttgttttgttttgttttgntttttttttttgagcaaatgaacttatgatttggatttctgagcan

SEQ ID NO: 2780 - DNA, 445 bp, Homo sapiens
  misc_feature (1)...(445): n = g, a, c or t
ctgaagaactgagacaggaggtggcactgctctgacaccatcctttgaaggtgacagagcatctcagggcttgggggacgccagccggactttgagaggagacagaagaggtgcttgcagaggtatttcacaaagatcagggtctcggcccaaaagttgacttctgctttttcaaacaggtagtcttcttccacctaaatcagatgaaaaagccgaaagtcagtcttacagggaatggtgacaagccccagtccagaccaagcagtaccctgccagatgcaagaggggtttcccttcccccacctgacagagggtgcactcttgcctgtcaacatccatgtacacacaccacttgcagccttgaaggncaccttctattttcactcactgtatttctccaccagagaggaattttttccccagacttaacatgaccttggataaa

SEQ ID NO: 2781 - DNA, 270 bp, Homo sapiens
  misc_feature (1)...(270): n = g, a, c or t
cccatcctcagcacgtggattcgagtcaccgtgagaattccggtatctcaccctgtcctcaccntcagggctcccagggcccacactgtggggggggacctgctggagcttcactgtgagtccctgaaaggctctcccccgatcctgtnccgattttatcatgaggatgtcaccctggggaacanctnancccccctctggaggaggancctccttcaacctctntntgactgnagaacattctggaaactactcctgtgatgcnnacaa

SEQ ID NO: 2782 - DNA, 310 bp, Homo sapiens
  misc_feature (1)...(310): n = g, a, c or t
tgctcagtctgggcctaaggaagcagcactggtggngcctcagccatggcctggaccgttctcctcctcggcctcctctctcactgcacagactctgtgacctcctatgtgttgactcagacaccctcagtgtcagtggccccaggaaagacggccaagattacctgtgggggaaacaatattgggagtaacaatgtacactggtattaccagaagccaggccaggcccctgtcctaatcatctcttttgataacgaccggccctcagggatatctgagcgattctctggcttcaattctggggacatgg

SEQ ID NO: 2783 - DNA, 478 bp, Homo sapiens
  misc_feature (1)...(478): n = g, a, c or t
ccaaatctttntttttttcttggagctgtaagatcttttcttctactgntccctcacaaacaaatctgtgtatgacaacatctttctgctgccctactcggtaaattcggtcacaagcttgatcttcaagtgatggattccagtgcatgtccaaaagaaagaggtgatttcctccagtcaggtttagaccaacacctccggccaagagagagattagcattacctgagggcctctggagtggttaaatgcctctaccaagtccattctctgcttgggattgacagagccatcgatggtggcataagtcagtccatgcttcttcaggtgcaatgctacaactttcagcatgttggtccactgagagacaatgacactcttttgggatgctgaatttctttgaattgcctccaattctgccaacagagatgaaatcttggtgctctctcgcatgccttcaaaaagctccatcttgaagaa

SEQ ID NO: 2784 - DNA, 337 bp, Homo sapiens
  misc_feature (1)...(337): n = g, a, c or t
cgaggtccaaaccaggtcntcaggcatcccaggatttccaggcatcagatggagggtgagggctgcccagaaaatgtcagtgtgtgtcaacatttactgcaggttcagagctccctccggggtccctgagtacatcatgtgctcctgagagttttaagggaaagccaagtaaagacgtgatgatgttctaaacccaagcaattaataaacgccacggaaatcagtcattcacttaccaagtatttctctgctttctgccatgtcacgggcccatgatcccctggagattgagggaaataagatcacaggagctcccagtctgagtgagaaaaggcag

SEQ ID NO: 2785 - DNA, 295 bp, Homo sapiens
tttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagctctctgaatcccgggaccccttcacgtgg

SEQ ID NO: 2786 - DNA, 179 bp, Homo sapiens
gtgttggcaatcgttttcgtaagagtcagaaaaattaggccggtttcacaatatagagtgtcctttctggtcaacagtattgcttcaggacagaagagcatttcacagatctttcctgtaacttctagaaaagtcatccagccagatttaggctcaagcttctttacaaagccattttc

SEQ ID NO: 2787 - DNA, 238 bp, Homo sapiens
  misc_feature (1)...(238): n = g, a, c or t
gcccaagcacagccctgactaggatgacagcagnacaaaagaccacctttctcccctgagaggagcttctgctactctgcatcactgatgacactcagcagggtgatgcacagcagtctgcctcccctatgggactcccttctaccaagcacatganctctctaacagggngggggctacccccagacctgctcctacactgatattgaagaacctggagaggatccttcagttctgg

SEQ ID NO: 2788 - DNA, 333 bp, Homo sapiens
  misc_feature (1)...(333): n = g, a, c or t
caagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagaccccattcataatctggacngcccccaaagtcttanattccctcatgaagaagctttgcgnggggcccaccagngaagacatcctcctgaagagng

SEQ ID NO: 2789 - DNA, 449 bp, Homo sapiens
cgaggtctgagctcctctggttcttctctagacctgctccctctctgaaatgcaaggccgtgcctttaatgggcttttggcattctgtctccagacctcccttctcatctgaagggctctcaggagaacagagaaaaaaccagcctgtctccaaactggcccgtctcagggactgggggcctttacccccagtgaaagatgcagactttacagcgctgcagtacagtagagtcaagtgactccttcagatagttggatgggtctctcgatcattcctgataataacattttgcctatgttaagtgctttccacctatcatgttaccttctaactactcccttggttggatacaggtattagccccatttcacaattaagaaattgaggcttaaaaggattaaagagttttttagaggagaaacagctcttccttacagaaggatcccaa

SEQ ID NO: 2790 - DNA, 219 bp, Homo sapiens
  misc_feature (1)...(219): n = g, a, c or t
tacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgngaca

SEQ ID NO: 2791 - DNA, 374 bp, Homo sapiens
ccaccctgaccatttacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcaagtggaagtcccacagaagctacag

SEQ ID NO: 2792 - DNA, 316 bp, Homo sapiens
  misc_feature (1)...(316): n = g, a, c or t
aaaaagtgaggtntttcttaaaagtttagtatacaaacaaaatgaaggtaccttcacattttactacagatgtgcagatagttttcttggtgcacagagataaggcagaattaagtcagaataaacgttctaaaactgacctccggaagaactagtcttagtcatttctttgcagagtatgtgaaccaagattcgggtttggtctttggtgttagcactgtgtcaaggatcagatagaaagtacaaatggaggggcccctttctgaggccaggccccactgttggggcatgtggggtgaccaaaggccaataccag

SEQ ID NO: 2793 - DNA, 429 bp, Homo sapiens
aaaaaagttaaatggagatcttctgggaaaccaagccatgaatgcgagtttgtactaacctagccctctggaggccacatctgtagcaatcagaataggagcttttccatgtttgaattcatttagaacccagtcacgctcttgttgactcttgtcaccatggatacccatggcaggccacccatctctcctcatttttctggtaagctcatcacatcttcttttggtttccacaaaaacaatggttttattctccttctcactcatgatctcttccattagacgaataagtttttcatccttttctacgtcatgacacacatccacaatctgaagaatgttgtggtttgcactcagttcaagtgcaccaatgtttatatgaatatagtctttcaggaaatcttcagcaagctgtcttacttcttttgg

SEQ ID NO: 2794 - DNA, 216 bp, Homo sapiens
  misc_feature (1)...(216): n = g, a, c or t
ntcaagaagctaagaagaaagaatctgttagaaatgctgaagcaaagattacaaaacttacagaacagcttcaagcgactgaaaaaattcttaatgttaacagaatgtttttgaagaagcttcaggaacaaattcacagagttcaacagcgtgttacaattaagaaagctttgactctaaaatatggagaagagcttgctcgggcaaaggcagtgg

SEQ ID NO: 2795 - DNA, 44 bp, Homo sapiens
  misc_feature (1)...(44): n = g, a, c or t
tcaagtccagtgtgtctgcctgtgactcctgcctgggggcccan

SEQ ID NO: 2796 - DNA, 347 bp, Homo sapiens
  misc_feature (1)...(347): n = g, a, c or t
ccaccatttcccntgcatcgtctctcctacgtaatcagtccctgatgaactctcttcccataaaaatccctgtgtcctaaagtcatggcgtgctctatttcatggtcatttgtagagcacagcagcactgtgcctgtcaggaaaagtgtgtgctaactgcaataagcatgatgactgccatcacggttttgttattctctgtccacctccatggtctctaaatcagacaatctttaatctgaaaaggcagtgtccttattcctccaggaaactggatagaaacgctcctcatctaatgaagtcagccctgtcatcttactgattctttcccagaccacagtgaaagg

SEQ ID NO: 2797 - DNA, 155 bp, Homo sapiens
  misc_feature (1)...(155): n = g, a, c or t
ccatgaggaccagccgcctgtccagctcatgaatacgctcattcttcatctcnatgacaaagtgtaagctctccagctcctgntcccagaactggctggggctcccataatcntgnatatgnttcttatagnttgggcnnagaatggactcctcc

SEQ ID NO: 2798 - DNA, 294 bp, Homo sapiens
  misc_feature (1)...(294): n = g, a, c or t
aaagctatctgacgctaatgacttgtacaatctggtttgcaaactctgagagacagtatcaaataagcactgtcaaagactactcccagctaatctttactgccatttttctttgaaattgtctttgggactggctatgttctcactgtagcttccgtttatcccacagcacaaaccctaaagtccatgtgcagtctccatgttcaagtataaaagtctgtttcaggacaaccctgggttgctgtagtgtttctctctctgtagtgnctacttggtgtcatgcccttggacagg

SEQ ID NO: 2799 - DNA, 311 bp, Homo sapiens
aaatccaagtctcttgaggaccagagaagcactgctacctttttctttattcaacacagataccacagaatcagcagggtgagaaacaattgcacaaaagactccagctatgtaacctgctacaaatgttacaaccagttagtgatcaggtgagggttctttgaacctggttctatcagtcgaattaatccttcatgatgggccactttgtccttccagctcttggtcttattagttgccatctccagcttctttttaacttcctcgtactgctcaagtgcttgcttccgttctaactcaagctgctccag

SEQ ID NO: 2800 - DNA, 373 bp, Homo sapiens; identical to SEQ ID NO: 142

SEQ ID NO: 2801 - DNA, 287 bp, Homo sapiens
aaaattcccaaaaggattatacaaggcagccaaaaattcacaatctgaaaaatgatcaaacacattattaacccgtccatgtgacttggcagtgaggtggcgctgaatgatttggtgcagcatctctctgcattcatttaacagcctggataacacattccggtcaaaggtataatccacctgatggaaactgaccacggtcatagcaagctgatgaactttcttcttaaatttctccatcaatgctagctcatcttgattaaactgattatccctataaagaatgg

SEQ ID NO: 2802 - DNA, 424 bp, Homo sapiens
gcgttgtgaggggtgtcagctcagtgcatcccaggcagctcttagtgtggagcagtgaactgtgtgtggttccttctacttggggatcatgcagagagcttcgcgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcag

SEQ ID NO: 2803 - DNA, 493 bp, Homo sapiens
ccagtgtaaaaaactctctccgggtcagggatatactcagtactgagctcatgcttgggcaccagtccctgcacattgttgtagaacttcacaatgcagccatagtccttgaccctgatgatgaagccatgtgtctgcagaccaggcttggcatcggcatagcaggtaatgacaggtagtttggactcaatcagggtttttttcagggtcatcatcagcttcttggcttcagggtcacaaagcaaaacccggcacttgacctcatccccgatgtggtacttcttctctggattcttcatcaggatgtcagccaggtgcatgggaggtaccaggcccctcatctgctcgcccaccttcaccagcatcccatatgactttatggttagcactgtgccctttaccactgccccaggttcgatgtcatgatatctaaggtactgagcttcaataatagacgttcgtagagagagcaaggccagttcatccatttggc

SEQ ID NO: 2804 - DNA, 398 bp, Homo sapiens
ccatgtaagagtagggtggccgctcagacacagagttctgccaggacgctgatggtctcgaaggctcctcaaccttaacctgtcgctgctccaggtgacaattctccttttcctccatctcttgcttgatgctgcgggagcccagtccatcagaactcatctttcgaagccactggatgttggataggctattgttgatagtgcagcctgctgcctcaccatctgcacaggtctcccgtttctgctcgcaaagggctccaggtggtctaggaagattcacatccctagctgcaggttttggtcccaaggtctccagggtcacttctgtccttttggcatcatagctggtttggatttgaggccggagtcctggaggctgagttggggctcccccacag

SEQ ID NO: 2805 - DNA, 250 bp, Homo sapiens
  misc_feature (1)...(250): n = g, a, c or t
ntcgaggtccaccctgaccatcaacagggncgaagccggcgatgaggccgactattactgtcaagtgtgggatcgtaataatgaccatgtcntcttcggcggagggaccaaactggccgtcctaggtcancccaaggctgccccctcggncactctgttcccgccctcctntgaggagcttnaagccaacaaggncacactggtgngnatnataactgacttntacccnggagccgatgacncngncctg

SEQ ID NO: 2806 - DNA, 615 bp, Homo sapiens
  misc_feature (1)...(615): n = g, a, c or t
ccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgtgctgtttcctcaccacagaggttcctgaggtcacagtgttttccaagtctcccgtgacactgggtcagcccaacatcctcatctgtcttgtggacaacatctttcctcctgtggtcaacatcacatggctgagcaatgggccctcagtcacagaaggtgtttctgagaccagcttcctctccaagagtgatcattccttcttcaagatcagttacctcaccctcctcccttctgctgaggagagttatgactgcaaggtggagcactggggactggacaagcctcttctgaaacactgggagcctgagattccagcccctatgtcagagctcacagagactgtggtctgcgccctggggttgtctgtggggccctcgtggggcattgtgggtggggcactgtcttcatcatccgaggacctcn

SEQ ID NO: 2807 - DNA, 456 bp, Homo sapiens
ccatcttgaacttggaagggactatgtccagaataagtgggctcatggaactaactggttctaaagcctcaagatagggggcaatcagatttgaggctgagagaggtaaaccaagattttctttgaaggtacgggctttaagaaagcaaaagtggctgagcgtgttggctcacacctgtaatgccaaggcaggaggatcacttgagcctaggatttcgagggcagcctgggcaaccgcgagacctcgtctctgcaaaaaattaaatattagttgggcacggtggcatgtgcctgtagtcccagctacttgggaagctggggttgggaggatggctcgaacctgggaggtcaaggctgcagtgagctgtcatccttgccactgcactgtagcttgggcaacagagcaagagtctgtcttggaaagagcaaaagtaagttgctgtttgtatttccagg

SEQ ID NO: 2808 - DNA, 308 bp, Homo sapiens
aaatcacaacattctggtcgatataacagatagaaattcctgatctagacagcagaattctgttgtgttaagagagaatacacaattatagctaaactctaattctcactttatataaatttatttacactcacctaactacattattctaacaaaacactgggacaacttgtaaaagtacttatgcatatgtgcaggacaggaagagaaaataaagaatcagatttattggggtggttaagtgagatcatggatgaactgtttacttctattcagcagtagcctttgtggtcccaggcttccggtgg

SEQ ID NO: 2809 - DNA, 101 bp, Homo sapiens
ccaagggaataagcaagaggagacatttcctccctgccccagcactctgtcccaatccgagaagttccgaggctttcccggggcagtctgtgtcacgctgg

SEQ ID NO: 2810 - DNA, 436 bp, Homo sapiens
aaaaggcttccttttctgttaagttctgagacttaataaatgagataaaaacagtttcttacacctaagaaactgggttatgaaagctgtgcctaggatgttggggagagcacactgggagaaggcattcttgctggtaccttgagttcaggaatctacgttgaggcttcctcatccaccatgatcacagccccaggggatgctgggcttgttagcattcaagctctgggacctgattggcctctctgtctcctctaagtaaggacaactgatggggacagtctcccactctctgaggcttcgatgttccacgcatggctttcctcttccagaaactcccctccctggctctcccatgcagccctagtcagcagcagctcacaggtccgtggacagcgagtctgggatctgtttgccttcttcagccgatttgctg

SEQ ID NO: 2811 - DNA, 472 bp, Homo sapiens
ccactcccctttcttcttaggcagattctgccccatgtaagcaaaatgcctcagatcctggcaaagcagcgttgggggtacctcttcttcccaaagtcctggtcagttccccagaaaggaccagtcatggctgtgccagggtgactgccctcccccaggtcagccctgtcgacaaaggcaggggcttggttgtcatttccaccaagtgggaagacagtattaatagatggagaaccctctgcagtgggaagatttcagcaatgggcaagctggatagagccgtggttaggatggagttgtttgcttgttgcacttggagctctttatgaagcaagggctctgcctcccagcctgagacccagaccctggtttggacccagtagaactcttgtgggccctgggttggtgtctctgagcaaatccccaaagcaggagagtccctagcaccgtgagctctgtcagaacctcccag

SEQ ID NO: 2812 - DNA, 347 bp, Homo sapiens
ctgaatctgtctttcattcgaccccctgaaaaccctgctttgctgttaatcaccatcactgccaccaacttctcagagggtgatgtcacccatttcatctgccaggctgctgtgcccaaggtttgtaaagatcagagttcagaggtggcctggggactccaggagaaaaggccactaagtggaggaggtgggtgggagacagtgtgagatgggattgagtcatctggagatcagcacttggggagttacaggaaaagggtgtggagccactgagtatagaggggctgcctgagccctacctactgccatactgtgctctgttaaactcctgtgttcagagtctccag

SEQ ID NO: 2813 - DNA, 264 bp, Homo sapiens
  misc_feature (1)...(264): n = g, a, c or t
ncgaggtccaccctgaccatcaacagggtcgaagccggcgatgaggccgactattactgtcaagtgtgggatcgtaataatgaccatgtcgtcttcngcggagggaccaaactggccgtcctaggtcagcccaaggctgccccctcggtcactctgttcccgccctcctctgangagcttcaagccaacaaggccacactggtgtgtctcataagtgacttctacccgggagccgngacagcggcctgnaaggnagatagcant

SEQ ID NO: 2814 - DNA, 218 bp, Homo sapiens
  misc_feature (1)...(218): n = g, a, c or t
ctgctccangcnctgcancatcntcanacncagggcttgnaacttnntggncantgngattatttctctttcttnctcntntnnnantnnttcaacaaanctgtncnncnccggnattnnaaacttaangtactgancnacttcatgggggactnccacncccnagtcannttccatcacgaanatcctggngancgactnacanggaccatgcagga

SEQ ID NO: 2815 - DNA, 385 bp, Homo sapiens
  misc_feature (1)...(385): n = g, a, c or t
caagcctcatcaataactgtatccaaaaggagacgctgcttggggtgtacccagagaaaacaccaagctttcctggcttcccggtcctccctctccccattagtctttggggtgcatacataagtgttgtgtgaagtctcttggggtttagaagatcttgcactcattgatggagaagagcctccttctgtttcgtctcctggcctggttgacggcagttcggacggcgcactcaaacacctgctgtactccccgattgctaagggctgagcactccaggtagcccttggctctgacatcctgggccagtttcttcccttccatggcattgacncangaggccctgaggggccccatctccccctggtcangtctgggtggaccc

SEQ ID NO: 2816 - DNA, 367 bp, Homo sapiens
ccaaaactgcgaagagatgcagaataatgttgacaataataagttgctgaatcgtcaggctgcagactggtgatggttaaattgaattgtgtcccagatccactgccagtaaatcttaatgagaccccttcttctaaactggaagtcgcataaattaggacattaggggctttgcctggtttctgttgatgccaggccaaccaccgatctatattctgagaggcccgacaacttattgtaactgtatctccgacagatgcagacagggtggaaggagattgggtcatctggatgtcacatttggcacctgggagccagagcagcaggagccccaggagctgagcggggaccctcatgtccatgctgt

SEQ ID NO: 2817 - DNA, 373 bp, Homo sapiens
  misc_feature (1)...(373): n = g, a, c or t
tcgaggtctggacttctttaagcgactcnttcaactgtgtcacgtgtcctttcagtagtatctgctnccgtatggactgctctaactgccgcttgagaagtgctttactgcggctcgagaacccatccggcttcttcttctgtgtggcggcgacagcacagagagaccactctaactctcctatacgctgcgatgaacgttgcaggcggccggccagatccttggactcttcttcaaagtatctgagagaatgtttcatgtgatacaggtccgtatttagtttctttttctctatgntcaatctctgganttgaccctctagctccctttcagctttctgnttctcattgtctgctttctttncttcttncag

SEQ ID NO: 2818 - DNA, 226 bp, Homo sapiens
  misc_feature (1)...(226): n = g, a, c or t
cctgtcctcttaggactcaaannnagaccctggactgattttccagtccccaccgtcctgcgggacagccagcgtatgctaatgttgcaaacccatgataatgtatgtggaatatcctgccattggggttttacattaaaaccccanaatggctgcagaggggngaacaggccccaatatttggggngctgtgatacccctcttctacccacaaggagccctctcg

SEQ ID NO: 2819 - DNA, 436 bp, Homo sapiens
  misc_feature (1)...(436): n = g, a, c or t
cctaaaaaagcggnctcggngggaatgcatttctcttgctccacgtctattttagttgcatatctgtagtgatgacaaatgcctccagccttgtcctctgcaaggctgcactgggctgcatacaggctcctgtctcaggtgtctggtttcctccttgaaaggttggggcagcagagtcagccctgtctatctgggcaaggccctgacacttggaagcatgaaaagccatggttcaggtggagtgagcttccaatgcccttggaaggattttatttcanggccgtggggcttaaaagtcatcactgtacaatccactgggagcaaagatcaagataacatgtgatggatatcataaaagcggaacagaacatcccattgctcagagatggganaacaactctgaatggagagggctcaggttatatacattcaccct

SEQ ID NO: 2820 - DNA, 294 bp, Homo sapiens
ctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagtgtctcttactccccgcccag

SEQ ID NO: 2821 - DNA, 277 bp, Homo sapiens
ctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtgg

SEQ ID NO: 2822 - DNA, 246 bp, Homo sapiens
  misc_feature (1)...(246): n = g, a, c or t
aaaacgaccaccacagatttttatttaattaaaaatattatacatgttgntgcattttcatggaaaaaatttgagttaaaaacacaagcagtgttaatttcaaaaacccttctgccccccattctgcccctgntggctttttttggccnatgggcatttaccacctggtttggaaagaaattgggcccatcgaactgggaactttcnaaaaaggcattacttnngggcttcctggaagtaaggccn

SEQ ID NO: 2823 - DNA, 341 bp, Homo sapiens
  misc_feature (1)...(341): n = g, a, c or t
ttttttgantcaatttcctttaatgantacttgttacagnaaaanaggnataaagtcctgttcccaagtccaaaccactttttaacttaaatcttgagtttttctgaattactcaatttgaagtaattctntttatatctgaaaaatggttttattgaaacntttgaaantaaaaaatatgcattgcaanaagcatatgacaaacattntganagtacaaaattagttgtaaaaaataacataatttaccagtaaacccactcatataaaaatgtgcaaagccttttgatataaaaagttttgtcaccaagcacctatttttataacttaacttcccatgg

SEQ ID NO: 2824 - DNA, 521 bp, Homo sapiens
cttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcagaattaagttaaaaagtgggttggacttgggaacaggactttatcctcttttactggaacaagactcattaaaggaaatggataaaaaa

SEQ ID NO: 2825 - DNA, 152 bp, Homo sapiens
  misc_feature (1)...(152): n = g, a, c or t
tcacatattanacacnataatttttattatggaaattaatctttacatacaaaatcagctacgtaattttacttacaaaacaataaaaactggtctttactgnggcaacaaaagaagcattttgacaaatgaaaaaaattaatgcaaacaaa

SEQ ID NO: 2826 - DNA, 285 bp, Homo sapiens
  misc_feature (1)...(285): n = g, a, c or t
ctgtctcatcagccctcccctccatttattcctatttttctgtagttaagaatactgtaaaaatgtgactattccttaatatcagaaaagaatgcacaggctgagtcttccggtcaaaagttaaatactgatggaatcaagtattttgtatgaagttctcatttgttatctctaacgctattttgtgttttgcatatagtattatagtatgtgtatatcactttttgtatagagtaagcaattgaataatttgttaataaaaataataccacattgactgatnaa

SEQ ID NO: 2827 - DNA, 456 bp, Homo sapiens
  misc_feature (1)...(456): n = g, a, c or t
tttttccagttttatgatttatttaacttgnggaacaaaaataaaccanattaaccacaaccatgccttactttatcaaatgtataanaagtaaatatgaatcttatatgacaaaatgtttcattcattataacaaatttccaataatcctgtcaattatatttctaaattttcccccaaattctaagcanantatgtaaattggaagttaacttatgcncccttaactatcttaacaagctttgagngcaanaaantgaaaanttcaaatctgaccaaaaagttgatgntggaaaaaaaaattcttcaatcncttgcctntaaacanangatgtaaaatggaagttaacttatgcncccttaactatcttaacaagcttttagtgccaaaaaatgaanagtcaatctgaccaaaagntgatgttggataaaaaaatctctgcttcccactntaan

SEQ ID NO: 2828 - DNA, 317 bp, Homo sapiens
  misc_feature (1)...(317): n = g, a, c or t
gaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacattccctgccagagggagttcttcttttgtgagagacactgtaaaccgacacaagagaacaagaatna

SEQ ID NO: 2829 - DNA, 120 bp, Homo sapiens
  misc_feature (1)...(120): n = g, a, c or t
caggcataacacagaggcaatcagattccaanaataggggttgcactccagggagacaccatctggctggaccangaaagggccatgctctgtgangagcccatctaaagagctgcagcc

SEQ ID NO: 2830 - DNA, 260 bp, Homo sapiens
  misc_feature (1)...(260): n = g, a, c or t
ttttttttttttttttttttttttttactttaaanatttttatttctccaaatttgttatttatcaggagngactgaaataaaaaatacaattgagtcccatcatcatcatcatggaaatggctttaaaaaaaaactggncanatgaatattattgcttcccattttcaaccagtaaatagttgccactganaaactgacagccaggagtctgtcaaaaaatgctcaanatatgttatataatacaacatgcctgttcac

SEQ ID NO: 2831 - DNA, 368 bp, Homo sapiens
  misc_feature (1)...(368): n = g, a, c or t
ctttatctgtggaaacttcagactctcccctattactttaatttcagtgagacattattaaatataagtgggcttacacatttgttttgctttactgacaaataatacacaacttggaggctttttttcctttctattcttcctctaaatgttcaacacttttctgattttgtgatttgaggntgtttaatagcttcctgaggctccattgagaccgtatatacgtgacacttaacagtctagccttcctcggtacatatagatatatgatggnggctttgcctgtagtaaattcatgccaaaacataggctttcagtgcctattacatatggctttcagctctctctactgagggatgtangagttt

SEQ ID NO: 2832 - DNA, 111 bp, Homo sapiens
  misc_feature (1)...(111): n = g, a, c or t
cctagacactctcatgctttcaatgtggaatacgtagcctaatatgcatagaagcatgaatggcaaacttgaagancnatatnataactatttttctanntattngaagca

SEQ ID NO: 2833 - DNA, 347 bp, Homo sapiens
aaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttcttttta

SEQ ID NO: 2834 - DNA, 278 bp, Homo sapiens
  misc_feature (1)...(278): n = g, a, c or t
cctactatgtgccaaggaggggtaaggcagctagctctcacagacacaccccacagtgaaaatcacacacacacacacacaccccggcatctgtgctcactcacaggcagactgctcactttcttgcacctttcttgccatcacctcggcacacccacattcctccaataggcttgggaaccagcatggaangggcaagtgtcataaaaaaaaccccctacctaccctactnccanacttcatgccaaaaggttaactccacttcccttctggttgcc

SEQ ID NO: 2835 - DNA, 143 bp, Homo sapiens
  misc_feature (1)...(143): n = g, a, c or t
atgccttctggtgaatttgcacgtatatgccgagatctcagccatattggagatgctgntgtaatttcctgtgcaaaagacggagtgaaattttctgcnagtggagaacttggaaatggaaacattaaatngtcacagacaag

SEQ ID NO: 2836 - DNA, 226 bp, Homo sapiens
ccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttattt

SEQ ID NO: 2837 - DNA, 379 bp, Homo sapiens
ttttaactatatatcatattcatttattatcaatccacaggaaaatctgattgctacatgagctcataaaagcttttttcacctttacaaaattaaaaaaaaaaatgtgccacaaggatgtaataacaactgctgataaacaagaaaaggaatcttaaaattataaatttgctgtagaaaagataaaaaacaattatattttatttagaattttaccttgaataaaatattcccctgtataaaaaataaaaaagcttgctctggttagaattagagtatttttgtcttcaaatctgggaatttgcataatatttccatgatactttttcctttgtaccgcgtggcattcaagcatagcagattagaagggatttttttt

SEQ ID NO: 2838 - DNA, 506 bp, Homo sapiens
  misc_feature (1)...(506): n = g, a, c or t
aaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgngctgattgtggatcttttcattctcattgcagaataatgttctattgtgggacttattacaatttgtccatcctattgttgatgggcacttgagaactttccattttggcgctattacaaatagtgcaactatgaatgtactgcatgttaccatcttacttgagcctttaatggacttatctcttcaaa

SEQ ID NO: 2839 - DNA, 469 bp, Homo sapiens
aaaaaaaaaagttacagaaatactataacatatgtacataaattgcataaagcataagtatacagttcaataaacttaactttaactgaacaatggccctgtagccagcacctgtaagaaacagagcagtaccagcgcgctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttacc

SEQ ID NO: 2840 - DNA, 483 bp, Homo sapiens
aaatgtaagtattttaatgagtaaatagaattaaccttttttacaaatgaaatgataggcatctatgtaaagtgggaaaaatatgtttcgtaaatatttgcatctttaatattgttagtaagtagtaaacaggtgttttgctgattgaaaggaagttatcttggtaaattgagactcaaagtgaaatacaaaaatgaaaatatttataataggactcgacttggagaaattgctattcttcctgttgtccaaaccataaatctgaggataacctgggcttttctctttcctcttctcctaaccagtttttcaccaagtcctgtgccatttcacctcctaacgtctgtcagctatccttttgcctttacctcaccactattaccctagagaagactttcattatttctcatctggattaccagctcgatctctaatctgcttcagttcatccttcttgctacttctaggctaaacatcaaaaac

SEQ ID NO: 2841 - DNA, 395 bp, Homo sapiens
  misc_feature (1)...(395): n = g, a, c or t
aaagattctgaaaaacacaatttttaacgcttatgtagtccgccatcaaaacatcaatgtactgaagattttaagcagcatgaggcaccatcacgtttttgtttcttccccctcatttccccgcccctaccagatctgtttttgatgtttagcctanaagtagcaagaaggatgaactgaagcagattagagatcgagctggtaatccagatgagaaataatgaaagtcttctctagggtaatagtggtgaggtaaaggcaaaaggatagctgacagacgttaggaggtgaaatggcacaggacttggtgaaaaactggttaggagaagangaaagagaaaagcccangttatcctcagatttatggtttggacaacaggaagaatagcaatttc

SEQ ID NO: 2842 - DNA, 428 bp, Homo sapiens
  misc_feature (1)...(428): n = g, a, c or t
aaacattaaacaacaagtatataatcaaaataatcctgtattacttataactgaataactattttcaaagaaactttcctccctgatgaataagaatgcaaactccaagtgtatatagggtgctgtgagtgaagaagcttgagtttgccccatcagcttctgcaaggttatttttacatagnctcatgcttatttgtatggggaagttctttttcctggaaaagatttaactaagcacaaaactaaaatccagagcagggataagggaagaatgcaggtgttcttagtggaaatatcagcatcagggaatctttctcttaaacactggaactggtagagttgaagaacttctttttctcaatacttccatcattntttgtatccattcagcttgagggtccacacacacaattgacttgttcttnttc

SEQ ID NO: 2843 - DNA, 212 bp, Homo sapiens
aaacattaaacaacaagtatataatcaaaataatcctgtattacttataactgaataactattttcaaagaaactttcctccctgatgaataagaatgcaaactccaagtgtatatagggtgctgtgagtgaagaagcttgagtttgccccatcagcttctgcaaggttatttttacatagtctcatgcttatttgtatggggaagttcttt

SEQ ID NO: 2844 - DNA, 366 bp, Homo sapiens
  misc_feature (1)...(366): n = g, a, c or t
tttttttttgttgtcccagatttattgaaaataatacagcactacagaaaaaattcaaacaggtccccgaggcgttttgaaattcatcccaactgtaggctgagtgacctgaaggttggacagactgccgaagtccaaaagcttcagcatttccttagtgncaggatctacttcaataatctcctgatccaaggctgagacctcaggaacataattgtctctcctttctctctcctcctcctgcagcttgatgganatacctcttactgggcctctctgaattcgcttcatcagatgcggtgacataacctgctatcttgttgcggagctttttgctggggataatggcgatctcctcgcacacgc

SEQ ID NO: 2845 - DNA, 337 bp, Homo sapiens
  misc_feature (1)...(337): n = g, a, c or t
ttttttttttgttgtcccagatttattgaaaataatacagcactacagaaaaaattcaaacaggtccccgaggcgttttgaaattcatcccaactgtaggctgagtgacctgaaggntggacagactgccgaagtccaaaaagcttcagcatttccttagtgtcanggatctacttcaataatctnctgatccaaggctgaaaacctcgggaaccataaatgggcttctcctttcttttttcctcctcctgcagctttgatgggagaataccctctttactggggcctcttcttgaaattcgctttcatcagaatgcggtgacataaccctgctatc

SEQ ID NO: 2846 - DNA, 263 bp, Homo sapiens
atttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaaggttaaataaatcataaaa

SEQ ID NO: 2847 - DNA, 163 bp, Homo sapiens
ccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttac

SEQ ID NO: 2848 - DNA, 139 bp, Homo sapiens
  misc_feature (1)...(139): n = g, a, c or t
ctgtttgcccttaggccagnacacagaattaaagtgggggagatggcagacgctttctgggacctgcccaagatatgtattctctgacactcttatttggtcataaaacaataaatggtgtcaatttcaaaaaaaaaaa

SEQ ID NO: 2849 - DNA, 106 bp, Homo sapiens
aaaactcttctaactgccatagcaccagcctccacaaaatacttcagacacatatcatcaattccaccagtggttagaataacattggcaccagcttttttttttt

SEQ ID NO: 2850 - DNA, 271 bp, Homo sapiens
  misc_feature (1)...(271): n = g, a, c or t
tttattgatataccacattacatacanaaacattcatgtaaagctttttggattataacanataatttacataactgaggaataaaaccagctttactcctacccanaaaataaatttctncctncctccctggccaaaggnaaacaanatcctgagctaacnttgtaaacnaatattgtgcatttatacaaangnttttaaagacataaaaataaaatntatagacctgcccccagcttcaactactaatcatggaccacttccgcttca

SEQ ID NO: 2851 - DNA, 226 bp, Homo sapiens
  misc_feature (1)...(226): n = g, a, c or t
ttttttttttttttttttttcgtttttcttcatgttatttattttccaatnanaaatgacanattcattatcaaanacatcatttaccattttctcctttgtacttcttattngcatacttcttatctcgcccattanagnaaaagcatcttaagtataccttaaangncanatttatcttggtatgccccacagcaacttactnatagtanatacttnaatattn

SEQ ID NO: 2852 - DNA, 153 bp, Homo sapiens
cctagaagtatcacacatgacttgaagttgggcaacttcagtgttttaattaaattcagacagaaagcaatccccaagatatcctgtaaaatccaagcccacctgtcttcatttcgaaacacagcccaaacaacagctactgctatgcacagt

SEQ ID NO: 2853 - DNA, 401 bp, Homo sapiens
  misc_feature (1)...(401): n = g, a, c or t
nccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcggatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaa

SEQ ID NO: 2854 - DNA, 154 bp, Homo sapiens
ctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaaagaa

SEQ ID NO: 2855 - DNA, 164 bp, Homo sapiens
  misc_feature (1)...(164): n = g, a, c or t
aaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggcaccaan

SEQ ID NO: 2856 - DNA, 339 bp, Homo sapiens
ctggtatttgggtgaatgttgttgctctgtgcctgttgaatgtccatgctacaagaagttatgagccttgttctaagtacagatgaaccttgtatttgtgtaatctcccaagggagagctatggtttacattcaattttttggtctttctgctatgaaacgtgtttattttgcctctgtcaatgtgtttgcaaccttaagtaaggaaagggaaaaaaaaaatagccctctgaactctgatcttttgccgcttctgtagattttgattgtgaagttgggagtgaggacattcaaaagcccatggtgaatgcatatgcctttagaatattgtgcctgtttt

SEQ ID NO: 2857 - DNA, 174 bp, Homo sapiens
ctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatgg

SEQ ID NO: 2858 - DNA, 359 bp, Homo sapiens
  misc_feature (1)...(359): n = g, a, c or t
ctgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgngttagaaaagtggacatgtaagtgaacaatgcattacttctaccttaggtttanga

SEQ ID NO: 2859 - DNA, 374 bp, Homo sapiens
  misc_feature (1)...(374): n = g, a, c or t
aaattttaatattctacatgaaaacttacattgggaaatatgcagacaagtgattatattccaaattttacccttattttaatatctaaaatattgggtatgatgcaaattatactatagaatatttatctgaaatatgacttactggggtattctgttaatactatatataaatattcagaatttttttcaaaagtagaaaaattcccctctaaaagtacagccagatagattttcatccatattgaggaacttagctttttcaacaagcttcagaatctgaagtctgtagaatctaaaatacagaaatatccagaaatcagacaataaattgaaagtttagacatcatgagtattaaatagctttacctcnc

SEQ ID NO: 2860 - DNA, 308 bp, Homo sapiens
aaaaatcctattatgtaaaccttaacataagagggtagttaagataatactacaagtttcagggcgtttccacagacttctagaccttatgtacacacagactatcagactctagatatgcggcctgcttacccttaagggggtgcactgggagcccgatcatgggcgccccctagtggggttaccatcgctcctccattcaaaaagactcgcttctctaagaagtcggtgtcaggtgagtaagcgttctacctgacggctaagccagggatgaagagaggccaacattcttcttaggatgagtcctg

SEQ ID NO: 2861 - DNA, 454 bp, Homo sapiens
  misc_feature (1)...(454): n = g, a, c or t
gtgcccagcaagcccattgaccacagcaccatcacttcctgggtatcacctgattttgatacagcagcaggaagcttgttcccagcctaccagaaacaccaaaactgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaataacccaganc

SEQ ID NO: 2862 - DNA, 194 bp, Homo sapiens
aaaagtttttatttacctaaaaacataaatttatcaaacatatcaatttgctttacagagcaatttacataaaaattcatgatgtataccaacgacagcatagcattatctacctcagtttgtgaagcatcctttcctacagatctcagcaaaacgcagagccagtaggggaaattcaagctttcatttggggg

SEQ ID NO: 2863 - DNA, 233 bp, Homo sapiens
  misc_feature (1)...(233): n = g, a, c or t
ttgaggaacgggaacaaagattatgatagctttccgaccaccaccaacttcaatttccttagctgccgtaatattcagctccctgagctgagccttgaggtccgagttcatctccagctccagaagagcctgggagatgccggactcgaactcgtccngcttctcgccattgggcttcacgatcttggcgctcgaactgaacatggctttctcctgggagaacttgccgagcg

SEQ ID NO: 2864 - DNA, 243 bp, Homo sapiens
  misc_feature (1)...(243): n = g, a, c or t
ctggtgtgggaagtttcttgctcgcctccaaatccccagtgcctgtcacataggggctgacttgaaccaggtgctaattatagacccccgttgggtgaatgagccctggtcagaaaacactgccttcctccatgcanatgggccctggaggctgcatccctggggtacctgactttgaggtgccaccgggcagancccatcactggtgcangagcanagggaggggatccagggtacctgnga

SEQ ID NO: 2865 - DNA, 403 bp, Homo sapiens
aaaaaatataaattatatgaaaatacaagttggaaaatagtcaaacacaatataacatctttttcatccctatacttctcagcttaaaaaaaaagtattcttaaaaaaaaaagttcaataactgaggcagtattcctgataattttattttaatatatatattttatatatgtatatgtatacatatatttatggttccttgaaacttctttggaatgtaggtaagagttcaacaaatttatatagaccccaacagagtaagcggcatgcacagcatgactagaagagagatggtgtatttctcaccatgaaggttaggcaggttaatgctgtaaaacccagagtgttcatctccaaagtgaggaaaagcacatctgatctttgaatgctacctccaatcccc

SEQ ID NO: 2866 - DNA, 236 bp, Homo sapiens
  misc_feature (1)...(236): n = g, a, c or t
aaactttttatttgcatattaaaaaaattgtgcattccaataattaaaatcatttgaacaaaaaaaaaaaaatggcactctgattaaactgcattacagcctgcaggacaccttgggccagcttgattttactctagatttcactgtncgtcccaccccacttcttccaccccacttcttncttcaccaacatgcaagntctttccttccctgccagccagatagatagacagatg

SEQ ID NO: 2867 - DNA, 328 bp, Homo sapiens
aaattacaaagtaataaaaagctttgctctttaattaaaaaaaaaaaggaaaaaggggaaacagaggtaaataaattaggaaaacacacacacggagaaaacaaacaaaaataaaataaaataaaaacaaaaaggtgttaactaggaaggatgggttaatccaaaacccagccctgactccaggctcctcctcagaaaggtggaaccagggagaggggggaccccaggtgactgtcaggaccagggaagtaatttataactcagagccagatgccttctggaagcagtctccatggattctgccctaaaaccaggaatggaagatgga

SEQ ID NO: 2868 - DNA, 430 bp, Homo sapiens
  misc_feature (1)...(430): n = g, a, c or t
aaaaattatacatattgtacattttcaaaacctgcacatgagtaaaaccatggcaatattgtcctaaagctacctaactgtgactatggaaattgctactttgcattcagtgttgtgggatttgcacgggcagtactcattttccctcatacttcggattgaccacagttgttacggcactcttataaataggattttcacccgtgtcccatttggcattcattttctccttttcaaatttagcaaactcccttctgtcatgaattatcattaaaagcttccatatcagcagtaatgcaaggccaataagaacaattccagcaaccacaccagctacaattggaatgatgtctggaccagtgggacactctggattctccacaacatgaaccatgacctcgttgntcccattcctgaatacngtaaaata

SEQ ID NO: 2869 - DNA, 405 bp, Homo sapiens
ccatcttatctctgtcttcaagcattcctcagctttctctttccagaacaggattatgaaccgacaccatacagaggtatttgtaagaaagaaggtggatgccggaatcctttcttcaaacagaagcttaccagtaagtgcagactaatacaacaggcggtaaagagaagaacagagaaagcatcctgccccagccctgccccagagctaaacgtcattctagagaatgaaaaattccatctccacccagtgggttctcagaattccagagagattggaactacagcaaaggtatgaacaggtgtcacggggacacagaagaaagagcagttactcttccggaaggttggagaagattttgtgaaggtggggatgtttgatttgaaccttgaagaacaagcagag

SEQ ID NO: 2870 - DNA, 403 bp, Homo sapiens
cctggagcctgcctcccgggctgagggctcagctctggcctccggctggatgccgtctagagtcctatgtgctcataggtctttttctttcagtaaacagtataaaacattactattttcctttgattgtaaacttcaacagaaaataacatacttaaagaattttgctacaaagagtactatgatttttattgcctcaccacctttagaacatttccacttcacaagtttctgatttgcttcactttcttacttggcgatggcgccctggcagcatcatccacacataccagtgcgtatggagaaatgggctgtaggcccttcctgcgtggtccatggctctgccttcatggaacaggctgagtcatgtctctgctcaagctcaaaccatctactctcaagt

SEQ ID NO: 2871 - DNA, 451 bp, Homo sapiens
aaataactttcttaaccctgcccattaagatcacagtaaacatacaataatttttattatggaaattaatctttacatacaaaatcagctacgtaattttacttacaaaacaataaaaactgttctttactgtggcaacaaaagaagcattttgacaaatgaaaaaaattaatgcaaacaaattaaaacaatgcttttctttttacttgcttcactgtctcttctatttattttctatgatcatttgacacaaacatggattactttgatatctactgaaacataaatgataaggttcttaaaggttgaattaaaagtctgggtgttcaatattttagaagctgaataaacaaaacgaaattggggtttgtgattacagaggatttatcattttttccctttgcccatatgaaaatatataatagaaaattacccacgggaaaacattttt

SEQ ID NO: 2872 - DNA, 265 bp, Homo sapiens
  misc_feature (1)...(265): n = g, a, c or t
aaacttgatccaacctctttgcatcttacaaagttaaacagctaaaagaagtaaaataagaaggcaatgcttgtggaatgtacagtgcatattggcggcgcacgcctcattacgattcgcctgcttgcttctcctgttcaatcgtttctttggaaggcaggtggatttttctcttgcgtntctgtcttcttcagtttcgacttatcgaatttctcgatctcagccatatctgggtttgtcaagacatggttgcggangaaaagcg

SEQ ID NO: 2873 - DNA, 436 bp, Homo sapiens
cctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccggaagacaaccacttctctccttttagaaagcagcaggattgacttattgagaaataatgcagtgtgttggttacatgtgtaagtctctggagttggatgggcccatcctgatacaagtttga

SEQ ID NO: 2874 - DNA, 328 bp, Homo sapiens
aaattatttgctgtttctggctcagatttcaaccttttttccccctttttaagacaaaaataagtgtgactttctggtcagggtgattgtagaggaagggtcatgatactgaaataggacttggttaaaataaagagttgagagtaagagactaaagacatatgccaaatgtttgtaataaaattaaagagaaaatataaatatatacaaaatccaaaatgtcaggataatgaaatcaaagcatttttagtattatcactttgggtactttagtagaattgcactcgtttatgattttgaagtttgttttacaaataacatccaattt

SEQ ID NO: 2875 - DNA, 294 bp, Homo sapiens
  misc_feature (1)...(294): n = g, a, c or t
cctctccaacttccgaagcttcaccttcttgagcttcttgcctggtcggccttcctcacccctcattaactccctgtgattccaatagctctgcttgaacaggtcgtaatcctggatctccacatcctcactctcccaagaagcctgatcgtaaggtaagtcccgccacttgatcaagtagtggacgtggnccttcttgtccacactgtggntgaggattcggtggatcatcatccactcgggttttatcccatagcgatagaagcgttcctccatctntgcaaatttagggnc

SEQ ID NO: 2876 - DNA, 334 bp, Homo sapiens
aaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattcttttttt

SEQ ID NO: 2877 - DNA, 408 bp, Homo sapiens
aaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgattt

SEQ ID NO: 2878 - DNA, 426 bp, Homo sapiens
  misc_feature (1)...(426): n = g, a, c or t
ctgggataattctgcctttgctttccatatggatgctccaattcatcagtatggggacactcatgaatcacagagctatgttcctgataattctgggtctgcaagaggatctgggagtaaataacaatcaattttcttaaagatatgctanaaagtagttagtacttccaatttctcatccaaatcccaaaaagggccagccctgagaagcttacctgaaatatttctttccttctctcatggaagtccataaaagccacccctcctccttatcctttcaactgggcaactatagagtgagggagattctaattgtattagncactttccctcactagntagatgntgacttttcctctaaaactccattttcagattccccctcacagccagcagaaagatgactaccttgcttgactatggtng

SEQ ID NO: 2879 - DNA, 443 bp, Homo sapiens
  misc_feature (1)...(443): n = g, a, c or t
tttttttttttttttttttttgncaagttaaccaattttaatggaaccaagtaattacacaataaaattttatattcatccacaaaaaaacatnttgcaacctttggaaattgtagaaanaaaaccgtggggagcatatccttgnggagcatctctggttgtaactagngattagcattttggtcttttgacttcaaccccatcagcttccatcttcttcctcttctcaatgattgcactaatcttcttccactggcgancaagctctgctttgtcattggtttccttgaagcgcctggttttccgcccttcanacattttgataccatactggaatgcagccttgggcaaagcttctttgntgntcatatactcgctgnattcttcctgggtatcaaagtcccaacggcctaaaggccccttcttgntaccctgggccattt

SEQ ID NO: 2880 - DNA, 383 bp, Homo sapiens
cacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacgcaaaaaaaaaaaaaaaa

SEQ ID NO: 2881 - DNA, 326 bp, Homo sapiens
  misc_feature (1)...(326): n = g, a, c or t
ctggactgctgtacatcaaggacagattaactggaaaacatatgttccttatgtgtgattgagagccattcacaaaagacttcctttgngtncagcctatacttttccatatggtataccttgaaaaaaattagcncaccatgnttattcttntacctttnataaaanacanagcctgtttactcatttagaagatacaganaatnggtctaaaattgaacatcctagattcacactcccaactcacttaaggagattcgatggtgaggaaaatgatntgacaaagnccaacaatgatctncggaatcacattttccaacanacca

SEQ ID NO: 2882 - DNA, 460 bp, Homo sapiens
aaacctggtacaagttaaacaacatctttctcatacccacatgattaagtatgtattctgacaggatataaagaagatgaaacacaagctggtgggtctcagaattagaaactctaatgcaggaccagatcccaaaagctatgttttctatcacttttgtgacatttaggaaacatttaccttgcataaaatataaaagcttttccttttaattatactgtttgtacaaaaaatcactattgagggaaaggtccaccatggctgtatttatctataattcactgtagtatatataaagttcacttggaagttggaaatgtggaaactataatgaataaacaagctgagctgtaattgtgaattttttactgctaatttagaatgtccaactcactcctacagatattacaacttacaatacatgacacacacaaaaaacatgtcaaactttgctgtagag

SEQ ID NO: 2883 - DNA, 502 bp, Homo sapiens
aaaaataaagaaaaaaataccacgactctttgctaatggcttttaagatttgcagacacagctaaatactcatctaacaaagtatccaggctatccaactatattgccatgaattcataagacagtaacacacatttataatataaaagtagtcaaaaaaataaaaagaaacagccacaggtaatttagggctaaaatgagtcctaataagggttacatgagaaataacatataagaccccaaataaattttagatacaaaattaaatgatgtggctttgttcaaacatacctaaaattcaaaatcaagttaaatacctaggctggcttttttatatcaccagctttcattagggctttaatcgctcttgccctcatctcaagttctagcagctccagttgctgtgcagaaggttgaacatcttctggtggaggaacagccagggtggctgctttgggttcgtttgggctagactctgccagtcctagaatctcattccact

SEQ ID NO: 2884 - DNA, 302 bp, Homo sapiens
ccattagctcctgtagctagttcctgtcttttccaaaacctgttttttttttggctttttggtagatgctgtggctctcttatggcctccaataaacataagtgaggcagagttggtttctattgtttgcaaccaacgaacttaatggattctgtattagaaagaactggtatatttctttaagcaaagactaggactctatggggctcaacaaactctgtaatcgcctttccactcccctggacaaaataaatatattgtctactgctgaaacgcaaattatccccaaaccaagtagcttt

SEQ ID NO: 2885 - DNA, 271 bp, Homo sapiens
  misc_feature (1)...(271): n = g, a, c or t
ccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccangactaatncttaatcgggcattatttatacaagaggtcaaggaacatttactaaccncaatactgcncttgtnaatgaattataaacgctccttctggaatatattt

SEQ ID NO: 2886 - DNA, 308 bp, Homo sapiens
  misc_feature (1)...(308): n = g, a, c or t
aaagatcagatttatttggagaaaacaaaaaacccacaacccaaaggatgggattttacatcaagacatctcccangtaataagtctacagattacaaatcattttcatagaagatatttttgtacaaattttacatgtattcaggagcgggacattaatcaatccctgtttctattttaataggggggacaaggtaggggagagggaaaaacagttttggatataactatttggaaggagagtagacatgaagagggcaaaccctagcttttcattatctacaatcaatagtttgtttttctttttt

SEQ ID NO: 2887 - DNA, 148 bp, Homo sapiens
  misc_feature (1)...(148): n = g, a, c or t
aaaatgttagtaacaccaggttcaaatccttttccaatgaaaactcctggtgtcaggtgataaagaatgatgttttgaanagcatttttgtcccgtatcagaatttctttttnttcactagncattcccttaaaagcatcattggttg

SEQ ID NO: 2888 - DNA, 196 bp, Homo sapiens
  misc_feature (1)...(196): n = g, a, c or t
ccatggatgtgccccaatacagnncacattnnttgganaaatgtgtttncagatcatttaatgnaatctttgaagtatctttgactctaactttgacttggtggtggaccttccttggtttttatancacctnncanatatcctttagaattacatgtattttagcataaggaaatcgaaaaagtanaacatactg

SEQ ID NO: 2889 - DNA, 303 bp, Homo sapiens
  misc_feature (1)...(303): n = g, a, c or t
cgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgntattttttacaactaattttgtactctcagaatgtttgtcatatgcttcttgcaatgcatattttttaatctcaaacgtttcaataaaaccatttttcagatataaagagaattacttcaaattgagtaattcagaaaaactcaa

SEQ ID NO: 2890 - DNA, 317 bp, Homo sapiens
  misc_feature (1)...(317): n = g, a, c or t
agtccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgnga

SEQ ID NO: 2891 - DNA, 364 bp, Homo sapiens
  misc_feature (1)...(364): n = g, a, c or t
nggcnggtaaatatagcaaagcagtgtcttcttgcacagcaaagtgaagaaagtttctacagagaaatagaagttttacatttgtaaaatctttttcacattctaatcatctagcttaagatccaatgccaggagttttcagcttccttatttactatgtatttcttgtgcgcatgatggttaatacagaaattatgttgatgcattactagttatccttctagttaaaggaaagggtaaaacatgtattgttcttgtagaacaaacccctgatttagtctataacaaaatggacataattgggctcaaaagatggagttttgattgggaccacctgtgtacacacaacagtgacttccactcg

SEQ ID NO: 2892 - DNA, 359 bp, Homo sapiens
cctgttctctctttacatcttcagacttaaattctgtagaaggtaacagctttgtattaagacagaagcttagtggtcacaaacaaaaaataacactgaaatacaattcggaaattaatgatactgtgtgtctcaaagaatacctgaactatacattcactaataatttggcaatgagattccatgctgttcaacttttgtcttttatacccacacgtagaaaaaaaattcatgatttaccccaaggttattattaaatatcattttgtgatatgaactttagtaatagaaattaataacatttcccataccaacagaaagtaagttgctagaataaaggaatcatttttcccatcagg

SEQ ID NO: 2893 - DNA, 362 bp, Homo sapiens
  misc_feature (1)...(362): n = g, a, c or t
ctgaggcaacagaataaatgcagaggcattacaatgaatcccacttaatataaagaactatacagaccaacacttctctacaaaatttttttttcctcattgccagttaaatacagagttttactttcatagcttaacaatgaagggtcatacactgaagccaatacatatacctagcatttcagtctaagcttgtgcacgtacatagctgaagtcaattacaaggtttggcctagaaatgctaggggaacttctttgtagtttttacaggtattaaacttcatcttgcacactgaagtcatcatacatacagggcanaatcagagcttttatatttgcgtttattcttcatttaacttttt

SEQ ID NO: 2894 - DNA, 385 bp, Homo sapiens
  misc_feature (1)...(385): n = g, a, c or t
aaagaatttattaagcctgttataccacacagtatgttttatacactgacatacaactccctaataagataaagcaaagacaaaaaagtttatcttattagaaacaagatacaccaccacttattgtcttcaaacattattgcactttaactttcttaatttgacaaagcattcaagaaacatctgcggactagttttaacagacaaataacacctgtaagcagacatgactgtcctaaattgtttattaagtatgaattttacaaactttacttatattagcggtaacggtggagctggagagtattgcgccttctccaagctgcccggcgagagccaccaatagtgtggtggaacttgtggccctttccaaggccaccggntc

SEQ ID NO: 2895 - DNA, 338 bp, Homo sapiens
  misc_feature (1)...(338): n = g, a, c or t
ctgtcangtggcccaataacgnaatnggactccgnccccttgncagtgccactggctgttcctggctctagttcccaggggagcctcaaactggggcctagcccagaaagccaccggctagcatcacatagcttctccagctcaaatagcccaaggngtggcatgnctgcccgacctccanagaataaccggcantcaccgtgcccagncaacacatgctcgtgctatggggagaagcctctgctgggtgacccaccanccaaccctgggcgcaattttaattttagataaaatgcntcaangntcaaacngccacaggnaaacccctgatgtaacac

SEQ ID NO: 2896 - DNA, 241 bp, Homo sapiens
agagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtgg

SEQ ID NO: 2897 - DNA, 156 bp, Homo sapiens
  misc_feature (1)...(156): n = g, a, c or t
aaancattcctttctttaattttgtaannctttactgtggaatanctcaaaatgtcagttctgttttaagtaacagaattgataactgagcaaggaaacgtaatttggattataaaattcttgctttaataaaaattccttaaacagtgaaaaaaa

SEQ ID NO: 2898 - DNA, 50 bp, Homo sapiens
ataaagtaaggcatggttgtggttaatctggtttatttttgttccacaag

SEQ ID NO: 2899 - DNA, 267 bp, Homo sapiens
aaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatctttttttttccttacagacacccataataaaatatcatattaaaatt

SEQ ID NO: 2900 - DNA, 262 bp, Homo sapiens
cctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaaa

SEQ ID NO: 2901 - DNA, 427 bp, Homo sapiens
ctgtagctttttcattcagaaactggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattgtatcagtacttcccctgttaagataactgagtgccacctagtgttcaatttctgcaactactaagcttacaaattcaatactgctattaaa

SEQ ID NO: 2902 - DNA, 432 bp, Homo sapiens
aaaaatacttacacagcttaaaaaaacaaaaacattaaagtcgtagagaccaattattaagcgtataggaacatgatattcatgtatcattaaaacgtagagaccaattattaagcgtataggaacatgatattcatgtatcattaaaataaggattctttcaagatctgtttcctatctcagtctaaatcaggggtctggagttgtggccttaaaaaactagcctcaaacggctccatgcatgcataatagctttatatgtgttccctttgttggtccagttacctgatttataattcttccttacctgaatgactttagaaaacacattaatattgccttaggaattaaatcaattaaacactgatgatcagctacatttatcgtgtaatttaatctgcttttttgtatattagcttttacatatagaag

SEQ ID NO: 2903 - DNA, 243 bp, Homo sapiens
ctggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagctgctcacatgtctttgggtgggggggagaagaagaattgg

SEQ ID NO: 2904 - DNA, 415 bp, Homo sapiens
  misc_feature (1)...(415): n = g, a, c or t
cggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcganggaa

SEQ ID NO: 2905 - DNA, 199 bp, Homo sapiens
ccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagtggttgcgtggagcccccgcccag

SEQ ID NO: 2906 - DNA, 327 bp, Homo sapiens
ctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatccagctatgtggcatgaagagttacaggagggagggaggaaaatagccctatgttagtcatgtttgcatacagaggatcaaagtagg

SEQ ID NO: 2907 - DNA, 414 bp, Homo sapiens
cctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatg

SEQ ID NO: 2908 - DNA, 422 bp, Homo sapiens
ccatggatgtgccccaatacagtacacattttttggttaaatttgttttcagatcatttcatggaatctttgaagtatctttgactctaactttgacttggtggtggaccttccttggtttttataacacctaagagatatcctttagaattacatgtattttagcataaggaaattgaaaaagtaaaacatactggtttttttcaacaagaccatatgtaaattaaatagtgaaatgtgtatgagtttcagtagaactgtaccatcaacaatgtttccataaatatgcagagttctttcttttgtattgttatttacaatattgttaaattgaatgcatttgcaatttctaggattctaaagaattgagtacagaaagtagcaattttattatttgatgataatatgagaattactgtgcc

SEQ ID NO: 2909 - DNA, 352 bp, Homo sapiens
tcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgca

SEQ ID NO: 2910 - DNA, 151 bp, Homo sapiens
ccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcgg

SEQ ID NO: 2911 - DNA, 373 bp, Homo sapiens
  misc_feature (1)...(373): n = g, a, c or t
aaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacntctttgtaaatatcaaacctaatacatttcttgtc

SEQ ID NO: 2912 - DNA, 187 bp, Homo sapiens
aaaaaagtcataggtactgtgagttctgtataaactggtggacagtaagttagttcctttgttttaacttataagcctcaacttcaccgcagaataaagaatgtaggccaaagaaagcataatcggtcactcgtatagaacagtattgtttctataatttgaagctttctgaatggacgggttcagg

SEQ ID NO: 2913 - DNA, 309 bp, Homo sapiens
  misc_feature (1)...(309): n = g, a, c or t
ataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagtnaaaaagtggtttggacttgggaacaggactntatacctcttttactgtaacaantactcattaaagg

SEQ ID NO: 2914 - DNA, 270 bp, Homo sapiens
ccagagggaaggcccaagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcagcttcgggggtgacatttgtatccggccagccgagcggggaaaggagaccttgtgtcctggcaacagggagagccgggactgggatgg

SEQ ID NO: 2915 - DNA, 288 bp, Homo sapiens
ccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaac

SEQ ID NO: 2916 - DNA, 419 bp, Homo sapiens
aaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggtttt

SEQ ID NO: 2917 - DNA, 269 bp, Homo sapiens
ctgcctcctgagggtgtggggttattagggtctcaatactttctcaaggggctacactccccattaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcag

SEQ ID NO: 2918 - DNA, 302 bp, Homo sapiens
aaacaagtgggattaagttcttgaagcatttctttgaaaaactgtaacaggagatgtaacatgccttcaccagtgtgatcctgaatactaagtgcaatccaagcaatcgttaccgagaggtggcagtggtccagtcaaagcaaaagtggattggtcaagagcaaacgtcattgcaacagatttttgagatgctcaaggcatattccttggtaactttatggaaggacaatgaataattacatattttgttatgaaagtgttttgagaaatttgccaaagacttagaaaaacaccaaggaagg

SEQ ID NO: 2919 - DNA, 331 bp, Homo sapiens
ggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcgtggctcagaatcttaggtaggtgcttaactcttgtggtgg

SEQ ID NO: 2920 - DNA, 207 bp, Homo sapiens
cggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctgg

SEQ ID NO: 2921 - DNA, 212 bp, Homo sapiens
ctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgttttt

SEQ ID NO: 2922 - DNA, 247 bp, Homo sapiens
ccttcccagtccccacaggtccccgtcctgataggtccctggagctccactggccctcaggtaaactccaagcgccacactactgtctacaaacgctggtgatctggacctgcagcccttctcgccttggtggaggcccctccccacgctctggaaagtgcctcaggccctctcagctctggtctctgcaccttccattcccctcacctagatcactcctctaccaaactcctgcacaccttccagg

SEQ ID NO: 2923 - DNA, 316 bp, Homo sapiens
ccaccacaccacacccctttacaacctccagccctatagtctaaggatatggggccctgggagacaccgagggaccaaggaaagaggccccctgtagaaagcaagcagaaattccttgtagacccactgaccagagttgctcgctgtccttgaccccaccgagaggggtgcaaccctgactcagcatcacctcctatctgtcatagcggggagagctttccccaaaggccagcaggggaaaacccaaccttacttggaggagccagggaagtatctcgcagatcccgcaaaaaggcacccacgtctacagctcggc

SEQ ID NO: 2924 - DNA, 316 bp, Homo sapiens; identical to SEQ ID NO: 2923

SEQ ID NO: 2925 - DNA, 269 bp, Homo sapiens
  misc_feature (1)...(269): n = g, a, c or t
ctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcangatgtgagaggtggggagtactggctgtgcgtggcaggacagaagcactgtaaagggctctccagccgcagctcag

SEQ ID NO: 2926 - DNA, 207 bp, Homo sapiens
ctgggaggctattcccaatgccaggatcgagctgcaggagtgggagcatgtgacctgcatgaagacagtgtctctgcgcagtgaggagaccgtgtcgggcctcaaaggctacgtggtcgccgggacctgcctcatgcagggggaggaggtcacgtgccgagggcggatcttgatcatggatgtgattgaggtggtgcccgagcctgg

SEQ ID NO: 2927 - DNA, 346 bp, Homo sapiens
  misc_feature (1)...(346): n = g, a, c or t
ccacgagaccaccccgagcgccaagcctgtatctgcagatccctctctgctcaggaaccaccacgtcctgtgttctcgccaatggagaccaagacctggggttggttctgggctcctgacagttctcttgatgttaagagtgcagctctgtcaacactcagcataccaaaagctctggagcagcttatggcacacctttccctggtgccatctcttcagacacgatgtgagctcattacaaccncatnagtaaatggagctaccatgtatattttantgaaaatacatangcacccgtgtccccatggggtctnacanggctaggctggggacactgctngggggg

SEQ ID NO: 2928 - DNA, 314 bp, Homo sapiens
ttgtcctttggacaaatctataactttcttttcctagccaattatactcaaagaactaggggattatagagaggttaggcatattttgttgggtgtcaggagatgctgaacagagggcttgtatatctgtacattgctctttctccactgtgaggtccatcctgccttaatttgggttcctgcagcctcagggcattctagggctctcttagatcctgctggactgagtcccctctagaaaagaagcaggaacaggctaaccaacagcagactgttagaagttggtggagggcactgacaggagtaccagccag

SEQ ID NO: 2929 - DNA, 269 bp, Homo sapiens
  misc_feature (1)...(269): n = g, a, c or t
aaaagatactttggattcaattaagaagagtttttaagaaaaaagaggaaggttctggcatggggagctctgcaacccactgctgggtgccacaagcgatgcttaanaacggaagatgaanatggcaccatgtgtctntaaaccacaaatggaaccactgatttctatgtgtatttgcatttgctgtaatgtgtgggaaatctgaaggttacacagcacaactgtncacancagatggcccttnaaggggatgaggtttanagccatnc

SEQ ID NO: 2930 - DNA, 175 bp, Homo sapiens
ccctcccctgctcagaatctgataccaaagagacagggcccgggcccaggcagagagcgaccagcaggctcctcagccctctcttgccaaaaagcacaagatgttgaggtgagcagggcaggcccccggggaggggccagagttttctatgaatctatttttcttcagactgagg

SEQ ID NO: 2931 - DNA, 216 bp, Homo sapiens
  misc_feature (1)...(216): n = g, a, c or t
ccagcccacngggtactggaagacantggttntgatgggttcagccctgctacttggggctganctcagacgcttggntctcttctccanccagncctccagatggccctcngggagctcangagcatntagtaaccactccctggctcgnctctcctcctccacctggatgctcagntcctgcaggtctcgctctgacatgtgggaaaatctgca

SEQ ID NO: 2932 - DNA, 186 bp, Homo sapiens
  misc_feature (1)...(186): n = g, a, c or t
tccganctnngtaccaanctnggagnaatcatggncatagctgnttnctgtnaatgccccacggagacttagcaggttccaggagtgagcgagggcagcggaaaggagttcttccgggggacacgaattgcctggctgantatcaagaaagacacactcttaaatttcttggttcagagcaggaaa

SEQ ID NO: 2933 - DNA, 444 bp, Homo sapiens
ccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgggaatcgatagggttaattttggagcagtggcttataccattcacctctgtttttttgtgattatttcacagataatgagaccttaataacaaataggcgtaaaaaaattttcacatcgaaatgatagaaacatttgatgtaataaaacttggttggcttgatattttaaggaattgaaacctagcaatcttattggagagacaaaaattggtctccaggggctggaggtctgcgggccaagccagg

SEQ ID NO: 2934 - DNA, 236 bp, Homo sapiens
aaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttagg

SEQ ID NO: 2935 - DNA, 347 bp, Homo sapiens
ctgaacaactgtggagacccatcctgcctcctgactctaagctgcttttaagctaattttctggctctttgcctactgtgtatgtgtgataggactgttttccttggtatgttcccagatattctctgggatatttgggttctcagggatacctgcttcttggctgggcaccatgcccttggcttaccccccagccttcagggttcaagcagtggacatacacccttacataacctggtgaaggacctgtcacactacagcagctttataaaaagatataaaaagataaagtattataccctaacaatatttgacattttacctttagcttcagttattattctttt

SEQ ID NO: 2936 - DNA, 234 bp, Homo sapiens
ctggaccagaaatgtgaacagcaggggacccaggaagttgaccagggcgatgacccaagggggcaggtactggagcagcagaaacagggactcctccttgttgtcctgtgagtacttggtagcccagaagatggcgctgatggccccaaccaccaggagcccgttgagtacgttgacccgcaggtaggagagcaggcggcaggccgtctgggcccgggtctgctgctgcatcag

SEQ ID NO: 2937 - DNA, 401 bp, Homo sapiens
  misc_feature (1)...(401): n = g, a, c or t
gatgatggacagngaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcag

SEQ ID NO: 2938 - DNA, 250 bp, Homo sapiens
ctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaattt

SEQ ID NO: 2939 - DNA, 338 bp, Homo sapiens
ccagcatagcagggtggagtccatgtccctggctgacagagggaaccctggaaatattacttcgcgcttgatggagaaggagaaggccagagattgcctgattcctatggggatagcctctgagaatgtggctgagcggtttggcatttcacgggagaagcaggatacctttgccctggcttcccagcagaaggcagcaagagcccagagcaagggctgtttccaagctgagattgtgcctgtgaccaccacggcccaggatgacaagggcaccaagaggagcatcactgtgacccaggatgagggtatccgccccagcaccaccatggagggcctgg

SEQ ID NO: 2940 - DNA, 352 bp, Homo sapiens
ctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagccataaaacagggacctctgacgcttcacattatcaggtaagaaatgtttcttgcccagcagcccccagaggatgaacagctccctccaccttttacttttatccagcatttcttagctcggttggcaaactggatatttatgcacctgcatttcacaatccatctccaccgattattcctgg

SEQ ID NO: 2941 - DNA, 196 bp, Homo sapiens
ttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaa

SEQ ID NO: 2942 - DNA, 307 bp, Homo sapiens
  misc_feature (1)...(307): n = g, a, c or t
nggcggncgaggtccaggcaagtggcaganccagacctgggtcttcacacacttccctcttcttgactgtactggcgcaggtgcttaagatttgggggaaggtgggtgggtatctggcctcttctttgggactcaaattgngatatntntctgagaacccacaggctccctctttanggctgaggtgagaagttctgaaagtcaancagacacatccaggcatttgggcaagaaacttcttccttccaaatcaaaggtgaaatgaaaacgattatgagnccaccgggggatgaacanaggtgaatgg

SEQ ID NO: 2943 - DNA, 357 bp, Homo sapiens
ctgacagttctccatggcaactcagtcctccagcagacccctgcatacataaaggtgcaaaccaacaagatggtgatgctgtcctgcggggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcag

SEQ ID NO: 2944 - DNA, 205 bp, Homo sapiens
  misc_feature (1)...(205): n = g, a, c or t
ctggcctgggtcacagtgacctgacctcaaaccagcttaaggctttaagtcctctctcagaacttggcatttccaacttcttcctttccgggtgagagaagaancggagaagggttcagtgtagccactctgggctcatagggacacttggtcactccanagtttttaatagctcccaggaggtgatattattttcantgctcag

SEQ ID NO: 2945 - DNA, 138 bp, Homo sapiens
gtgaatgctggtgtcactcagaccccaaaattccgggtcctgaagacaagggcgaattccagcacactggcggccgttactagtggatccgagctcggtaccaagcttggcgtaatcatggtcatagcttgttcctgt

SEQ ID NO: 2946 - DNA, 250 bp, Homo sapiens
  misc_feature (1)...(250): n = g, a, c or t
ctgctatactaatgggattctggggcaggtctcagtaattatgaaacatctactgataaaataggtattcaccaaccctaagagtagactgcgattcactagatgtgagcattctaagtaganccaacccagggaaaactatgcaaggggcccctgacagggaaagggctgcaaagcaccaggcaaggtgactctcatgcgctttccagctctgcttttgtttctctatgatcctagaacttaattatta

SEQ ID NO: 2947 - DNA, 214 bp, Homo sapiens
  misc_feature (1)...(214): n = g, a, c or t
ctgcacgtaggcgaccttgtagtccggcttcttgatcctcacgtttctgtgatctcttctcttgttagagccatgctgcacccgtgtccgcacagcagccacgggcacgttatagatgccctcganggaaattcctgaggtccacccttgtcatttccatggggatccggaactgcacggtgtcctcgggctgggccacaccgggccgcaccag

SEQ ID NO: 2948 - DNA, 134 bp, Homo sapiens
  misc_feature (1)...(134): n = g, a, c or t
cctcatcatccatgaaggctcctctgtctaccgcatcttcaagcgctggcaggcagtgaaccagcagtggaaggtcctaaattatgacaagaccaaggacataggaggagatgcaaggggagggacggnaggga

SEQ ID NO: 2949 - DNA, 233 bp, Homo sapiens
aaagggtgtaatgtgttggtcacatcacaaccagtaagaaacgcttggtaggttatccacatcttttgctgactgtttccatatacaattctggtcaccatattttccaaagctaaaatctgaggcgtgggcttgatggtttttgaaatcaggattaccccaggaagaaccaggtcctattactaattttcctgattctgaggctctgaaggcttgtctgagacacattccgg

SEQ ID NO: 2950 - DNA, 169 bp, Homo sapiens
ccatagggcgctacgacgggactcacccgtgcctggcggccgccacccaaacgggcaaggtttttattcataatcctcatacacggaaccagcatgtcagtgcatccagggtcttccagaaccccctggaatctgatgtttctcttctcaacattaaccaggcagtcag

SEQ ID NO: 2951 - DNA, 360 bp, Homo sapiens
ccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcagattcctgagattgttcctggaacatctccgagtgggtgtgggttgtggccctgcgtgtgtgattttgcctatcccagctccggggtaccaccaaccactttttgtctctgtgggtttacctactctggatattttgttt

SEQ ID NO: 2952 - DNA, 238 bp, Homo sapiens
ctggagacactttagaactctttccccatcctccaccatagtgcaaacttcacgcttctctgagcacctccaaggtatgcccttgaagtaaaacagaaaagggaagaaagggggctttttcttttccatttctgaccaaacagaggtctgaaatagcagtgtattatgaaattctcattccctgcaacagtcagccaccacttggaaaatggctatttttgccataaactagattttt

SEQ ID NO: 2953 - DNA, 349 bp, Homo sapiens
ccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagggcgaattccagcacactggcggccgttactagtggatccgagctcggtaccaagcttggcgtaatcatggtcatagctgttt

SEQ ID NO: 2954 - DNA, 286 bp, Homo sapiens
  misc_feature (1)...(286): n = g, a, c or t
nctgtgtcctgccctcccttntggaggctggangggagaggccaagcccttggaaaatgtagcaaatgtctggatgtcgcataagtgcgtgtatgtgcgggacaggccccgagaagctagtgacttcttgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcag

SEQ ID NO: 2955 - DNA, 286 bp, Homo sapiens
  misc_feature (1)...(286): n = g, a, c or t
ccagagaacaagatgctcccttgctgagctcctgggagcgtggaaggagatgctaggccctggcacagtgttatgtggactgggccacgatagggtggagtgagctagtgaagaaggcaganggagactttgcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcag

SEQ ID NO: 2956 - DNA, 125 bp, Homo sapiens
taaaagatactttggattcaattaagaagagtttttaagaaaaaagaggaaggttctggcatggggagctctgcaacccactgctgggtgccagaagcgagctgtggagcggaagattaagatgg

SEQ ID NO: 2957 - DNA, 309 bp, Homo sapiens
  misc_feature (1)...(309): n = g, a, c or t
ccagtaggtgtgggtgcttttgatgtttgcttctggtggttgaaagaagcgcagggaagagactgggtgtagagtgatgtaccccaaggctgcagctaagatcaaattcttctggagagctgtgtganctggatgctgatgcanaggagggtgggggagctggtgagaccaaggctgggctctgtgcccatcccactgggtgtgaaggaaggaaatgaccacagacagccatgttctgggtcggccgtctgcaagccaggctgactcctcctctcccccagagttcaggatggtcaacggcagcagcag

SEQ ID NO: 2958 - DNA, 290 bp, Homo sapiens
  misc_feature (1)...(290): n = g, a, c or t
cctgtgaccaagtttacagtcatctagtttctctcacaatttcaaaatgtcagatcagaagaatctttggcgattaatccactctccattttatgcgtgagaaaaccaaggccctgatggtgtccctggtcccaagtccagtngcccttcacaatgaggcttttggctcttaccctctgaagtggggcagtggctcactgtgaggggagagggtcagatcttgttagtttgatcttaaggcactcacaaaatgccctgatttttcttgtctttgtgagaagacaaaaaac

SEQ ID NO: 2959 - DNA, 122 bp, Homo sapiens
aaacagctctaagtgtcagtactcatagtggcatattacaaagtaataaacagtgcacacttgagggcaaaccgcatattgagctatggaagagctcactgtgattaagatgacatcaaacc

SEQ ID NO: 2960 - DNA, 377 bp, Homo sapiens
  misc_feature (1)...(377): n = g, a, c or t
ctgagattgtgtgtgtgtgtgtgtgtgtgtgtgtgtaggggaggactggctangaaagcaagcagagtgcctctgcttnttctgccaactctatctcagcactgatccagaccccaccagccaagcattttntgggacccgcacactttgctctggagctttctaatancctgnattaatccacccctgtgcttcatgcctttgccaccaggagaaccagtgcaactgaagtttccactgcctgctgctctcctgnggcatccacatcctgaataggcaggagggtgcancccacctggtgcacagggaggaggaggaacgtcccctctgatataccacatgnnagnanaccacctcttcccagaccanatctcggt

SEQ ID NO: 2961 - DNA, 401 bp, Homo sapiens
cctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttatggaagcagaatggtggaacttgtgccggaggtacactgctgaaggtgcgtggcggtggaccagccag

SEQ ID NO: 2962 - DNA, 207 bp, Homo sapiens
ccttgtcctacggccagaagccctacaagaagatgaaagggccggaggtcatggccttcatcgagcagggcaagcggatggagtgcccaccagagtgtccacccgaactgtgcgcactcatgagtgactgctggatctacaagtgggaggatcgccccgacttcctgaccgtggagcagcgcatgcgagcctgttactacagcctgg

SEQ ID NO: 2963 - DNA, 375 bp, Homo sapiens
  misc_feature (1)...(375): n = g, a, c or t
ctgagagactctaaatccagtgacaagtctgtctgcctattcaccgactttgattctcaaacaaatgtgtcacaaagtaaggattctgatgtgtatatcacagacaaaactgtgctagacatgagggtctatggacttcaagagcaacagtgctgtggcctggancaacaaatctgactttgcatgtgcaaacgccttcaacaacagcattattccagaagacaccttcttccccagcccanaaagttcctgtgatgtcaagctggtcgagaaaagctttgaaacanatacgaacctaaactttcaaaacctgtcagtgattgggttccgaatcctcctcctgaaagtggccgggtttaatctgctcatgacgct

SEQ ID NO: 2964 - DNA, 424 bp, Homo sapiens
  misc_feature (1)...(424): n = g, a, c or t
aaatcaatagcaaaacaggattaagataaatgtgggcataattaggtgtattgacatgcctttgatgtatcaaactgagggggaacccactaaatccagtcaagcagtttcataagatcttcacaaaatgcctctacttacggaatcatgttgattttagtcctgctgatgtgtgtaccgttagcactttggtttatcaatatttgactggctcaaatgatggatagaagggtggcctggttataggcagtaggcanaaggaggcagagggttacagtaatgtaagatcaagaccggaaaatgatagctatagaattacaagcccggtaccaccaggtaccacatcacataagaaaaaaggttctaatgttttcttaacttaacagcaaaccagtccagctacgggggcccagccagccagcag

SEQ ID NO: 2965 - DNA, 318 bp, Homo sapiens
  misc_feature (1)...(318): n = g, a, c or t
ctcattantcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcag

SEQ ID NO: 2966 - DNA, 459 bp, Homo sapiens
ctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggtaagtgaactctctcttccctgaatttcttttggaaactatctgaaccacatggttt

SEQ ID NO: 2967 - DNA, 286 bp, Homo sapiens
gtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatgg

SEQ ID NO: 2968 - DNA, 237 bp, Homo sapiens
aaatacagaaagcacaagaataaaccaatggtaacatgtagaatctagatcgtcggggcaatttagaaggtagactttcaaaaagtctgaggcacaattacaagtgagtaaaagttcttgtgcaacctacataaacgcagcaaagaaacttaagacataaaaacatgggaaagctcactgtaaaaatattatcaaaatatttctacataagatattttgctttcatttttagatcag

SEQ ID NO: 2969 - DNA, 135 bp, Homo sapiens
  misc_feature (1)...(135): n = g, a, c or t
ggtccaagncgtagtggggtctgatatcaccagcataaccgagcggtataggatatattctgttaaagatggaaaaaatggaaaatctctgccatttatgttgtgtgacactatggggctatatggggcagaagg

SEQ ID NO: 2970 - DNA, 371 bp, Homo sapiens
ctgcattgtgaggggcttgctcctgcccttaggtataagcaggttcatcactccaatttgtgagtttggctactacccattcatgctcaagtgcagtagtagatgattttacaaaatatgctgtgatgcactggaaaccaaagaccaattcaggtctcaaatcgtattatctagcaacaaaacatttacagttgtgcaagaacaaggattccattttcataaccaaataacaaaataaaacattttatgtgtaagataacttacatctttggactgctggaaaatactttttaattatgaacatgttaaaaataaaaaacagcagaagccctgatattacctctttttcctcatttcttatactacctttt

SEQ ID NO: 2971 - DNA, 210 bp, Homo sapiens
ctgcctgactatggggctaaaggggtaagacccagacagacaaaaacttgctctctgccaacccgtcacccaccgctgcccagggcagcctggctgcttaggctcaaattccagctccacctgggtgggtgactttaaggggagttgcttagtgattctgcctctgtgagcctccatttcctcatgtgtaaaagctggtcacgcatgttc

SEQ ID NO: 2972 - DNA, 359 bp, Homo sapiens
aaaagcagagagcatgtgtaggttccctgtggtgggaggaaataaggtgccatcaaggaactaaagggcctggagtgtaggggaggataagatgaacagaagccagattgtgcagtatcttacaagctgtgtttaagtctttggactttggttcttagagtaatggaaaactcattggagggttttaagcaagagggtttgtgattaaatttgtgttttgaaaagatatttctagctatattgtaaacatgttcacagcagggggtaggatggaagcggggaatcagtgggaacagttaggatgcttttgcatttgtccagttgagagatgatagtggcttggcctaggatgatggtgg

SEQ ID NO: 2973 - DNA, 322 bp, Homo sapiens
aaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggagg

SEQ ID NO: 2974 - DNA, 259 bp, Homo sapiens
ctgtacaaacagcgagcttcctgccttgtccaaagacgacaagatgatattaaagatgaatcttcggagttttcaagccattcaagtcagtccatcttgaagacaaagctctgatggcaccaaatcttgactcctttggacgcgatcgggcactgtatcaggagcatgcaaaacgtcgcattgcagagcgggaggccaggaggactcgtcgtagacaagccagagaacaaaccggtaagatgacagatcaccttgaagg

SEQ ID NO: 2975 - DNA, 344 bp, Homo sapiens
aaagacccaagcagtcattttgagttatatctataaaaattataaaaggatttttgaaagtataaacaaattgtcagtgaaataaatgagattttggaataaagtgagaataggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaattt

SEQ ID NO: 2976 - DNA, 353 bp, Homo sapiens
  misc_feature (1)...(353): n = g, a, c or t
tctgaattttccctgaggagagtcagttcaaccttattacagcagcttttacaaatctatctctaaagtctccctgccgactcaagtttccactgacttgtccccctgcatgcgatgccatgaccttcacaccaacatccaaccacatgtctctcctttggaatctgtgtgccccaccaccangaacctgttaggcaaaggtggcaccatctccctctgtaaggctgcagcgggtgtctgtcancatctgacaggggccctttgcgtgctgtgtgttgaatgttgcacttgctgaatgcatgcagttcccgtgagcctgtggntgagctgaaactgacagcgctctgcaggcc

SEQ ID NO: 2977 - DNA, 157 bp, Homo sapiens
tggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctg

SEQ ID NO: 2978 - DNA, 176 bp, Homo sapiens
cccctttctcaggcttactgtcaccagtctgtctgtgttaggggaggggggagtccgctctgtcctgaaggcccagagatggaaggacaagtggtaggccgggtgttcaggctcttccaacgccgactgcttcaactccgagcaggaccaccccaggacaattcaggggaagcttt

SEQ ID NO: 2979 - DNA, 433 bp, Homo sapiens
ccatctctctcaaagcaatgaagaaggaggtgaagattggggcctattacacaagataaacagtgtcagcatgctttaccagagagaacattttcatcaccccactactgaaagccatgtataatccgccaccacctgttttttgggggacctgggacacatgaaacacagagaggaaatttcatgggtactggatgaaataaggaaggaaatgtttttgctcacctgagtcacagggagaatgagaggtttatagagtttaataccatgttttttctggtaaagtgccatctccgaggaagccttgtaatactcaatatggtctcctgctaacttggcctctctgattcgactggaaaacttctggatctctggcaagtgattgtggatcctggctgcctctcgctggcccgtcacgatgagaggaaaaatc

SEQ ID NO: 2980 - DNA, 405 bp, Homo sapiens
gccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgctgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctg

SEQ ID NO: 2981 - DNA, 345 bp, Homo sapiens
  misc_feature (1)...(345): n = g, a, c or t
taacaggtcacncagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggnggttgctgctcatgtagatctataaatatgtgttgtatgtcttttttgctttttttttt

SEQ ID NO: 2982 - DNA, 102 bp, Homo sapiens
  misc_feature (1)...(102): n = g, a, c or t
tcctccagcanacccctgcatacataaaggtgcaaaccaacaagatggtgatgctgtcctgcgaggctaaaatctccctcagtaacatgcgcatctactggc

SEQ ID NO: 2983 - DNA, 269 bp, Homo sapiens; identical to SEQ ID NO: 2613

SEQ ID NO: 2984 - DNA, 111 bp, Homo sapiens
  misc_feature (1)...(111): n = g, a, c or t
gtctgncaggtgtaatttttcaagtgtcaaagatcccaagtgatccctgacacccaccccttcctactcttacattcatgcgtctgtaagatagctgcctacaacaggtca

SEQ ID NO: 2985 - DNA, 286 bp, Homo sapiens
ccacgtcgatctgcttcttgcgcatgcggtacacgccctggcgcactgagccaaagttgccgcagccaagttcaatgtcagctatgaggaggttatcgcgcttcaggaagagcttcttgtccttgagctcctctgggtcgctgtaggggctctcatacacgctcgtgtccatgggcatcggccgcggtttgtctggggacgttatgcgtgctggctcaggggtgtatccatctgagttgagggtgtcgattcgtctctgaggctaaaggccacagggtcagcaagg

SEQ ID NO: 2986 - DNA, 269 bp, Homo sapiens
ctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcagg

SEQ ID NO: 2987 - DNA, 240 bp, Homo sapiens
ctgcaggaacatctaaaatgaaagcaaaacgcactgaagtgagctgaagtgcatatgtcctgcttgaaatgttcacattgtggcatctgaacaggtttcactgtttgtctaacatgtttgtgggaggcatatttgttacaccattcttttccatactgtaactctggattctttccattaaaggttcgggatgagtatcggcaggactacgatgctgggagaggaggctatggaaaactg

SEQ ID NO: 2988 - DNA, 244 bp, Homo sapiens
aaaaaaagaaaagaagaaaacagaagaaaaaataaactgaaatagggctgccaattgctaccaacagagtgggtttggctattacatttatttagctctactgaacaccttacaagggcggagaagccactatgtgttacaggcaattcacagagaagccacttaccagacaagctgtctcagaaaaagaaggcttctttttatgtcattatttcaaacttttccagaactttcaattttattt

SEQ ID NO: 2989 - DNA, 331 bp, Homo sapiens
ccagaatgtatcatttcttgatctgagtctggttacagagatgtattcactttgccaatatcaatgatgttacatactcatgatttgtgtacttttctttatgtatgtgtgagcaaagagttaatagcaggtctgtaccatttttctcccagaactatgcctgcttgggaaattttaggtttgtcttatcccagcacgagtttcttgtaaatgacccaaattaagataaatttggaatattgggtaccagggacagacatccattttgtgcactgtgaaacctacaatctatgggacagtacatggggctgggagacctgggaaccgtagg

SEQ ID NO: 2990 - DNA, 163 bp, Homo sapiens
ctgactgctaagacttcctcatctctgtccacctgcactgctctgctctcaccacctgttcagctctgcaaggccagtttcaatgcctcctgctctgtgataagggtggtttcccttcaatttgtggtggcgatggagacattcttgacacaggttctagagg

SEQ ID NO: 2991 - DNA, 323 bp, Homo sapiens
cctgagctacacacagatgccagggacatgacttctctgagccctggaggacagccccaccttctgccaccagggaattgcgagtgctggacctcctcggctacccaggactggtcctcagtgtccctcacgttcacatgcagaactttctggactccatggggtgaagagcagagtggagaggagggttttagccgagagctctagctggcaggaagcacatctggcggccctgttaaaactggaactctcagcagaaaagttttggtctgtggtcagcctgtgaggcacacacgtgcgtacacatacacacacacatacag

SEQ ID NO: 2992 - DNA, 358 bp, Homo sapiens
ccaagcatcagaactacatggcctaaccaaacaggatggaaatgtgagagggtccctcccttgtggaaggggtggatgatgctttctgcccaccctatttaattaagatggaaaagggggctatagatactggctggcatctgttaattcattcagcattcaaggtaataataaaacctcataaacacaagagctttaatctcaaggcagctctaagaggcagtcagggtacatggagcataagggaagttagtcatctgtagttacataaccaggaggtaccagagtcaggacaaaagcccagatgttcttaaaaacagggctctgtgctcagatgtcttctgcactgtgtaagcag

SEQ ID NO: 2993 - DNA, 126 bp, Homo sapiens
aaaaggaaatacaaagtataggcaaaacctacaagcattttgccttcagaagaaaatgtaatgttctcctgcactagtgatcccacccacgaacacaaatgtggctccatctcccatgaaagcatc

SEQ ID NO: 2994 - DNA, 273 bp, Homo sapiens
aaataacatcacctttccatgtatagtaaactgttcatatttctacaggtactaagagtacactggaattacgtgttacatataaatggagaggtggagggaagggggaaaacttgcactaagtcgcctaagagataaactgataatgttagtaagacagctttgtattaaaaactttttatactacaagttactgcagaatcatctactgtaagttttatctccccaccagaaaactgaaatgttgatttacaatattaatgtaaaatattt

SEQ ID NO: 2995 - DNA, 218 bp, Homo sapiens
aaacacccagtactgaaacaatatccaaagacagtattgcaatgaactccttttgctgtatcatgtgcaaatgctacttagatgaggttccctctctttagctaaaaatcacaaaacattaaacaatggaaaaagccctcccctcagttcttgctaattgaggtgtccgtgatttacaaaaaaagagttccttaaacactgcaggattcttatttttt

SEQ ID NO: 2996 - DNA, 339 bp, Homo sapiens
ccaatgtgcatttttgcacatgctggaaccttccatgggggtctggactattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtgg

SEQ ID NO: 2997 - DNA, 110 bp, Homo sapiens
  misc_feature (1)...(110): n = g, a, c or t
ccctcaccaacccagagaacctgntttactttgcccagggacttcctccccatgtgaacatggggaacttcgggccctgcctggagtccttgaccgctctctgtgggccc

SEQ ID NO: 2998 - DNA, 167 bp, Homo sapiens
ctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtgg

SEQ ID NO: 2999 - DNA, 174 bp, Homo sapiens
  misc_feature (1)...(174): n = g, a, c or t
cctttncttgagctgcacgtgaacctgtgtgggcaggcagcgtttgcaggcgtgtttacgggcaggcagcgtttgcaggcgtgtttaccggcaggcagcgtttgcaggcgtgtttacatgcaggcgtagcaccatgtgagaccactggtccagggtttcagaggtcctgctcag

SEQ ID NO: 3000 - DNA, 395 bp, Homo sapiens
cctgctaaacagaagggtaaatgttttgcccttctggctttaagcagtcataggaatgtgacagacattcctcttagggagcgcctcctcctagggtttcctcatctgtctcacactgagtggatgtaatgctattttaatcctgctgtggcccccaatactagtacttgtccataccttcttgcatttttagcgtctgctctgtggggttgttaggccctggcactcccaggaactagtgctaaagctgcatctctctctcccctctagggatcgataaagtttcactgcagaaagtctccactgcggtatgctgacatctgccctgaaccttcaccctacagcattacaggctttaatcagattctgctggaaagacacaggctgatccacgt

SEQ ID NO: 3001 - DNA, 356 bp, Homo sapiens
aaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagt

SEQ ID NO: 3002 - DNA, 135 bp, Homo sapiens
ctggggagggcggcggacctagtgaagtcacagagagagagacaccagtagagtggactggggccacgggacatttatttgtagccatcaagtgcctgcccacctgggggagggttgagactggcccgcaggtgg

SEQ ID NO: 3003 - DNA, 264 bp, Homo sapiens
  misc_feature (1)...(264): n = g, a, c or t
ctgagttcccttcccgaaggtcagctcggggctcccgacgatcatgcagaagtagatgccactgtcttccggcttcacgcttgtgagattgagaatgaactggcttgcatcccgaaacacagctatcttctcctgttccacctcttcaccgnggataggtcccttttgcggaatcccananggccaggaactcgtggtgactgtcactgctcggtgcctggcgctgtctcagccanntagatgctcatgttactganggagatt

SEQ ID NO: 3004 - DNA, 170 bp, Homo sapiens
aaaacctgttgactaaacagtaattaatttatatttgtgaaaaatgtcactgtcctagtgatttctgatgtaaataatgttgtttatatagtatgtattaaattttcctacattgtaaaactgctgtacttttgattcttgtatattaaaaagtgttactgagcattttt

SEQ ID NO: 3005 - DNA, 411 bp, Homo sapiens
  misc_feature (1)...(411): n = g, a, c or t
ccaattatttccaatcttnattnnatncttaaaanntaaccntggtaaagtgttaagctgnaatcatccnctgnnannattctnctatnanaagcccttcttgancngatatgangagaaanaggataacatanataaggtatanttagagaagctgntgcntgagaaatcatgtctccatctccattttgctctgcgctanctgangatcgtttctnacaganatgtatttaggcagtgtgtgtancgcagtgctntgccaaaagtactancgtgaaggtagacaaaccttgtaaatgcacttccanccaattgtggctcaagngtangtggtgaccccaaggctggtgccaatgagactggggtttgggaataagttggtgcatcatcccncctgctgcccctacnngg

SEQ ID NO: 3006 - DNA, 138 bp, Homo sapiens; identical to SEQ ID NO: 2945

SEQ ID NO: 3007 - DNA, 130 bp, Homo sapiens
  misc_feature (1)...(130): n = g, a, c or t
ccanctcactagatgaggaaagaggaaggcattttctgcattcttgcctagttttccttataagcaccactaanttaatagctctgtctttttgntcgtttgcactatgtaatgctattaatanttttta

SEQ ID NO: 3008 - DNA, 243 bp, Homo sapiens
ctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctc

SEQ ID NO: 3009 - DNA, 150 bp, Homo sapiens
  misc_feature (1)...(150): n = g, a, c or t
ctgaccagaagtngnttgttatatggatgggaaccctaacttagggcttgggcaggggaaaganaaagaagatgagagattatacttcatgagtnttagcnatatgggagcaggntttcanttgaattctnangggngnctctgnntgtc

SEQ ID NO: 3010 - DNA, 136 bp, Homo sapiens
  misc_feature (1)...(136): n = g, a, c or t
ccacctgcgggccagtctcaaccctcccccaggtgggcaggcacttgatggctacaaataaatgtcccgtggccccagtccactctactggtgtctctctctctgtgacttcactaggtncgccggcctccccaga

SEQ ID NO: 3011 - DNA, 130 bp, Homo sapiens
  misc_feature (1)...(130): n = g, a, c or t
gtgtggacagtggnggccgcgctgtgcctgctcgtgttgcctacatgtccctggctgttgaggcgctgcttcagcctgcacccctcccttgtctcatagatgctccttttgaccttttcaaataaaatat

SEQ ID NO: 3012 - DNA, 109 bp, Homo sapiens
  misc_feature (1)...(109): n = g, a, c or t
tatctgtaaaatagccaggaatttcctgtttgtgatctattatgcctttttacaaaaaaaaatggctgcanattatccnntaatattaaaggaactttnctttcttgaa

SEQ ID NO: 3013 - DNA, 196 bp, Homo sapiens
  misc_feature (1)...(196): n = g, a, c or t
actcctggcctcaagtgatctgcctgcctcagcctctcaaagtgttgagattacaggcgtgagccaccgctccctgcccaacacatataccatctgaaaatgttagaattctgagttgngattttattgacttgtngcttgctttttcttaggctttgtnacttgnaatatgntaaactgtactatcctaataaac

SEQ ID NO: 3014 - DNA, 127 bp, Homo sapiens
taaatatatttctctcagcttcttcccttatattttttattttttcatcatattttaattttagtaatttaatttctttctccttttcttcctctgatttatgcttatcctcttctactagggttaa

SEQ ID NO: 3015 - DNA, 88 bp, Homo sapiens
  misc_feature (1)...(88): n = g, a, c or t
aaattgtaatcagagtcaaatacagtattgaatggaatgtactgccttctcctcctaaatcaataaacatctttcntggaaaaanaaa

SEQ ID NO: 3016 - DNA, 442 bp, Homo sapiens
ccatgtagcaggtggtcagtatgcgtccacagaggtctcggggatcctggggggtgtagctgatctggttcacgatggtgcggacatcagccagcacttcctcatttccactcctcacggcctcgcagacctggcagcacatggagtagatgaggcaggcggtggctgcgctgtccaccccgccactcaagggcagcaaaaaccctgcctgttgacttcgtcttaaaaaatcccagagccagcaggcaggtccaaggcttatctcctcctcagggctgtggtatttccactcgatgggctcagagatgggtgccagcaagtcctcgtggcacgagagggcaaagtccaccttcactctggggtaggggctcgccctgctggcttgaatctacgaggcagaggttgtgctgagctgggattgcgccattgtactccagcctat

SEQ ID NO: 3017 - DNA, 442 bp, Homo sapiens
  misc_feature (1)...(442): n = g, a, c or t
ncgaggtctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccc

SEQ ID NO: 3018 - DNA, 337 bp, Homo sapiens
ctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagggcggctctatctacagatgtgggagcattatgcag

SEQ ID NO: 3019 - DNA, 216 bp, Homo sapiens
ccaggctcaggccctggggtgaaaggagacaggtgctgccaagaccatacatcagtcatctggcagcagctcgagaagcatgtcctccacgccgtcaatcttgatgtggtgcactaagcgccagaaactggagtctgaggatcggtatcgtccatcagggtagagctgccacatgataggcagcaggcttgggcctatctgggtgggggtcatagg

SEQ ID NO: 3020 - DNA, 294 bp, Homo sapiens
caagcagaccagcaattgcgtcctggagatctgtgctgagcagcgaaacctgagcgagcaggtagactcagccctctctgtttcactctcccctctgccagcgctcagtgccttcccctctatctaactttgtttccctctcagatgccaagctcagtaactctttctctgaagtagggctagggcctttctgtacttgagtttatggcagaattcttttcttagtgtagtcccttcagtctttcctcccttaggactggatagaagtgtctaaaaatactcttatttgaacag

SEQ ID NO: 3021 - DNA, 431 bp, Homo sapiens
ccttttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctctcccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaa

SEQ ID NO: 3022 - DNA, 410 bp, Homo sapiens
ctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgccaaaagaaaactgagtgggaataccctgcaggttcagg

SEQ ID NO: 3023 - DNA, 313 bp, Homo sapiens
ccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcag

SEQ ID NO: 3024 - DNA, 355 bp, Homo sapiens
cctctttcttctgtttgtaaaggttttctaaggcagggcttttcagactttattcagtcaacattaagctcctacactgcctcaaagcagagcgacgatggaaccctttatttcaatggaattgtgcacgtaggccagtgtattgaagaaaaactaagtctggtttatggagagttggcatggggcttagaggttgccgacctggacatccccacttagctggctctaaggcaccctcagaaaaccactgctctaacctgagaatgccatctagtttacaaactcttagaaaactgtgtttaatactcatatcactggcttctagatgtgaagcaaatgctctacaatggttttt

SEQ ID NO: 3025 - DNA, 340 bp, Homo sapiens
  misc_feature (1)...(340): n = g, a, c or t
ctgattgggggggcccaggagctacatgcctactctgtgcgccgcctctacaatgccctggcagaagacatttcccancaaccactggtgcaggtggcagcctggtgcattggggagtatggggacctcctgctggcagggaactgcgaggagattgagccccttcaggtggacgaanaggaagngctggcattgctggaaaaggtgctgcattcccacatgtccctgccagccactcgaggatatgccctcacagccctcatgaagctcagcactcgcctctgtggggacaacaaccgcatccgncangtggtgtccatctacgggagctgcttggacn

SEQ ID NO: 3026 - DNA, 411 bp, Homo sapiens
  misc_feature (1)...(411): n = g, a, c or t
ncgaggtaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttgg

SEQ ID NO: 3027 - DNA, 464 bp, Homo sapiens
  misc_feature (1)...(464): n = g, a, c or t
ctgccaccaactcaggactcaggggctcaattctcttctttggagcatattctgtagctcttcgaagcctgccaagtgtagcttccaaacttttaagtggtcttcttttggggggctttgttgttcgtacatttactgtgcttaattcaactttcatgcccttaataatgcctaacaagtctttttcgtattttccttttcactgtcttggctctctgaagtctccttggaagtctcctcagttcgaacagactgcttatctttcttgctacagatcacactgttagtgccaaaatatctttggatgttattttttgtccgggccaacagcgctgaactgcggtacctgactgttccgtgccgaacagtgagtagcataatcgcagccgctgatgtctccgggcttccagaggacaaagggtggcgggaaagggggcgaagaggtangaacgtcgagactctan

SEQ ID NO: 3028 - DNA, 143 bp, Homo sapiens
  misc_feature (1)...(143): n = g, a, c or t
aggtccaccctgaccatcaacaggggngaagncggcnatgaggccgactattactgtcaagtgtgggatcgnaataatgaccatgtcgtcttcggcggagggaccaaactggccgtcctangtcagcccaaggctgccccctc

SEQ ID NO: 3029 - DNA, 357 bp, Homo sapiens
  misc_feature (1)...(357): n = g, a, c or t
tggaacccangacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctgtgaatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctgg

SEQ ID NO: 3030 - DNA, 402 bp, Homo sapiens
gaagctttctcaggggagtattttctggtcgacttggctaatattatatgtagtctgaatttctctttcagatgcttttaacctcgtaatacaattttattcagactgagagctgtttttctcttcaatgctttcagtgtctgtcttcagaagggacacccaaaagtgtctcatggtgtttctgagtgagttgggctgtcacaatgagaactctttggcactctatcgagacccataatgggaatccagcagtatttttttgtcaccattataaatagaaacttaggctgaaacattgctcccatttccattattgcaaaagtgcaatcctacccaggagtcctgcaggttctcctcctgcagttcagggacgctgctccataatgtgacactggagtgcag

SEQ ID NO: 3031 - DNA, 163 bp, Homo sapiens
  misc_feature (1)...(163): n = g, a, c or t
gcaggtctgacctacctgccaacctctcctctgctggcagattgtatcatccccattactgatatcagggctttcacaacaacactcaaccttctcccctaccataaaatagtcaaataaataaactgcagtcacgttggccggaaaaaaaaaaaaaaaaaan

SEQ ID NO: 3032 - DNA, 285 bp, Homo sapiens
ctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaagg

SEQ ID NO: 3033 - DNA, 160 bp, Homo sapiens
  misc_feature (1)...(160): n = g, a, c or t
gtagcaccatgngagaccactggaccatggtttcagaggncctgctcaggtgaatcggatgtgttntcacaanttcactgagctgagngggtgtgcaacatgaaatactantgctgtgagggacagaagggacagaaagaggctgaagaccatcatccag

SEQ ID NO: 3034 - DNA, 278 bp, Homo sapiens
caccaccacgtcgatgcggtccactgagaaggggttgaactgcttgtccggccggcgcatgaactcatgcttgaggaggtagccgctctgcccgttgaactcaaatactgccatgttctgctgcatgggcaagtccatcgtctggaagttgagggcaaccatctggcatccagcattccagaacatctggggcatgtagttggaggagtccatgcgggttcccttggggtaaatgcggctcatctggcgcttgttgtagtccacaaactgcaccgagg

SEQ ID NO: 3035 - DNA, 120 bp, Homo sapiens
  misc_feature (1)...(120): n = g, a, c or t
gataatgtaaatacttcttaaatgtctgnaactcttcaaaagtgatgcttcangataaatgagctgctaagcattttaagaatttaccgtaactctaatatctgganggaaggggatgga

SEQ ID NO: 3036 - DNA, 397 bp, Homo sapiens
  misc_feature (1)...(397): n = g, a, c or t
gaggtaaatgcgcatgtaatttatttatgataatgtaaatacttcttaaatgtctgtaactcttcaaaagtgatgcttcaggataaatgagctgctaagcattttaagaatttacgtaactctaatatactggagggaagggatggatctgaaaggctaccatcagtaagaggaataaaacttgctctgtgtcctccagaagtctggacagtgatcagcaggtaatagacacagaggaactgatttcaacttttgaaaaagagttttccactaattaacactgtcccacggcggaataggttccctgaagatgttgagtgctgaaagtgatcaagcaggaggctagagggcttcttgcctgggagcaggggagggttgggggagaaggacaanagga

SEQ ID NO: 3037 - DNA, 263 bp, Homo sapiens
  misc_feature (1)...(263): n = g, a, c or t
aagtgctcggtttacaggtgtgagccactgtgcccggccattatgtgttttaagaaagggttgtgatctgttacaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaangctgcagagggtgtgagtgctgctgatatgg

SEQ ID NO: 3038 - DNA, 394 bp, Homo sapiens
  misc_feature (1)...(394): n = g, a, c or t
gatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggnaaattaataagcattccagatgcttgcagcttcctgcatccaggagatgctgtgttccccgtgatgcag

SEQ ID NO: 3039 - DNA, 240 bp, Homo sapiens; identical to SEQ ID NO: 326

SEQ ID NO: 3040 - DNA, 213 bp, Homo sapiens
  misc_feature (1)...(213): n = g, a, c or t
cactctgttnccgccctcctctgaggagcttcaanccaacaaggccacactggtgtgtctcataagngacttctacccgggagccgngacantggcctggaangcagatagcacccccgtcaaggcgggagtggagaccaccacaccctccaaacaaancaacaacaagtacgcggccagcggctatctgagcctgacgcctgagcagnggaa

SEQ ID NO: 3041 - DNA, 343 bp, Homo sapiens
cctcaggttaggaaggaggggcacaggttcttgttggcatgagtgtcaactcagtgcaaaggactgtcctaatctggaaacctgaaagctgtcatctcacagatgtagggaagagaacttctacatgactctgactccagtgtccaccatgaccaagttttatgtaccttgttacattttgagctttgagcataagtcctagtgcgttgtgtatcatcagtcaacttccaatccttgttagagctgaggccagtccaatatgaattccctgaaccaccatttggcaacagtgaatttaagaagtagtaagagtgtgattgtggataaatttcactgaatgtgg

SEQ ID NO: 3042 - DNA, 275 bp, Homo sapiens
cctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaagg

SEQ ID NO: 3043 - DNA, 223 bp, Homo sapiens
ctgctgccacagccagtattgccggggctccaacccagtacccacctggccgtgggggtcctcccccacctatgggccgaggagcaccccctccaggcatgatgggcccacctcccggtatgagacctcctatgggtcccccaatggggatcccccctggaagagggactccaatgggcatgccccctccgggaatgcggcctcctccccctgggatgcgagg

SEQ ID NO: 3044 - DNA, 359 bp, Homo sapiens
ctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgt

SEQ ID NO: 3045 - DNA, 400 bp, Homo sapiens
aaatatgctgcatagactactggaccatattttgtagccattaaattttcaaaagactgggcccactgtaatacttcctccaaagtaaggtttgaagggggcctcttagattcatctctgcacatcttacaaatccaacaattccgcctgctcatttttctctaaaatgagaagagaaaaggcagcgttagaatatcatcaagcttcaaataaacaatgatcatttttttctcatgttggtggtataatatgtggaaacattccattgacaaatatatcctgtcgagcagtccaccatgctaaatttgatctcctctttgttatgatccgtttgaaatcaggttctgaaattttgtgagacacccagcattttatttttcccagagtaaaagaattttac

SEQ ID NO: 3046 - DNA, 299 bp, Homo sapiens
ccactcggatcagctcctcgctcacctgaagccaagagaagaaggagagaagcaccaagaatcagctaacctcagaaaggtctgttttggagacacaggaggtactatttccagcagtcagaggaagtgcacagcaccaatgcgaggaagaaaaacaatcccacttgcgcccaccagctaagggaccagggtctatgaagccccacagtggctccgacccaccatcatggcctgctggaccagggtgttgctgtgctcacacatgttcttcagaatcttgttggctgcattgtgccggg

SEQ ID NO: 3047 - DNA, 129 bp, Homo sapiens
  misc_feature (1)...(129): n = g, a, c or t
atctctggaagcttancaatcttattgcacactgttcgctggaagctttttgaagagcacattntcctcagngagctcatgagggttncatttttattcttccttccaacgtggtgctatctctgaaac

SEQ ID NO: 3048 - DNA, 410 bp, Homo sapiens
ccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgttt

SEQ ID NO: 3049 - DNA, 464 bp, Homo sapiens
ccttgtggcccgatcacctcccaacaccttcacattggcaacacctggactagggtcttagtagtcccacccctggggtcgtcaaagaacagatcagaaattcctggggtgtaggggcaggatccttacatcccctgtactgtaacatatgcatgcaccccccagtcgcatccaagtcccacagatacaagggcttgctgaggtccgagggtctggatggtgagtccagggagcatgagaaattcatccaggccacacaggctcaggcacctatactcctgcccaccccctgcaggatggatattaccatttgaaatactttggcgcttgcagtgagatcttgcttaaaagaagaaacccaccaaattctagaatcgcagaggtgggggcacctatgtgacaaatgagggaacagaggcacagagattggcagggacatgctcaaagacatggagagcctgggc

SEQ ID NO: 3050 - DNA, 264 bp, Homo sapiens
  misc_feature (1)...(264): n = g, a, c or t
ccaccctaagcccgncagtggagctccttttccagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgagg

SEQ ID NO: 3051 - DNA, 128 bp, Homo sapiens
  misc_feature (1)...(128): n = g, a, c or t
cttccactgntcaggcgtcaggctcagatagctgctggccgcgtacttgtngntgctttgcttggagggtgtggnggtcnccactcccgccttgacggggctgctatctgccttccaggccactgnca

SEQ ID NO: 3052 - DNA, 329 bp, Homo sapiens
cctgaggctggctcatcggaggcgtgagtgttcggccctgccatgcctcacatccccaggatgccgcggtgggaactgggctgtggctttcctgccctggcactgcttgtttgctgggatttcaggaggaaaacccccaagctccgaaagaaaggtatttcttttttattttgtggttcacttcttccactagaagactcgtttcccagagcctctaccctctcctgtcaggggtggggagcgcttctggaactgataccctgggaaggaggtatcagtgctgagcgggcaggcacagtgtgtatgggggtggggagctctccctgagg

SEQ ID NO: 3053 - DNA, 373 bp, Homo sapiens; identical to SEQ ID NO: 6

SEQ ID NO: 3054 - DNA, 466 bp, Homo sapiens
  misc_feature (1)...(466): n = g, a, c or t
ccatgagtgacaggtggcctcttggtgggagaggtggggcagggggaaggcagctcccactagaccagggcagtatttaggggaaggaggcagattggagcagttggctgccaacacctggcctcactcagggagaggggccttgggcctggaagatatctgggtgaggtacccacaccatctgctgcaacctctgtgtatccattatgggctcacgccattcacaggcatgaattgagcacctagtatgtgggaaaacaggggaaacagagatggcacagacatggtctccatccttcgggggctccagtctagttgggggagatcagagaagttccatttgccactctaggccangctaggtaagcggcagagccatgaagcattgtgggagcttggaggagggagtgagcccttgcagtcanggagaaggagtcatcctggggagacttccagaaagtagccc

SEQ ID NO: 3055 - DNA, 114 bp, Homo sapiens
aaattcctgtaataaaagggaaattgagggcagagcaatcaggctggagttgcaaggacccaggggatcacctaatgccagaagccagccatccaaaactctgtttgtcaaagg

SEQ ID NO: 3056 - DNA, 373 bp, Homo sapiens; identical to SEQ ID NO: 6

SEQ ID NO: 3057 - DNA, 359 bp, Homo sapiens
aaacctaaattttttaattaaatgcctgttcaacaaagctaattggaacaaacacatttatgtaaatttacattctagaataccagggtaaacaaggagacgttattcaaagatgaatgagaaagttctattctttttcatcatttgtgtgatcaggttgcaaaggacatgctctttcctcgatgaaactgatgtcgaattagtggcagaggtggaagaaccaagcacctttctgggggctcgagcagccaccacttttctgtaagtgcctggaacactgtctgctttagtccgcaccatgttcaaacaagaagagaggagaggagagaacgaactgacttcccagccgagggtgtttc

SEQ ID NO: 3058 - DNA, 345 bp, Homo sapiens
aaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctgg

SEQ ID NO: 3059 - DNA, 340 bp, Homo sapiens
  misc_feature (1)...(340): n = g, a, c or t
ctgtgagactagggctgtgctttgcaacccccatagcacccggcatatattgctctgcattcagtgtatatttgagagctctgttcttttggaaacactaacccatgtattttgaattttataccatttgtagatgtactagcagcaatatgtcctgtcttatggattacaaccatgcctagaagttaaaaaaaaaaatcactgtaggngtataaagtttacctcaaatataaccaaataattgagcaactggtaataactgctgtgctctgaatgtttgtgttcccccaaattcatgtcaacatcctattccacaaggngatggtatcaanaggtgagg

SEQ ID NO: 3060 - DNA, 325 bp, Homo sapiens
ctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgtttt

SEQ ID NO: 3061 - DNA, 419 bp, Homo sapiens
ccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgagg

SEQ ID NO: 3062 - DNA, 246 bp, Homo sapiens
ccactgcaacagtgagtcaaactctcctcgcatgaccacaaagtatagggacaggtgtgaccccctccctgacccatccccattcaggtatgctctagcacagagccggtagccacagcggctggtgtagaaggactggctgaagatggacactgtgtgcccatccaccgcctctctcttcttcatcttgtaatctgtcaccttccaaatgagccttccattatagcaagtaccctccagcagttt

SEQ ID NO: 3063 - DNA, 220 bp, Homo sapiens
  misc_feature (1)...(220): n = g, a, c or t
aaagaccaatttgttctacctagcattttaactagtttttctgccggctatgttgaatgcacaaattctgtcacgcatgttcattcattgctacataatttggttcttctggaatatttttatgtagctcttggagtacagctatgaaaattaacaactgttaaaggaaataccttttttttttgtaattttttccttgaanaaccaaagtattttttca

SEQ ID NO: 3064 - DNA, 467 bp, Homo sapiens
  misc_feature (1)...(467): n = g, a, c or t
ctgtagcttctgtgggacttccactgctcgggcgtcaggctcaggtagctgctggccgcgtacttgttgttgctctgtttggagggtttggtggtctccactcccgccttgacggggctgccatctgccttccaggccactgtcacagctcccgggtagaagtcactgatcagacacactagtgtggccttgttggcttggagctcctcagaggagggcgggaacagagtgacagtggggttggccttgggctgacctaggacggtgaccttggtcccagttccgaagacataattgttgctgcctgcatatgagctgcagtaataatcagcctcatcctcagcctggagcccagagacggtcanggaggcccgtgttgccagacttggagccagagaancgatcagggacccctgagggccgcttactgacctcataaatcatgagtttgggggctttgcctgggt

SEQ ID NO: 3065 - DNA, 441 bp, Homo sapiens
cctcagcatcgcctggacctgttcttgcttggggcatcccgtcggtcaccaaccatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaaggttgccatctgcaacccagcccggtttttatcttgtttttctgtgttttaactttttatttagacttacagtttgaaacagtgctagaatcggaagcatgtaaagaaacctgtggaccttttatgcagatacacttaagtttttaacccatgtgccttatcactggggacctcttgcactctctctcatgatttttttcccgaactagatgaggatattgacaaagattcttgcttgg

SEQ ID NO: 3066 - DNA, 349 bp, Homo sapiens
aaagaactaatttgtaaattatgacacaaaattttattaacaaggaaatatccattaattgactactacagtaaaaactttataatgcttgtatcatgaagaaagaccttccttttccttatatattaattgaactacataggcttgctgtacattttgttattcatgttataagaattctagattccattgcttttgaaatatgtttctttttaggaactaaaagtcaacttatagtttgatttctgttttatttgtactgtgtttctgattttgtgggtttctaaataaaaagatcaaacccaccactttcaatatactgttttctatttaaacttttgagttgtag

SEQ ID NO: 3067 - DNA, 119 bp, Homo sapiens
  misc_feature (1)...(119): n = g, a, c or t
cttccactgctcaggcgtcaggctcagatagctgctggccgcgtacttgntgnngctttgnttggagggtgtggtggtctccactcccgncntgacggggctgctatctgccttccatg

SEQ ID NO: 3068 - DNA, 413 bp, Homo sapiens
aaaatgaatttgaaattcagtatctattcaccatgacctaagagtatacagaggaaacagttagaaatggccagttgagggtagggtgtttaattgagaagtcagcacacactggcagctcttaaaccaaatattggctcgtttaacttgaaactgtaagtattttgaaattctttgtaacatataatatgctgtaatttcaacccttatttcccctgttgttagacatagggactttagactaaacatactttttgccttcatcacagttccaagttcttcgatttgatttgtctaatggaacaaattgatgttaccttgaagtggtatgaggacctgataccttcagcctactttccccactcccaaacaatgatacatcttctccaagcattggatgtggacctgcccgg

SEQ ID NO: 3069 - DNA, 151 bp, Homo sapiens
  misc_feature (1)...(151): n = g, a, c or t
cgaggtccaccctgaccatcagggngggnngaagccggcgatgaggccgactattactgtcaagtgtgggatcgnaataatgaccatgtcgtcttcggcggagggaccaaactggccgncctaggtcagcccaaggctgccccctcgggca

SEQ ID NO: 3070 - DNA, 320 bp, Homo sapiens
aaaatgacatctaacataaccagcaaataccagtaatggtggtgatatatacattatcctttatgttgtaaataaattgtattcaaattaaatgcaattttctcatgatcaaaacattctgctttcgatcatgttttgccagaggaaaaggtgagcgcgcttagtgtattgccaggtacttagaaagtgctcaagatctctggcgtcctcaacagtcttggtaaccatcttggattatctttattaatggttttacaactcccctgactgacaaaccttcacttctttctttcttttcttttctctttcttttttttttt

SEQ ID NO: 3071 - DNA, 181 bp, Homo sapiens
aaacatttgtcttattttatacctgtactttgagtaaggttttaagttgaaatgtcattatttccttatctgaaggattaaaggaaacagggacccagtggcttggtggtttgggaagaacacttggtgatggcggctcactaaatttggcaccagcatagttctgattagcttgagattt

SEQ ID NO: 3072 - DNA, 454 bp, Homo sapiens
aaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttact

SEQ ID NO: 3073 - DNA, 321 bp, Homo sapiens
aaaggaggttatgggctgagagtagattgctgaaagtcatgatttaggaagtgtaaggttactggtaatgacacaccgcaagtgcagctaagggagttgacagttgggatgagtgaaagaaaagattattagtatgaggatttcaaggaatcgagaaagtagggctttggatgagttgtttttgtagaagtcaccaatgatgacaatggatgctgatagagaaaaagatggtgaacccgggaggcggaggttgcaatgagctgagatcgtgccactgcactccaacctgggcgacagagtgagactcagtctcaaaaaaaa

SEQ ID NO: 3074 - DNA, 310 bp, Homo sapiens
aaaaggaagagaaaagcaatcatcactattttggttttgttttgttttaggagtaactgactactgaacagtactgcatgtttctgaggttcctctgttattcctgtagttcactacctctgcatcctccccaggacaagaaattcattttccttattgtactgtgttatgccaagaatattactattgtttggtgaatataaaataatcattatagcaacaatttttttggcgtcctaaataaggctgatccatggcaacggtactatgcaaagaaaagaataaagtcaaaacacttgtaaaacctttt

SEQ ID NO: 3075 - DNA, 451 bp, Homo sapiens
ctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcacaactgatgaacctggcaggaggcgcagtggtgctggccttggagggtgg

SEQ ID NO: 3076 - DNA, 270 bp, Homo sapiens
ccttcagaagttaaacgtgatcacttgtgctgggacagccaatagaggagtctgagatgatcatttccaaggagttcttcacagaggaggtagctttggagctgggctttgaggttgggcagtatttgaaacagtagagacggagcaaagaacccctcctggtggggtcagtcattcgctttcttttcctcctcaggaccagggctctttgaagatgaagaatgcccacaagggaacacaggcagaagatcagataagccaaagtcacag

SEQ ID NO: 3077 - DNA, 472 bp, Homo sapiens
aaaaaaggtgacttggattaaagtatgcaaactcaaggagtagtacgagcccacttgagtcaagttagcttagttgctaaagagcttgataccaaaattacttttgtttacttgatgaatgggatagttgttgcacagggccactgatctagattactgtcttatttgtcaagtacttatagttgtagaagtagcagtgtgaaaattatcggaatggagaaggggcaatgataaaacaatttattttcaggtaccagcaacttcaaggtttctgccagcccactgttgtatacacttattgagaaaacaatgcaaaatgtgaagcatccggttactggacaatttctatatcaggacagcaactgggccagcaaagttgagaaactcactttagacaatgctgctttccctttccttgcatattctggaatcccagcagtttctttctgtttttgcgaggtaagtctgttca

SEQ ID NO: 3078 - DNA, 269 bp, Homo sapiens
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttc

SEQ ID NO: 3079 - DNA, 142 bp, Homo sapiens
  misc_feature (1)...(142): n = g, a, c or t
agcagcgctggtggtgcctcagccatggcctggaccgttctcctcctcggcctcctctctcactgcacagactctgtgacctcctatgtgttgactcagacaccctcagtgtcantggccccaggaaagacggnnaagatta

SEQ ID NO: 3080 - DNA, 341 bp, Homo sapiens
aaaacagatttcatctagagcttcatttccctgttgagctttcttaaagagttctcttaggactgactgtcggaactggacaggtaaactcaaggttaagttgtcttcaatgaaaatctgtattacctcctgatagttgccagatctcaaacaaatatggacttgactatatggagtcaactgttgagatgtactatcagaagaaggtacaagaacatcacatgcttgacaatagccagctaaccgcttctcatctatggtacaatgaagagataatgaacctatctctgcaattagttctttggttctaaaaaatttttccctggcattttcatagacag

SEQ ID NO: 3081 - DNA, 468 bp, Homo sapiens
ctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggagcatgcggcgatgctgagtttcatcaaataggacgcagcagaagttgggaagcactgcagaagatgggttgtcttccagaaagaccactgttttggggaacagcttggctctttcttcggccgctggtggttggattagctgttggagggatgtgcaggactgaatggctagtactgatggtttcacggctgtctctgcaggcaggg

SEQ ID NO: 3082 - DNA, 173 bp, Homo sapiens
aaaaaaataaaaacaacagagtgggcttctttcctgccgttgcttttgccatttgtagcattacaggtaatcagtcagaattcagatcacttaactacataggtgagagtgagagtgggttaagttatgagtcctctgtttttgctattctctctggcctgtggttctgctgg

SEQ ID NO: 3083 - DNA, 373 bp, Homo sapiens; identical to SEQ ID NO: 142

SEQ ID NO: 3084 - DNA, 424 bp, Homo sapiens
cctcctccctcacacacacgtcgccctgtcagaaggccaggcacactactgcagccaggatgctgggatagcaaggggataggtgctccaaccttcaccttccagaaaggcagggtgatctgaagtgacgtgtagctgagagctggatggggagaatttcactttcccagttgatccagaaaggaaagaaaccccagagcatcctctcggaagaacttaaactggctttgggctccagtgcgagcgagtgacttgtggaaaggggcaccatgatgagaggccggggccggtgggtgttgctgtcctgggtgaacatctcgtcatctgtctgttctttctccccggcatcatatcccttatagtctgtgctccaggtaaacagtgtctctgccagccacagcttggcaagcccggctatgtctgg

SEQ ID NO: 3085 - DNA, 308 bp, Homo sapiens
ccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgattt

SEQ ID NO: 3086 - DNA, 470 bp, Homo sapiens
aaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagtacatacaggggagaaatcagtct

SEQ ID NO: 3087 - DNA, 465 bp, Homo sapiens
ccttgcctcagatccaaggtcactcggaagaggccatgcctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattattt

SEQ ID NO: 3088 - DNA, 190 bp, Homo sapiens
aagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatgg

SEQ ID NO: 3089 - DNA, 166 bp, Homo sapiens
gaggtaaaaacaaaaatatttatttggaaaatattagtagcatgataactcaacctcaccagatattaacagttcatcaggtcaggcaatagaacaagtccacatgagcttcttaaaaagaaatggatgactacttcaatagctgactccatcttccattttatta

SEQ ID NO: 3090 - DNA, 193 bp, Homo sapiens
  misc_feature (1)...(193): n = g, a, c or t
ncgaggtctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaagganaagtgatgcaggggagatactactgtgcag

SEQ ID NO: 3091 - DNA, 145 bp, Homo sapiens
  misc_feature (1)...(145): n = g, a, c or t
tcgaggtcctcaggcacttggcctttgntttcacaccaacttgatgggttctactataagatgctaaaaaggtgggttgtgtgtggttcagattggttgatttgtaaccctagttgtgcataagaattgcccagatatttttttt

SEQ ID NO: 3092 - DNA, 89 bp, Homo sapiens
tcgaggtaaagaaaacaaaattggagttgaagaataagtaggtttccaattggctattgccgttttctttgaaaaaataaacatttttt

SEQ ID NO: 3093 - DNA, 164 bp, Homo sapiens
  misc_feature (1)...(164): n = g, a, c or t
tcgaggtaaaaatactgaatattatagnttacctcttctcttcttttaagagcctacgcaacttttctgcacttgtttctattttctttgttttctgcttttcttccttttcagcttgtttttctcttaattccaaagatttcttttagaacccagatatcgaa

SEQ ID NO: 3094 - DNA, 283 bp, Homo sapiens
  misc_feature (1)...(283): n = g, a, c or t
aaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgagctccatctacaagtgattacctagttgtgagctgttggcatgtggttagaagccatcagaggtgcaagggcttanaaaagaccctggacctcn

SEQ ID NO: 3095 - DNA, 304 bp, Homo sapiens
  misc_feature (1)...(304): n = g, a, c or t
cactaaacctcaagaagtcagataggtattatcatggnccaactccaatccagtcactacagtatgcaacaagtcaggacattattaattcttttcaaagtattagacaagaaatggaagcttatacacccaagntaactcaggttctctcaagtagngctgccagtagtaccatnacagcactgtcacctggaggggcacttatgcagggaggaacacagcaagccataanccagatggtgccaaatgatattcaatctgaattgaaacacttatatgtagctgttggagaacttctaccaca

SEQ ID NO: 3096 - DNA, 137 bp, Homo sapiens
  misc_feature (1)...(137): n = g, a, c or t
ncgaggtaaaagtcgacctgttttgcagaaagtctgctgtttttgtactaaaggctttggaatttggcatttagctaggaatgcacattctttcacctcattcatactttaagaaccacagaagtgactctgcttgg

SEQ ID NO: 3097 - DNA, 182 bp, Homo sapiens
ttggctcgcttaaatgggacccttcgggaagacgataacaggatcttaagaccctggcagagctcagagacccgcagcattaccaacaccacagtgtgtaccaagtgtggaggggctggaaaacaccaagtcatacattttacattgtagaagcagtagcagcagtactatactcagtattt

SEQ ID NO: 3098 - DNA, 125 bp, Homo sapiens
  misc_feature (1)...(125): n = g, a, c or t
gnaaaccagtagcccctctggaccccccagtgaatgctgagatggagctgacagcaccgtccctcatccagcccctgggaatggttcccctgatccccagccccttgtcatcagcagngcccctg

SEQ ID NO: 3099 - DNA, 215 bp, Homo sapiens
  misc_feature (1)...(215): n = g, a, c or t
nngcaggtccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcagggtattaatcgagatacacttgttaggagggacagggttcccctaaggcactttt

SEQ ID NO: 3100 - DNA, 380 bp, Homo sapiens
  misc_feature (1)...(380): n = g, a, c or t
ncgaggtccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacag

SEQ ID NO: 3101 - DNA, 146 bp, Homo sapiens
  misc_feature (1)...(146): n = g, a, c or t
ccatgggaagcccgagaatnggttcctatagacccggttcctgatgaattcccaggccaaaagaaccaccctgacaaattttgggttctgaaagtcttattattggacagtattgcatagctagagaaggaaaaggatttactcat

SEQ ID NO: 3102 - DNA, 268 bp, Homo sapiens
  misc_feature (1)...(268): n = g, a, c or t
cattttccccttggtcacacatctgtaacaaagccctaaagtcaaaaccagtgacccgagacccacgtgcccaagactcccggggtctgaacctaaactttgtacacgttactaacataccagttcgcttacctaaaagggctaggtcatatcttaccacgtanacaaacatttcctctagaaaaaaggacagcagggatcctcttggcttccttcagccagtggctttangacatgcaagtccctgtagtaagggaagtctatgacc

SEQ ID NO: 3103 - DNA, 10 bp, Homo sapiens
tcaaaaataa

SEQ ID NO: 3104 - DNA, 159 bp, Homo sapiens
gaggtaaagctcaaacttacagagtctgttgtaaggttaatacatagaatgctagctttttagtcacctgagaatcaggaaattcacatgaacataattccctatactgacaaagaactatagctacctatgggcttgtcaagttcctacgcttcattc

SEQ ID NO: 3105 - DNA, 156 bp, Homo sapiens
  misc_feature (1)...(156): n = g, a, c or t
nttcgaggtccaccctgaccatcaacagggncgaagccggcgatgaggccgactattactgtcaagtgtgggatcgtaataatgaccatgtcgtcttcggcggagggaccaaattggccgtcctaggtcagcccaaggctgccccctcggtcactc

SEQ ID NO: 3106 - DNA, 238 bp, Homo sapiens
tactctcagcatgagaaatacaagtattatgagaaagagggcttattctgagcagaatttccatctctgctgctctcccatctgccggccgttggattgggaatctatactggaacacacctgacaacctccaccagcactttttgatgaagaattggaattcactctattcacatagtagaattatatcagagattgcaagatagctaactgaagagctactatgattcttgggtgg

SEQ ID NO: 3107 - DNA, 168 bp, Homo sapiens
catgttataagaattctagattccattgcttttgaaatatgtttctttttaggaactaaaagtcaacttatagtttgatttctgttttatttgtactgtgtttctgattttgtgggtttctaaataaaaagatcaaacccaccactttcaatatactgttttctattt

SEQ ID NO: 3108 - DNA, 122 bp, Homo sapiens
gtatcacatgagctgctgagctgaaatcacagtggtttatttggtgtcttgcaggacccagcctttatatgttaatgtttttccctcattggtatgggatacctacaggatgaagtgcagac

SEQ ID NO: 3109 - DNA, 196 bp, Homo sapiens
  misc_feature (1)...(196): n = g, a, c or t
agatggtcctcctctgtgcccatgacccctcagcagccaaggctggccctgccagataaatgtgtgtgcccatgatcacacccangggcacaggccacatacgtttccctgaaaccttgggctccagcctccatcccgtccatgtgggagggaacttgggtcccagcagtgtgtctttcagcaccaantcatgttt

SEQ ID NO: 3110 - DNA, 380 bp, Homo sapiens
acctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcgggaatacggttatccacagaatcaggggataacgcaggaaagaacatgtgagcaaaa

SEQ ID NO: 3111 - DNA, 295 bp, Homo sapiens
tcctccatcctgtggaacgtgggaaaactatcttgagtgttggcgtgttctaagtatgacataatagtttaatgtatgataaatcatgggtgtttagacgaaagatttacacatataaattggaggctttagcggtcttagtgtaactaacttttcggtccccttaacccttgatgcctgttctatgggtctctagagcggaaggagcattatactccggaaacatttgctggaaggggttatgagaaattcctctctgtatgctaactccgtaatacaagcgtttgtgtatttt

SEQ ID NO: 3112 - DNA, 287 bp, Homo sapiens
  misc_feature (1)...(287): n = g, a, c or t
naggtgatttgcccgccttggcctcccaaagtgctgggattacaggcgtgagccaccgtgcccagcctaacagttgctttcttttcagatccggagacatacccttcagccttgctgccatgtgaaatttgttgtctaccagaccccagagctcccagttcttggtgtgcagcaagggcagaagtgggtgactcaccttctggcacaaacatgttggcgatcaccatgagcccggccaggatgaggaaggaggccaccgtggcacggcggcccacgtaaatcatggt

SEQ ID NO: 3113 - DNA, 508 bp, Homo sapiens
  misc_feature (1)...(508): n = g, a, c or t
ncgaggtgttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtcaaatctttcatccatacctgtgcatgagctgtattcttcacagcaacagagctcagttaaatgcaactgcaagtaggttactgtaagatgtt

SEQ ID NO: 3114 - DNA, 166 bp, Homo sapiens
ttcgaggtccatgggatggctcttctgaccattgggggccaggccaggccaggccaggcttagggcagcaaggaccaggccaaaggggcagggcctcctttggaggggttgaggggtacatcctcggctggtgtttgcatccaggggtccagcaggatctcttcca

SEQ ID NO: 3115 - DNA, 350 bp, Homo sapiens
  misc_feature (1)...(350): n = g, a, c or t
tcnagggggatggaggactagtgatcggctggctgcttccagtcgattagagaggtgaaaaagctgaacgtgtgccagtaatcttcaaaaggcagaacatatcacctctgccccgtaaactgttctctccgaggggaaaaaatggaagttatcctcacagttcactgccgtggtatttcttctgtcccatgctttgcatgactgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagcttt

SEQ ID NO: 3116 - DNA, 344 bp, Homo sapiens
  misc_feature (1)...(344): n = g, a, c or t
ncgaggtctgaacgtctgtgggtgagccggggtcccctgggagggtcttcttgcactctgactgcagtcggtaggcactggacgtcagtaaacgaagggaagtcctcaccatatcagacttgggttttttggggaataatgctgccatttctgtaacagctaccgtgtatcctctctgagcagggaatataactgtcatgtttattttcttgggctgctcttaagagctcctgtatgtttttggtgatctgttcagtcctcctgatgacatcttcggtgctagggagagtggggcttggggccacatggggttctgctgtgtctggtaccaagccatcccctgg

SEQ ID NO: 3117 - DNA, 365 bp, Homo sapiens
  misc_feature (1)...(365): n = g, a, c or t
ntcgaggtcatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 3118 - DNA, 350 bp, Homo sapiens
  misc_feature (1)...(350): n = g, a, c or t
ngtggaacagacgtcagaaaaacaaaaccttcccaaaatactcctggatttggaagatggaaattgcaaactgcagtgtagcaaaaggaacattcattttaggatctggaaatctgggtgggagtccagactcctctcactagcnggaagactgaaggcaggttaggctaactattctgagaccacaaaatgcaactcagaactggatcgagtgttattacacataggaaaagtgctttataaattgtgaagcagtatatatacaatgttaggaagcagcatcataaagaccttgataaatcaatgagaaaaaaatacaaaaatgcacaaaggatgggaataggtaattc

SEQ ID NO: 3119 - DNA, 3 bp, Homo sapiens
  misc_feature (1)...(3): n = g, a, c or t
ccn

SEQ ID NO: 3120 - DNA, 348 bp, Homo sapiens
  misc_feature (1)...(348): n = g, a, c or t
ctgagacaaaagtaggcccaantccttccacagggacggaatgatgctgccagttcactgtcagcatgggtgggaagagattactgacaaaacagaccaaagtgttgggcttgccaaactccaggggcttcagcgtgaacacttcagcgataggaaaccctctggacaccgggattctcccatcaagttttggccctatttgctggatcatccactcgcagaactctttgtcaaataaaatggcaggagcatctccctgttcctgagcccagtcagcaaattcgggcaggcgaggcacccgagtgttctgggaaaagtcgaagaagaaaagctggtcctcgtcgtagg

SEQ ID NO: 3121 - DNA, 372 bp, Homo sapiens
  misc_feature (1)...(372): n = g, a, c or t
ngcaggtggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtc

SEQ ID NO: 3122 - DNA, 115 bp, Homo sapiens
gcatcgacaaaagaaccattgaaaaatttgagaaggaggcctatgacccccacccagataggcccaagcctgctgcctatcatgtggcagctctacccttgatggacgatcccga

SEQ ID NO: 3123 - DNA, 77 bp, Homo sapiens
ccacggcagtgactgctgattgcctaaccccacatgtgttctcccccttccctgataatcaagcccctgattttcag

SEQ ID NO: 3124 - DNA, 315 bp, Homo sapiens
aaaatcagattttctaaactacaattgttttagaacactgtatgaagaacttatctagtcatagttatttgtagtcaggattttaacagcttgcaacaggtaatgttttgaatataaatatctttccaaagtgttactaatggtaaagagataattttctaggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgtttt

SEQ ID NO: 3125 - DNA, 159 bp, Homo sapiens
  misc_feature (1)...(159): n = g, a, c or t
tcgaggtccatgagtgacaggtggcctcttggtgggagaggtggggcagggggaaggcagctcccactagaccagggcagtatttangggaaggaggcagattggagcanntggctgccaacacctggcctnactcagggagaggggccttgggcctgc

SEQ ID NO: 3126 - DNA, 382 bp, Homo sapiens
ttcgaggtaaaatcttgagggattgatctcgcctcatgacagcaagttcaatgtttttgccacctgactgaaccacttccaggagtgccttgatcaccagcttaatggtcagatcatctgtttcaatggcttcgtcagtataagttcttctccaggaactcacgcactgacttggcaccccggcctatggcattggccttccaggcatggtatgtgcccgaggggtcagtctgatagagcctaggagtgccatcaaagtcgaaacccacgatgagggcagagatgccaagcggcctgcgcccattgctctgcgtataacgctgcttcagactggcgatgtagcgggtgatgtactccacaggtgaccgggtcctccgcagtc

SEQ ID NO: 3127 - DNA, 310 bp, Homo sapiens
  misc_feature (1)...(310): n = g, a, c or t
gntttaatatggatatactgatgaagacttcaaaattcaccaagaatctttgggatctaatttcttcaaccaatttactttagggtcctttttactgtaggtggtggggatctacctggttctcaatttgacaccctctcaacatgaatgaggttcaaatcacattcattcctaagcgatcactcaagaatggtacagatgtgttggagtatgccaatacctaaggtaaaaaagtagattatctttaactccagacccatgttctcaagataaaagcctttgacattcatgatcctgtcacattttcagg

SEQ ID NO: 3128 - DNA, 381 bp, Homo sapiens
  misc_feature (1)...(381): n = g, a, c or t
ctggcactttaagaaaacgataatctcgaaaaccacaaaattgccaaattgttccctaaactcctaagcagataaacatgactaatgaatgagtttgttttgtaaagaaaaatcattcaaataaattgaataattcatactgagatgcaaagtttgtcttctttcttcctatctacttggatttataaaggggnnnaccgtaatataggaaaatataccctattttgaatgtggcatntttgnttgaaaagctggcccaattaattaaaantncttgtantggaaagtntcntcccctgagcagtccatatttnnataaatgggaanangacatctatggcgcagcatnttcatagtctnnactgagactaatgtcnacaa

SEQ ID NO: 3129 - DNA, 359 bp, Homo sapiens
  misc_feature (1)...(359): n = g, a, c or t
cgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaaagaaatccatatcttaaagnaaacagcttttcaagtgcctttntgcagt

SEQ ID NO: 3130 - DNA, 238 bp, Homo sapiens
  misc_feature (1)...(238): n = g, a, c or t
ttttgtatgtgngnatgtatgtgtaaatagcaatanaagaaagattnaaaagtttgctaagttttttctttttaagccctttaagtaatgatataactagaaactacgtttcatctcanaggaaaaaccacaggtgatatattctcatgcttcagggtaaaaacctctcttaaaaggctatgtttgngaaagccttcctaaaantatgcttntgttgntactatcaatttgatattca

SEQ ID NO: 3131 - DNA, 374 bp, Homo sapiens
  misc_feature (1)...(374): n = g, a, c or t
ctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaactaatttagaggtgatcccaaacctagaaatntaatnatatatctagattcttctctcacctcttctacttctactctttctactttggaaagattttcaaagcacaacacctgtcacagaacggatgtaagttanttttcatagaaggagnccctctntttcatagaggaattngtgtanntnccc

SEQ ID NO: 3132 - DNA, 335 bp, Homo sapiens
ctgctatctagaagaaaaccaaggtcccttaatatagtctaaatataatgtgtggcttattatagagaaatctttagcaacgtaagtttaaccagtaagtgtcacaactgatcaacagtacttaaaaggaaacaaacaaaaatcacactagccacaaatttccaccatatacacatgaaattaattttaatctgttttgactccttgacactaactgatcattaatgaaatatgatatggaaagatcacagagtagaaaacaagcaaagattagtttatacaacagtgactatatacatcagagggaaaacatgctagctaatgcaacattaagg

SEQ ID NO: 3133 - DNA, 414 bp, Homo sapiens
  misc_feature (1)...(414): n = g, a, c or t
ctttcccagaattagttgtntagggttggcccaagagatgtaagaaaaatctcgcattgctccctaagcaccctgggccttattaaagagcaacttctatttccagtcgggggagtaacactaaagctacaagaaatatgtaataatgataggtaataatgtgntccaaagctttttcaaactagaataaggaggcaaatngaagaatgaganactgatgtccacagttcattggcagaatctaaccccttctgttatcttttntaatactattngnngcttacatagaagtttcacangaagatanaaatgcttgaanagnctgagagtaaaaaagattntgctgcnaaangctntgatataaactgcctcttncannccacagggatacctgnttaaagaantttcttattt

SEQ ID NO: 3134 - DNA, 181 bp, Homo sapiens
ccaatccgttttttaattcttaaattcttgacattacagaactaaactgaaatttattaacattccactcttacacttcttatcgacaaacagaaataaaattcatgagccaaaaaacccaaaacaaaactaaaaacagggaaaagcttataaaactaaatatggatcccagcattaacag

SEQ ID NO: 3135 - DNA, 341 bp, Homo sapiens
  misc_feature (1)...(341): n = g, a, c or t
aaaaatccatgttcaacccaaacccactccccaaccctaactataggagatgaccctttaggaagctgaaaaggtttttataaagtcacaaaatgcatctcaatgcaagtttatataatatcaaaattatctcactgattttaatgtgtaagttatataatttatttcacccaccttgtattattctagaaaataagtcagnttttatatttaacaaatatgtgcaaaaatcataaacatagcttatagaaatatcaacngatatctaattacaaagtttcccgatctacttcgcttaaaaggcccaagtccccttttttctttttatttataacctntat

SEQ ID NO: 3136 - DNA, 284 bp, Homo sapiens
  misc_feature (1)...(284): n = g, a, c or t
aaaccaatccaatatacagacctttgaaagtaaaagatcaactgcacagatattttttaactaaagaatgtgtcagtaaatctatgtaaatatccaaattgacacaaattttctaaagagttaaaattattaaattncaaattattattttatatacttttgatcaaaanataatatttgcttcaccataagtttgaagatattaagaaaacataatctaaggtttattacaaaaaataatggccnctgatagatatacagagaataatntattnttaaatttt

SEQ ID NO: 3137 - DNA, 268 bp, Homo sapiens
aaatatattccagaagagcgtttataattcatttacaagtgcagtattgcgctagtaaatgttacttgacctcttgtataaataatgccgattaagaattagtcctggaatagttttcgaatttctaactctgtagatctaaaacacaattgtaaatggtataaagatgtaagaatcatattgtgataaagccaatctcaaaaatagagaatccagacccttcccagataatttaagaactgagttttcctcaacttaaacatgatgg

SEQ ID NO: 3138 - DNA, 365 bp, Homo sapiens
  misc_feature (1)...(365): n = g, a, c or t
gtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtntaaaagatgggcgnct

SEQ ID NO: 3139 - DNA, 385 bp, Homo sapiens
aaaacattgttttctaaacactaacaaaaaaaattaagggcaaactgaaaatacaaatgagatttacaggcactgtgtgtagaatgtgtaaaaattcacttagcttttcttttgtttttttggtgttgctttaagaaactttatcaaatatatttcttacaaatataaagctttctctcccaattgaaggcaattaaaaaaattcaaagtttatcaatactcagtacacaggtgaaccagtcaaattcattttctttctggaaaagaataacaaaccaatatttaggatgttcagagactcaacaaaaaccattctagaaatcacccagaacaattgttttctgttgccaaagccttttgttcttcaaaagtcaccatccaccag

SEQ ID NO: 3140 - DNA, 385 bp, Homo sapiens
  misc_feature (1)...(385): n = g, a, c or t
ntntcgaggtaaatggaaagttactattataaggttaatttgcagncctcttctaaatagaaaaccatatccttggctactaacatctggagactgtgagctccttcccattccccttcctggtactgtggagtcagattggcatgaaaccactaacttcattctagaatcattgtagccataagntgcgtgctttttattaatcatgccaaacatantgtaactgggcagagaatggttctaaccaaggtacctatgaaaagcgctagctatcatgtgtagtagatgcatcattnnggctcttcttacatttgtaaaaatgtcanattangccatcnttaantcatattagtgacnccggaacagcacctnccctatntgtatg

SEQ ID NO: 3141 - DNA, 176 bp, Homo sapiens
  misc_feature (1)...(176): n = g, a, c or t
gcctctgtctccgagctcgcctgcatctactcggcccccattctgcacgacgatgaggtgacagtcacggaggataagatcaatgccctcattaaagcagccggtgtaaatgttgagcctttttggcctggcttgtttgcaaaggccctggccaacgtcaacattgggagnntcnt

SEQ ID NO: 3142 - DNA, 242 bp, Homo sapiens
  misc_feature (1)...(242): n = g, a, c or t
cctgccagtctctggacggctacggcgtagggtggcaggcacaatctccgggggcagatgaaggtaatcacggagatactggataccctcattggtaaggtaccagtanaaatgtctccaggcaaactgttccttcacgtagcctcgggacttgagagactgcatggccttcacgacatgaaggttgggcacattcttgtctgccagctccgggtgcttangcatgtggacatccttcttgg

SEQ ID NO: 3143 - DNA, 200 bp, Homo sapiens
  misc_feature (1)...(200): n = g, a, c or t
ctggtgttcagcctctcaacagcaaaccatgagactacataactatcaggttttcacttcactttcttctcttctgtctaaataatcacaatgcctttaggcttataaaaagcatctaatcattacagtgtcttatcctttttaatgntctntccttttataaaactgtggcaaganctgaatgtttaggaaaggtancc

SEQ ID NO: 3144 - DNA, 364 bp, Homo sapiens
  misc_feature (1)...(364): n = g, a, c or t
gatttacatgtgcatatacaatttataaagttaaaaattctctgtacaaaatcttacatgtacagagtntatataagccccattcttatggctgnatcaccacacagatttgcttaaaactataatactacaaacactcgggttcttcatattcaatcttggcacccatatagcaatacactattctgaaatgtaaattacaaaggaaataaaatgtaatcatgcagacattttttaatataagaaaatgcgataaaatatactacaccagatcaacatttatcaattccatagatactgagttttcaacttactgcactgttttcatataagtacatgcaaaactagcagantatggattttt

SEQ ID NO: 3145 - DNA, 374 bp, Homo sapiens
  misc_feature (1)...(374): n = g, a, c or t
aaagtttatttcctttgtggatacaacattatttttacaaaaatgcaaattgggaggaaaaactaaggctagagaatatatcttctacttcttggcaaagcatgtttactattggtcaatgttattatttgactctatattgccaaagggataatcggggagaaggtcataggaattttcatccttctttaatagcagacattaaagatgtctcctattataaggagttatgtgaggtcagctaaaactaattatttgaggtcatacaaatgactcaaaattcttagagaaaccatgggtttggagaggaatcctcatatatatttcannaagaggagaaaaaataagatagaaataagatcttgtattttttt

SEQ ID NO: 3146 - DNA, 414 bp, Homo sapiens
ctgttttattgctaaactatcatgatacaagccgtataaaaatactttacatataggaaaaataaactacattaaactggagattaaaaacatttgcataggaatgtgatgtattcaaacgcctttaacagtcaggattttctaaacctaagcctgccagcaccaccatgttggagagacctgtttgttggagaattggttttctctcctctgagggctgtagaggccagaggggtgagtgaggttctttgacaagatgtccaggatgctaagcttgtcccaacagccatagcctcggtctgctcaggccaatcagaatgctgtgagcacctgctctaatggaaacaacatcatttgcatccattccattcaaagcttgaactcagcagggagtttattctggtcagccaacag

SEQ ID NO: 3147 - DNA, 396 bp, Homo sapiens
  misc_feature (1)...(396): n = g, a, c or t
ctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgntgtcctgatggcatatctatncctgaactgagagaagcatgtgactatctttgnatctcttttgaatatagcactattaaatgtagagatctcagtgccctaatgcatgagttatcaa

SEQ ID NO: 3148 - DNA, 425 bp, Homo sapiens
  misc_feature (1)...(425): n = g, a, c or t
ctgctgacagttctttggtggaaaagtaagttgcgtacttacccaagctgcccaaatgattatcaagccaagtttgtttttcaaaaataggntttaagatacaccaaagaaactatacaatacaaaaatttaacaatgaagttaaagtatatagncanaagccnaatangacaacacacatgtataatgtagaaaagaatcctttcaggtcctagaaaactaaaatggggagaacttactgaagggtaacatacataaaatgagtactaatagcaaggaataatcctaaacattttcccaataaactgactaancctcaaaaggacagcttaggaaaatgattaacatgcagtttttcttttttcctagccaattcagttctaccntagataaatctgggttgccaagcaatacatntataaatt

SEQ ID NO: 3149 - DNA, 381 bp, Homo sapiens
  misc_feature (1)...(381): n = g, a, c or t
ctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttntgatatagaaaaaggctttccttggtatcncgntatcatgtgtcgtcatctatgcattatagtngatgggntttgtactacnngtcaccagcatanaatcatattacaagtncgtaangattcaggggctcttganagactttatcatagcctntnt

SEQ ID NO: 3150 - DNA, 328 bp, Homo sapiens; identical to SEQ ID NO: 2874

SEQ ID NO: 3151 - DNA, 228 bp, Homo sapiens
ctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatattt

SEQ ID NO: 3152 - DNA, 303 bp, Homo sapiens
  misc_feature (1)...(303): n = g, a, c or t
aaaaacaggacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgntttttattctatttacaggatgattttt

SEQ ID NO: 3153 - DNA, 236 bp, Homo sapiens
aaaaaagatgaaaaagaaaaaaaaactttgtaaaatgcgagaacagaagcaaaagacactacgctctgtcattttatctttcttttgttgaaagactaaaaaaaaactgaaatgctttttagacaatcaaatgttaggtaagtgcaaaaacttgttttttcttactggtgtagaaattaatgcctttttttatttttcagttattttataataacgaaataaaaagaaccccccag

SEQ ID NO: 3154 - DNA, 343 bp, Homo sapiens
  misc_feature (1)...(343): n = g, a, c or t
ccacttgtgtgggtcctcacaagcaaagagagcactaaacttgacattgggagtccaccactccaactttgctttctgaaggttttggtgtacattgagccccanaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccag

SEQ ID NO: 3155 - DNA, 355 bp, Homo sapiens
aaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctatttt

SEQ ID NO: 3156 - DNA, 269 bp, Homo sapiens
  misc_feature (1)...(269): n = g, a, c or t
nncgaggnaaaagatcattctgttctttcaaggagaaataagcctaaaagaagaaaaacaaaaaaaattctgtataaaactgtaatcctttgtattcatgtttacagtgctattactataattcaaaattatgtatgtgacttanagttatataatcataatttatgtttatttcaaatatctaagtttattgcttggatttctagtgagagctgttgaatttggtgatgtcaaatgttctagggntttnttagttngtttttattgaa

SEQ ID NO: 3157 - DNA, 430 bp, Homo sapiens
  misc_feature (1)...(430): n = g, a, c or t
ccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtctataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgctnattcattatagctattcgtcctgtaatctgtttctaggtgaaggcatactccagtgttttaggggttttgaaaataaatatttacctcngccgct

SEQ ID NO: 3158 - DNA, 228 bp, Homo sapiens
gttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttcccaatgaagagcaaattt

SEQ ID NO: 3159 - DNA, 515 bp, Homo sapiens
  misc_feature (1)...(515): n = g, a, c or t
aaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagttnngtttttcactgtacattcctcattttacattcatttaacctgccgattatttaatntttttattgtaaagtagnttttagcatttgctcttatttttntactttgatgcctttncaattgncatgtctttacctgccccgggcggcccgctccaaanggccg

SEQ ID NO: 3160 - DNA, 486 bp, Homo sapiens
  misc_feature (1)...(486): n = g, a, c or t
aaagaaggtagataaatttattgccacttgaaaactaaatataactcagatgagtcagacaaaaaaaatcattgacattaaaattattattatttgaccaggtttgtcttttgaagatttctctcacaggcacttctgcaacaaatttgtataatttaatataaatattttgtgattattcttaaaggccaagcaatgggcatttatgatggctaatcataaatacacaataatatatattacatagtatatattaattgacaggttgcattttttctttgagcttatacacttttggaaaaagtctaccttttataaatatcaagntggatattcttgtctgntgcatttgctaaataagagncaatagntaagaatctgtttcttttntatatgtccggattgttccatttggaatacagaatcccctgnataaaactagcatgntttgntgaagnccttgtgaacttgactctaaaatatttt

SEQ ID NO: 3161 - DNA, 413 bp, Homo sapiens
aaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttctttcagtccgtatataacttttctataacttgtgatggacaagagatatgcttatccaataaaataagcttaaatattagatgctcttgggtcaaaatgtcctttaccaaattgacctttttatgagttctttgggtaaatacttttac

SEQ ID NO: 3162 - DNA, 201 bp, Homo sapiens
  misc_feature (1)...(201): n = g, a, c or t
gatggcacaacatacttgaagaccatagaagtttttgatcctgatgccaatacatggaggttatatggngggatgaattaccgtcggctagggggtggcgtaggagttattaaaatgacacattgtgaatcccatatttggngaacacanagaacacaggncttgtatntattcctctgnnttctggggagctttgacctt

SEQ ID NO: 3163 - DNA, 379 bp, Homo sapiens
  misc_feature (1)...(379): n = g, a, c or t
gtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcatactcatttaagtaanangctagagngagtaaggaatagagccaaatgangnaggtgtctgagccatgaagtataaatactganagatgtcacttttattcaggaaatatggggagattcaagtnatatanattcctactcgaaaancttgacacctgactttccangatgcacattttcatacgtagaccagnttcctctttggtttct

SEQ ID NO: 3164 - DNA, 266 bp, Homo sapiens
ctcaaattaccctccaaaagcaagtagccaaagccgttgccaaaccccacccataaatcaatgggccctttatttatgacgactttatttattctaatatgattttatagtatttatatatatctgggtcgtctgcttcccttgtatttttcttcctttttttgtaatattgaaaacgacgatataattattataagtagactataatatatttagtaatatatattattaccttaaaagtctatttttgtgttttgggcattttt

SEQ ID NO: 3165 - DNA, 446 bp, Homo sapiens
  misc_feature (1)...(446): n = g, a, c or t
aaatcagcatttcccaaaaggtgtgtcaggactgagttaatcagtaagctaatagaaacaactgcaatagactagggatgagatttctcaaagcagtctgatataatatgcggcaactccttatgtactggagcgtatccaatacattctcaaaactcctaaattagctaaaatgcaaggtaaagagcagtagaaaaatgcagctcttaggataggcaaaactttggaagatttatgtcctcacaccagggtccagcaacttaggtttgaatttatgatnaggttaatgatataataaacttgggttggctggtttccctggcaattgttaattccccttaaataaaaatatgttgatacattgcaaaagaagtattttacagtttgaaacctttggaaagggcttttacctgcccnnggcngccgtaagggcgaattccanccca

SEQ ID NO: 3166 - DNA, 387 bp, Homo sapiens
  misc_feature (1)...(387): n = g, a, c or t
ctggntctantcaatngngaaccaccaccccccgccccccgcaaaaagtaaaagtcaaaccaaacttcctcaagctgcatgcttttcacaaaatccagaaagcatttaagaattgaactatgggctggaagaagtgaaagggaagcatctaaaaangaaaggtgagtaaccanatagcaaaagaaaagggaaagccatccaaatttgaaagctgntgatagaaattgagatncttgctgtcttttgtgcctctacaagctactactcattccagaattcctgggtcttccaagaggatncttaangtaccagagatttgctatggaaccaaaagcgcttgagaattctgactgaggggcttcgcntagntntcacattacaaaaaan

SEQ ID NO: 3167 - DNA, 478 bp, Homo sapiens
  misc_feature (1)...(478): n = g, a, c or t
ctgagttacaaggactaaaagtgaaaagcattctaaaagtccatgaacactgttgttnananccttcttcagaacacactaaacttgtctgacacatttctcttcatacatagcaagcaacagcacccaataaaagcctgagaagaaatgctgctgtgtaaatactgcaactattcctgaaaaaagaattatgggatatatactccaaagctgcccattcccataatttgtattgcataggtcacataatcacacacatatatatacacatgtgtgtatatatatgcacatgcaagaatatattaagacgacaatgaagtctagtcacagagcaatttacaggctcaatatatttttttanactttggttganagaaaatttaatattttacagtctttcagtaggcattatatacactgcnctttatgaaatctaaaaggtattgaaataaatttttccacattttggtancaaaac

SEQ ID NO: 3168 - DNA, 198 bp, Homo sapiens
  misc_feature (1)...(198): n = g, a, c or t
ttttcatatcaatgaaaaattccataaaaatagctatattaaatttcatatgtaaatatttaacaaatatgtttgtattcttctatttttatacaatgaatattaatacatattgcatttatttattttaatgacatttatttaagttcaattgtacaaaacctaatttgttgncaaaagtatcaagcaataaatttt

SEQ ID NO: 3169 - DNA, 327 bp, Homo sapiens
aaaaatgtttttgaaaattgcaattcctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccgggtttttttt

SEQ ID NO: 3170 - DNA, 439 bp, Homo sapiens
  misc_feature (1)...(439): n = g, a, c or t
gttagtattgactttgnttnaaanaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacangtgncaatatttttctgtatttt

SEQ ID NO: 3171 - DNA, 279 bp, Homo sapiens
  misc_feature (1)...(279): n = g, a, c or t
agccattacaggtttgaacaaattcaaaattgcctattattaagcctccgcaggagctactgggcataagcaaacctaagattttataacccagcaattatcctatagaaaatagtccagattattatattctgccacacctttattcatacttgactccaaaaagttctcaattattcacagggataatctagaaaataaatattagttttgctttcaaagacattactggaatgagcaggaacctgcatctttgntatattaattaacttattattt

SEQ ID NO: 3172 - DNA, 302 bp, Homo sapiens
  misc_feature (1)...(302): n = g, a, c or t
ctgttgaaatgaagcactttncagtctttgtggcagcagaatatacttgtccatggttcatatcaatgctaaaattccggcagggaaaaaaatgatatgttaagcacccaaatcttcacatggagggggagggggtgggaaaagaaggaaaaaaagggaaaaacaaccaaaataatttaagtaaatgacagattggaaaacagggtttataaaaattattctcttgagtttataaattgttaaactcaatttatagctatgttaaactacgtaagaaccactatactgaaagaccatttaag

SEQ ID NO: 3173 - DNA, 300 bp, Homo sapiens
  misc_feature (1)...(300): n = g, a, c or t
aaataaattacaccttttgaaaatgtttaattgtacagtcaatagcttcaacaaaatattgaagtgtctgtatttagtatctactttatatactttatactttacaaattttacaattatttggcagnaattttctgattatgacatgactgctgtgcgattcagcgatttcccagatgcaggcaatanctggtgtttgtgtnctattctcagagtaactgnctcaatgtaggtgaaaaatatcancnattttagtnaactgtncaaggnccattnacacttnatcaacactatagcata

SEQ ID NO: 3174 - DNA, 519 bp, Homo sapiens
  misc_feature (1)...(519): n = g, a, c or t
ctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgttcagaaggtttttcanactgagagcctaagcatactggatctggntg

SEQ ID NO: 3175 - DNA, 499 bp, Homo sapiens
  misc_feature (1)...(499): n = g, a, c or t
ctggtggcttcctgattnccgcccacagaaggtatgttcacactgagagagctctcccgccaaggggaggaatcacctgctttaatacatgttgttctcttctgtgctagtgtggncatccactctgtataaacttatgtgcaacattaanacaaaaaaagggagttgagttgataanatgacttgggaggctctcatagttgnaataactatggaagacagaagaacatgctatcatctttatttttagcactcatatctggacctattactaaaaaagcttcttcattccttccaaccactagattataatggctaaaaagtcttttccttaaatctgatgggtgtaaaaataaaaagtaacagcatttctctagggctctggtttattttgnnttgntcttccttttatagacacgacaaaaacaaggattaactttccaaatactcatggtgcacaagaaggntatgtatgcncagtatnctaatttattcaaan

SEQ ID NO: 3176 - DNA, 451 bp, Homo sapiens
aaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgtagctgattttgtatgtaaagattaatttccataataaaaattattgtatgtttactgtgatcttaatgggcagggttaagaaagttattt

SEQ ID NO: 3177 - DNA, 303 bp, Homo sapiens
aaaaatacaaattttatgaaaatattaagaatttttaggatgggaattataaaagtcaatgctgaacaaaattctacttttagatagtatgtatcttaaaatattatgaaaaatattctttattctgaaaacaatgtcaggaaagaatacctgagttctctaaaaccactagttctaatttcaaattgctgttttggtaacataaagaaaacacatttacaatttaacactgcagttacctgtcaaataattagaatagaataaatgttgcatatacattaggttgaaaattatatatatttt

SEQ ID NO: 3178 - DNA, 343 bp, Homo sapiens
  misc_feature (1)...(343): n = g, a, c or t
aggnaaaactcattaataagatnccaaattcaagagattatagttacattgtaaaacgtaatcttcttttaataaaagctaataatgactgatgaattacaaatgcacttatttattggngattacaaacaatacttaagaacttangcagcttgagtagtagntnaagctngacagagcanagaaaattcttgtttaatatatatatatttttaattccagtaatattttcttaaattcctgttaaaaatataatcaatattaaagtcagcaaaatgcctttgactgacgcctggattattttaccacttaacctggttacacagtgatttttttttttttn

SEQ ID NO: 3179 - DNA, 417 bp, Homo sapiens
aaatatattgcattttattacgtaacagtaaaattagtaaaataattgatatactttaatttataatttctttctctcagtataatgtagaaaagtattactctgaacacctaccttaaacattacttaatataggttaactacaatgagcctctccacttatatttttgtcatgcatcttacattttaatgtccttactgttttatagaaaaggtcataaagaatgcccaactaataaagagtctctaatatctctgatgcagcaacaattgatcacatactttcacgtgaatataataaagtaacagcataatttgaaagctgtattacatcattattcacttttcaaaaaaattgttttcaaggaaacaaatatactttcaatgtaattacaaagcttcaaaaaatctcctttt

SEQ ID NO: 3180 - DNA, 304 bp, Homo sapiens
  misc_feature (1)...(304): n = g, a, c or t
agatgctcccttgcttttnataattcctaactgtaaaatataattttagtacagaacaaacaaattctccttggttggtcacatcattcattattgaaagggaaacttagtatcaaaagaaacaaaacactgaaataaataactaagtaatttactgaaaggtagttttgttgcattgcacacanctgaccgcagagaattctaaagctgatttttttcttaaaggatgaaaaactcatttgccatttttagnttcttgctaagngatacatgctcctnataaggaaaactactctgtgtatng

SEQ ID NO: 3181 - DNA, 347 bp, Homo sapiens
  misc_feature (1)...(347): n = g, a, c or t
aaaatacataaaattttctaaaacgtaaaatggaaaggtttaatacacaggaaaaacactgcacaccttaactaaacaaactagaaagaaaatatatttatatacagaactaagatgagtccattcattatttttacaaatattcacatagatggtttagagataagtagntaagcgngnctnattaattaatggatgctttctagcctctgtcttcattaattttatttcctattcaacaaaaaataatgctttcaggatatattacatntagagcaatntcatttttatcagtaatnttgcctgaaaaagagaaaaactttnnagcataaccctacnnagcanga

SEQ ID NO: 3182 - DNA, 279 bp, Homo sapiens
  misc_feature (1)...(279): n = g, a, c or t
aaattttagagtcacattttattctgatcagaatttttattgagatgttgagcttttgtttttgaaactagtttgtcataacattgtgcataatcacagtatttattttctaggacaattgngaatgtgtagacttatgtttactgctaagggaacaattatttataaaataatattaaatccagtattaggctgcctatttcagacacttaatacttgcngagatctatgttacatttaccacactgaagttntttttgttgttttttgtttgttttt

SEQ ID NO: 3183 - DNA, 367 bp, Homo sapiens
aaagctatttaatactcatgatgtctaaactttcaatttattgtctgatttctggatatttctgtattttagattctacagacttcagattctgaagcttgttgaaaaagctaagttcctcaatatggatgaaaatctatctggctgtacttttagaggggaatttttctacttttgaaaaaaattctgaatatttatatatagtattaacagaataccccagtaagtcatatttcagataaatattctatagtataatttgcatcatacccaatattttagatattaaaataagggtaaaatttggaatataatcacttgtctgcatatttcccaatgtaagttttcatgtagaatattaaaattt

SEQ ID NO: 3184 - DNA, 149 bp, Homo sapiens
  misc_feature (1)...(149): n = g, a, c or t
aaacttgaactattccttccagaagaatacccaatggcagcccctaaagtacgtttcatgaccaaaatttatcatcctaatgtagacaagttgggaagaatatgtttagatattttgaaagataagtggtccccagcactgtcgatccn

SEQ ID NO: 3185 - DNA, 197 bp, Homo sapiens
  misc_feature (1)...(197): n = g, a, c or t
aaagaaaatccagtagttgttggtgaaaagatccaaaagatttgaactcctgctggaatacaaaattcttgagcatctgcaaactaaaaattgacttgaggtttttttttttcctagtcnttgggaatgtanagcagggtatnttgcntgtcatcggaanaatanatttttgtttnggttttgttttgaaaatgact

SEQ ID NO: 3186 - DNA, 421 bp, Homo sapiens
  misc_feature (1)...(421): n = g, a, c or t
ctggaagagagggctgcccgnaacgactctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttnaagcagatctgagcagcttcaagtcccaggaattgaacgagaggaacgaagcttcagatttgctggaaagactccgggaggaggtgacaaagctaaggatggagttgcaggtgtncagctggctttgtgtgcaacacgtgccctgaaaagtggatcaatttccaacggaagtgctactactttggcaggggcaccaagcagtgggtccacgcccggtatacctgtgacgacatggaa

SEQ ID NO: 3187 - DNA, 349 bp, Homo sapiens
  misc_feature (1)...(349): n = g, a, c or t
ccaagttatcatgtccatncgcaccaagctgcagaacaaggagcatgtgattgaggccctgcgcagggccaanttcaagtttcctggccgccagaaggtatgtagtgctgcagcccccttctcccacctttgccccaggctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccgcttcggtgacatttcctgg

SEQ ID NO: 3188 - DNA, 434 bp, Homo sapiens
  misc_feature (1)...(434): n = g, a, c or t
gaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggnaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgntaattggtattcattcacaatgcagttgaagggggaangntccactgcattctttggctaaggacctcg

SEQ ID NO: 3189 - DNA, 367 bp, Homo sapiens
  misc_feature (1)...(367): n = g, a, c or t
ctggtggttaacaagtggatcgtcatgttcagtagtttatacattatgtgagaagtaacgttctgattctttttcttacacagaattggcagagggggtcgatttgggaggaaaggtgtggctataaactttgttactgaanaggacaagaggattcttcgtgacattgagactttctacaatactacagtggangagatgcccatgaatgtggctgaccttatttaattcctgggatgagagttttggatgcagtgctcgctgttgctgaatangcgancacaacgtgcattgtgcttctttctttgggaatatttgaatcttgnctcaatgctcataacngatcanaaatacagattttgatagc

SEQ ID NO: 3190 - DNA, 231 bp, Homo sapiens
ccaggcagccctgctcacaggcaaggtgtaggggggtatttcctcgaaagtctcggagctcaggatcacagccagctcccagaagtgcctcagcaatttctggctggttggtgatcacagccaagtggagtggagtctgctgcaggttgttctggaagttgaggaaagccaggtctcccttcacctggcggatcacttccatggtcagtgccttttcttcatggatgatgg

SEQ ID NO: 3191 - DNA, 409 bp, Homo sapiens
  misc_feature (1)...(409): n = g, a, c or t
aaaacaaatttctaggacttacgctctttgggcctgatttgttaatgcttatgaggtaatgatattatgtttgagaagctctacttctagtatacctcaatgctcagagagaaagccaacaatacaatcaggaaaccacaatattgacaaaacttagtactaccaccaagattgntcctcttgccttggcactactaaaaaactttacctttgttactaaagtcatggtgaatacagattttgcatttctcatgtaagcagctatataagctagggttctacaagccttagatgaaaggaaaaactttgctggaagccctgtaaaaatcactttattcacaatctgaagaatgaaagacaaatttggctgtcaatacaaaaactgtagtacaaggaagttcaactgttt

SEQ ID NO: 3192 - DNA, 374 bp, Homo sapiens
ctgaagcggcggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattgacaagggggagcctcggccctgaacagagcag

SEQ ID NO: 3193 - DNA, 208 bp, Homo sapiens
  misc_feature (1)...(208): n = g, a, c or t
atatataatagctgtaactgtttcactgctatgctgttttgtgttgttatagttgtaacatatttctcaattttcctgtttttcttttagtttattgacaagactacctggtcggcctaaattcacattttcattcagtttttgggcatttgagatcaaanagtaagtatggnttctacagttacttcatttttctacttatcttttt

SEQ ID NO: 3194 - DNA, 290 bp, Homo sapiens
  misc_feature (1)...(290): n = g, a, c or t
ncgaggtaaaccaatccaatatacagnnntttgaaagtaaaagatcaactgcacagatattttttaactaaagaatgtgtcagtaaatctatgtaaatatccaaattgacacaaattttctaaagagttaaaattattaaatttcaaattattattntatatacttttgatcaaaatataatatttgcttcaccataagttgaagatattaagaaaacataatctaaggtttattacaaaaaataatggcctctgatagatatacagagaataatatattcttaaatttt

SEQ ID NO: 3195 - DNA, 253 bp, Homo sapiens
  misc_feature (1)...(253): n = g, a, c or t
ccactcagcacatttcatggangtcatgtcttttcactgatacttttttgatagtttttatataacaaaatccttattctatttataacttaagatgataaggcactataaattaatgacctaaaataatntatttgnctgntatctttgtgctatttctacttcactttaatttttaggctgtaaaattggtaaatggattcttacaactatctctttccatttcttactatttggttttcaaatttcattt

SEQ ID NO: 3196 - DNA, 371 bp, Homo sapiens
  misc_feature (1)...(371): n = g, a, c or t
ctggtggttaacaagtggatcgtcatgttcagtagtttatacattatgtgagaagtaacgttctgattctttttcttacacagaattggcagagggggtcgattngggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatntgaatcttgtntcaatgctcataacggatcaganatacanattttgatagcanag

SEQ ID NO: 3197 - DNA, 326 bp, Homo sapiens
  misc_feature (1)...(326): n = g, a, c or t
ctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgtnactctgttttcttccaatcattagcggntgtggaacaggaaatgaaaaaggactggctttttgcccctcattatcgatactatgtaagagaaatgagaattcatgcatacagtcag

SEQ ID NO: 3198 - DNA, 516 bp, Homo sapiens
  misc_feature (1)...(516): n = g, a, c or t
cctttcagtggggcttggacaaaaagggccccaaagaccaattttgctcattaacctcacactggggatcagattgacaacttaaggatttttagggagcatatgtgagatcaaagggaagaagaaaatggtgcccctttcagatggtgcttcaggtgctaaaaaatatcccaacacaaacaagcaggtggctagctgacaggtgggggaagagatgcaagtcagatagcaaaggatctgcacagtgcaaaatcttcttggctttttatttaacttagcagtgaatgcagcaggattggcttaaagtataggtacaccccatggaaacatgcaataagatcacatcgatccagaggctggctcaagtttgactgaggggaaacggagggaaggctgttcctatcacacaatctcagcagaggttgaggtggtggggatttctttcttctnatatgacgctaccatcggtgacttcttactnggagaccactgancactgaatcaangtttctaata

SEQ ID NO: 3199 - DNA, 186 bp, Homo sapiens
  misc_feature (1)...(186): n = g, a, c or t
aaatcacatgtttacacaaacacttggacaaaaatggttttagcagctttatttgtaataaccccaaactggtaaaaaactaaatgtccatcagcagaggtatggattagaaaattgtgatgtattcatataatggaatattattcaacaataaaaaataacacatctgatnaaaaaaaaaanaaa

SEQ ID NO: 3200 - DNA, 275 bp, Homo sapiens
aaattaaaaaggtaaagaagaaaaagaaaaagaaacacaaggagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaagg

SEQ ID NO: 3201 - DNA, 385 bp, Homo sapiens
  misc_feature (1)...(385): n = g, a, c or t
aaactttaggttttatttacaaatatttatcttatcttcctctcctatttgacgttttagctcaagaagagttaaaatggaatgcatctgtagatatatagttgggaatgcgtgttcagtcacttggctctgtgataataatcttatgtaccatgtcagacangattttcagactccagatcctctttgccattatctgaatttcctgatgagatatagcaaccagagtcccttgggcagtcatctaactgtgacttatttaaggagatgtctgagctcaaggataggggctcaggttcattttcttgctcttgaataatttcttcttcaaggaagttttcagcagacctgcccgggcggacggtggaagggggaattncaacac

SEQ ID NO: 3202 - DNA, 302 bp, Homo sapiens
  misc_feature (1)...(302): n = g, a, c or t
aaaaatatatatttcagattttcagtgctaacagattgcatatatacagttcatttacttttattaaattggcaatcgatattttattgaatggggaattaagaatataaactgtaaattttgtcttaaatttattntttttcttggcctttatttttattacttaaggnatgagnnatattttaggagatactttctagacagttngaagnttgggtgctatatgaagaaaaacattnaatgatatactcanatataaacaccttgttttcttgaatgnaatttatttattagctaanaaa

SEQ ID NO: 3203 - DNA, 510 bp, Homo sapiens
ccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatattt

SEQ ID NO: 3204 - DNA, 449 bp, Homo sapiens
  misc_feature (1)...(449): n = g, a, c or t
ggnaaatcttaagatttgnagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaccattatgggaatgggcagcctt

SEQ ID NO: 3205 - DNA, 382 bp, Homo sapiens
  misc_feature (1)...(382): n = g, a, c or t
gccatctttcatgcctttgtcaatatgaacttctaaaattttcttctctcgaactatcttccttccgttgcagcttttacatctatctttaggactgatccgctccccatggccctggcactccatgcacacagactgaatttgctgaaccattccaggtcctatctgatgaattcttatttgcattccagtacctcggcaattgggacagcactctactgctcctttcttacctcctctaccttcacatttgtcacaaatcacattcttttgcagagccagttntcttgttgcaccattatataagtcttctagggttactgagagctgatgtacaacattttnacctntcctttctctctgcatccttcctcctcctgca

SEQ ID NO: 3206 - DNA, 316 bp, Homo sapiens
aaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataaggttatcctgttccctaggaccttctctgtaaatagtgatttttagacgagtagtctgtcctaaatcttaaatagaaaaaaaactaaagcgatttgcttaagccattgtacattataaagagctgttttgttttgctttgctttgctttgttttgttttttt

SEQ ID NO: 3207 - DNA, 287 bp, Homo sapiens
ccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaatttt

SEQ ID NO: 3208 - DNA, 345 bp, Homo sapiens
  misc_feature (1)...(345): n = g, a, c or t
aaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagcttcanaaaatagtctatatgcatatggaaagggattcctaccccagatttctaaagtcagaaatgtaccaaaaacttttgaaaactatgcaggtccaacaacaggtttctgactacaactcaaaagttt

SEQ ID NO: 3209 - DNA, 427 bp, Homo sapiens
  misc_feature (1)...(427): n = g, a, c or t
ctgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaatttctgcatagcatcagcaatgangtctgtacaactgtcttactgcctaattcataagataccatatggacaatgcacgattgcatgtcgtggcaaaaacatggaagtgagacttatttttctctctggactgtgcatagcagtagctgttgtttgggctgtgtttcgaaatgaagacaggtggggcttggattttacaggatatcttggggattgctttctgtctgantttaattaaaacactgaagttgcccaacttcaagtcatgtgtgatacttctang

SEQ ID NO: 3210 - DNA, 491 bp, Homo sapiens
  misc_feature (1)...(491): n = g, a, c or t
aaatggtattacgtataaattaatataaaatgatcacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcattnaaagctatttt

SEQ ID NO: 3211 - DNA, 409 bp, Homo sapiens
  misc_feature (1)...(409): n = g, a, c or t
naaatcagcatttcccaaaaggtgtgtcaggactgagttaatcagtaagctaatagaaacaactgcaatagactagggatgagatttctcaaagcagtctgatataatatgcggcaactccttatgtactggagcgtatccaatacattctcaaaactcctaaattagctaaaatgcaaggtaaagagcagtagaaaaatgcagctcttaggataggcaaaactttggaagatttatgtcctcacaccagggtccagcaacttaggtttgaatttatgataaggttaatgatataataaacttgggttggctggtttccctggcaattgttaattccccttaaataaaaatatgttgatacattgtaaaaagaagtattttacagttgaaacctttggaaagggctttt

SEQ ID NO: 3212 - DNA, 314 bp, Homo sapiens
aaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtcctttt

SEQ ID NO: 3213 - DNA, 285 bp, Homo sapiens
ctgggatgattactgattcctccattcctttggggtaactctgccaacaggggacaggttccattctattccgacttgtgttgctacatatgtccatgtaacaatacagaaagtggctccactggctaatacagcattaccgtatttgtcatgaaaatcgggtgtacgtttctggtggctctgccttgccattgtttgctgaatgcttcgaacttggagacgatttagtgcgcttttgaccaagggaaacatcgtgaaggtgaagctagaactgcggcaatacag

SEQ ID NO: 3214 - DNA, 420 bp, Homo sapiens
  misc_feature (1)...(420): n = g, a, c or t
taccanntcngtaccaagcttgggataanaatggacntagntgatnactgtgacttctgtttgatgaagagtatcacttcattccatttttgtgtttttgttgcatctccaagtcagaatacaaaaaaaatcatgacgaaaagacacttgcttattaattggcttggaaagtagaatatangagaaacgttactgtttattttttttcatgtattcattcattctacaaatatattcgggtgccagtaggtacttggtataaggtttttggccccagagacatgggaaaaaaatgcatgccttcccagagaatgcctaatactttccttttggcttgttttcttgttaggggcatggcttantccctaaataacattgtgtgggtttaattcctactccgtatctcttctactactctgg

SEQ ID NO: 3215 - DNA, 441 bp, Homo sapiens
  misc_feature (1)...(441): n = g, a, c or t
aaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggncggggcattacactgcctatgccaaggcaagaaccgcaaatagtcatctctctaatcttgttcttcacggtgatattccacanggattttgaaatggaatcaaaagggcagtggtttcacatcagcgacacacatgtgcaagctgggcctacaactaaagtactnanctcacaagcgtacctcctattttatgagagaatctgtaataatatcnaaagcacttttntctggaaacanatttatggcttttataanggntgaanta

SEQ ID NO: 3216 - DNA, 242 bp, Homo sapiens
  misc_feature (1)...(242): n = g, a, c or t
ccaaggctgtttgcatcccngggatccccgtctgctgaccagctaaacaccaatttcttcctgcttttctccacttggtttggaaaatcacacagttttcaggctccatctgtttggagaaaatacattctgaagcntccccaatttcaccttgtaaaaactcatgtgcagggnttggatataacaccacaacanaanacacttgatgctgtattatnttacatttattncatangatttgg

SEQ ID NO: 3217 - DNA, 501 bp, Homo sapiens
  misc_feature (1)...(501): n = g, a, c or t
ctggaactcaactaatcctaaacgaaaactcaagaacagcacaccagatgccacctgttgtttgtcagggtctcaaactccagaggaaatgcatttgcctgtcatggttttcctctctaagggcacctgtctgaacttggagctgtgtttccactggtgcctcatggggcctgggcctactctccacctgaattcacacttttctctataaggtatcaggtggggaataagtccaagaaggtgacaagaggctcccgagcaacagagcttgctcattcctggcaggcatctcccacaatgccccagagggctggcgaggccgggacagcataaggacaganaaagggcngaggggtgcttggaagtgctcatcactcangggagctggcaggcccgggatgacaggcagcctgaacagtgcttgnaacaaagacagccaccctgcggccccttgtcggagcanacctcngccgtnaccactgctaagggcgaatttcagca

SEQ ID NO: 3218 - DNA, 456 bp, Homo sapiens
  misc_feature (1)...(456): n = g, a, c or t
aaaaatctaaagaattcaaaaataaggcattcaatatttgaaaaaagtacagatttacaaaatgtgtatattctgtcatgaaaactccacaccaacattatacacttggaaaaaaatacaaacaggatatattacaaatttatgcagcagntaacttagttcacaccatgcaataaaaagtacattaatcaagatacacaagcttttgtaggttctaaactgaaggacttttttnttttttttctgcagaatccttaaaacctgtggcacttaaaatttgttagcctttctaatgagaggtaaattatacacaacantgatgaaaaagattaacagaccagttgtctattatgaatcattccagctttgtgcaacaatggccgaaactcttttctcatattctcgtcttgntttcctnataaaactgtgctgcctggctattnggcttggctgtta

SEQ ID NO: 3219 - DNA, 272 bp, Homo sapiens
  misc_feature (1)...(272): n = g, a, c or t
caattgcatacccatattttaagggacaggtgaatttactactttctaaagtttattgatacttcccttttatgtaaaatgtagtagtgatacctatatttccacattgngcattgtgacacacttgtctagggatgcctggaagtgtataaaattggactgcatttcttagagngnttntactatagatcagtgtcatgggccatctcttcctcagatgtaaatgatatctggntaagtgttatatggaataaagtggacattttacctcn

SEQ ID NO: 3220 - DNA, 354 bp, Homo sapiens
  misc_feature (1)...(354): n = g, a, c or t
aaaacaaaaatgaacatttcttttacttaaattcttgtacttctaaggtacaaatgatgaccaataattttatctttcttcctttgaatatactgtaaattctatgaaaaattcatttataaaaacaaagcaaagaatagcataaattttattttctttccaatgttatatttgtaatagaagaaaaaaactccttctgataactgtaacctaaggnaacaaatattttacatataatttngaggcaaanctaatgagnttcttgantcagctggagaaattagncncattacctatgtcatgcataaatgatggtaagaagaananaggcatctgatcatgtatgacaacngc

SEQ ID NO: 3221 - DNA, 419 bp, Homo sapiens
  misc_feature (1)...(419): n = g, a, c or t
aaaatagctttaaatgcattcttcacaagtaattcagcatatatttttatatcatgtttacttatgcttaagaattaaagcaagtatatttattactctgatggaaatatgggaaatctctcattcatgcaatatacagggataatattcaagcgaagggaaaattccngctttttatnttntgtaaatgtatccatatataatcatcgacatgacagatgaggaaacccatgaagttcccctagtcagatntacattntcacttcatcagaagcacctgatatctacagctaatttataattagatactgtttcaatgaaacccaaaatgagccctacaagntcctataaacaaaagctttcnatgtctangacantcaccaattaatgcatcattcannaggattatggcttgttcc

SEQ ID NO: 3222 - DNA, 502 bp, Homo sapiens
  misc_feature (1)...(502): n = g, a, c or t
ctgacaggttacacaatatatatcaaacaatgtgacacaaaacatagctctcctctttcgtctcacagaggaactaaagttccaaaatatatacaaaaccatcttccatctccaactgtcttctctttcttcccagttttatgcaaagcaggctcattaatacattcttcaccaggctcaaccaagtagcgnagtgtcttccattgcacctctaaagttggaagattctgatcccacgtcttgacgtgttncaaaaaacaatcaggtcacaaaggtaacagcaaaatacgaggccatgcccaacatttnaaaaacacagcgaagtaacaagaataaacgtgaccacaaaaacaacttaattaagccccatttctnttctgagagtatttctttgacaaaagggtatattttccaaaaccaaacacatttgataatctaaatccatatcgaggtcatcaatcactgaccataagggagactgttcattgggggggaaaaaaca

SEQ ID NO: 3223 - DNA, 318 bp, Homo sapiens
  misc_feature (1)...(318): n = g, a, c or t
aaaataaaaaagaaattaaaggtcatatactgtactactttcacaaagatcacacagttttgcaaaagacttgtcatatgtacaatgctatatatcaaatgagaaaagctgtaagcaattatatacgcaaaagaaatgcagtatttacagtttgtcaggagacattagaaatcatctatacattaaattacattttgcttgcaaataactggtaaaacaaaatgagccatgtccacaccaaaatataaaaatctgtattgcatttttatacctaagatgcattcacagaactgctgctgacaggaaagaaaaaaanaa

SEQ ID NO: 3224 - DNA, 221 bp, Homo sapiens
aaaaattacatgataaatgtaaatcataaaattgaatgtacttataaaggtacacctattttgtgctacataaaaaaactgtagactgcaaactgtgcatgcttaccataacattttacccggggtcgatgagtgggatttcttgcaaatatttactgctatgatataaaacaattatgtgcaaactgcaaggtccctaaaatagcagttaaagagtttat

SEQ ID NO: 3225 - DNA, 427 bp, Homo sapiens
  misc_feature (1)...(427): n = g, a, c or t
aaaggnatttgctcattggtctggcttanagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagnaagaaacttcattgagtagcttgtgatatgttcgatactaanggaaaaactaaacagatcacctttgacatgcgttgtagnagtcgggaataangagaggggcttttttattttttcgttcatacgaatattggntgaagatgatactaantgctaaatgaaatatatctgctccaaaaggcattnatcctgacttgggagatg

SEQ ID NO: 3226 - DNA, 275 bp, Homo sapiens
  misc_feature (1)...(275): n = g, a, c or t
aaactgggctctgtgattccagagtttanaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatccttt

SEQ ID NO: 3227 - DNA, 295 bp, Homo sapiens
ccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcatttt

SEQ ID NO: 3228 - DNA, 147 bp, Homo sapiens
  misc_feature (1)...(147): n = g, a, c or t
atagcatggcatctgtgaaatatggctgnttgttacatacagtgattctgcagacatgttgacatgacagtgaaatacataaatatgtaatgagaaaaggctnaactgtggataaaacaaagtcattacaattaaagactcnangtt

SEQ ID NO: 3229 - DNA, 434 bp, Homo sapiens
  misc_feature (1)...(434): n = g, a, c or t
tcagtttgttaatataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgctaaaagaatattctttagtattttctctcatactanggggttaatatggannntgtttgaaattgcaaatngaataattgtccangttttttttataccttgctaaantaanntcctcttttaatctantgatagatacagtgatcgccagtgatgacanctn

SEQ ID NO: 3230 - DNA, 259 bp, Homo sapiens
  misc_feature (1)...(259): n = g, a, c or t
gtcacattcagcattatccaggcatcaggcaacatctgtctagtgttgtcttcatcaagaacagactatatactaattcccactanaagctgtccatgccatacagaagatntattaaaaatgttttaaatggaaaatgtnctctagaccacaggactaatgtaaattaatatacacgtcnttcattattngtngaagctgatagaatncttgangtgnaaacttgcgnctgaatgttntatttgttctttanctgaag

SEQ ID NO: 3231 - DNA, 506 bp, Homo sapiens
  misc_feature (1)...(506): n = g, a, c or t
ctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcnatcgtcaagacatcacttggatttcttaatcttaaatgcttatggaagatgtgaagttgaggtgctgcattctagaacttcaatntgtagcttactctttttttcccccctttctt

SEQ ID NO: 3232 - DNA, 332 bp, Homo sapiens
  misc_feature (1)...(332): n = g, a, c or t
aaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataattnacaaattagttcttt

SEQ ID NO: 3233 - DNA, 508 bp, Homo sapiens
  misc_feature (1)...(508): n = g, a, c or t
aaatagtttcaggaataaaaagtacaaaagaagactggttaaaatttgttgctacaaagaaaaggacacagaaagacggccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagggcttaattaaagatggcttgagaactttnggtagccatgtgtnagaaatggatggtattcnccgggggaaacaangtntttgaatttctacnttattgaaccagattcccattgtttta

SEQ ID NO: 3234 - DNA, 147 bp, Homo sapiens
  misc_feature (1)...(147): n = g, a, c or t
tcagtatatgatactctgtaacatttctatttatatcggcataaatttcattttttttcttcatatgcaatgtggntatataaagcttaatgcagctcatttgctaccattcggatacttagacactntgagcaagattgtggcnnt

SEQ ID NO: 3235 - DNA, 340 bp, Homo sapiens
  misc_feature (1)...(340): n = g, a, c or t
aaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgcgattgataacttaggaagttcacaatgtattttctacttntgcaattaaatattctttagtgcttgtttattattactaaatactaattaagtactaacaagnacttaaatactaatgtattaagtatttaagnctttctaatngnntctttaacaaaaaaaa

SEQ ID NO: 3236 - DNA, 275 bp, Homo sapiens
  misc_feature (1)...(275): n = g, a, c or t
aaaaatgcccaaaacacaaaaatagacttttaaggtaataatatatattactaaatatattatagtctacttataataattatatcgtcgttttcaatattacaaaaaaaggaagaaaaatacaagggaagcagacgacccaatatatataaatactataaaatcatattagaacaaataaagtcgtcataaataaagggcccattgatttatgggtggggtttggcaacggctttggctacttgcttttggagggtaatttgacnancaggatt

SEQ ID NO: 3237 - DNA, 501 bp, Homo sapiens
  misc_feature (1)...(501): n = g, a, c or t
ggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggncgagaaccaccaaggaagagtttttatgcataaagattcctgtactctaccctagaactaatacatctgaatctctgggaatggagtataacaatcagatttgaaaaggtttctttagtaattttaaggactgaccattttanacactgctttgttanagcaaaatgattaggtacctagtatcaacctagccatccaaccttatattaataactagggaaaataaaggggttggagcctctgtgtttctttgttgnaaaatctgctactattattaagat

SEQ ID NO: 3238 - DNA, 218 bp, Homo sapiens
  misc_feature (1)...(218): n = g, a, c or t
ggtgggggaaganatgcaagtcatatnncaaaggatctgcacagcgcaaaatcttcttggntttttatttaacttancngtgaatgcaccntgattggnttaaagtataggttcactcccatggaaacatgcaataagatcacatngatccagaggctggntcaagtttgactgacgggaaacgggagggaaggctgntcctatcacncaatctcagc

SEQ ID NO: 3239 - DNA, 374 bp, Homo sapiens
  misc_feature (1)...(374): n = g, a, c or t
aaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaataggtaaacatgctttgccaagaagtagaagatatattccctagccttagtttttcctcccaatttgcatttttgtaaaaataatgntgtatccacaaaggaaataaacttt

SEQ ID NO: 3240 - DNA, 429 bp, Homo sapiens
  misc_feature (1)...(429): n = g, a, c or t
ggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgtncatcatacatcatacctttaagattgctatattntgggttattttcttgacaggagaaaaagatctaaagatgttttattttcatcttttttggttntcttggcatgactaanaancttaaatgttgataaaatntgactagttttgaatttacaccaagaacttctcnataaaagagntnatgaatgctccacantttcnacatnccacangagaagtcaattntcttaacattgg

SEQ ID NO: 3241 - DNA, 397 bp, Homo sapiens
  misc_feature (1)...(397): n = g, a, c or t
ctgaaccctcgtgaagccattcatacaggtccctaattaaggaacaagngattatgctacctttgcacggntagggtaccgcggccgttaaacatgtgtcactgggcaggcggtgcctctaatactggtgatgctacaggtgatgtttttggtaaacaggcggggtnagattttgcncgagntccttttactttntttaacctntccttatgagcatgcctgtgttgggtngacagtgaaggtaataatgacttgttggttgattgcagatattgggctgttaattgtcagttcagtgtttgaatctgacgcaggcttatgcggaggagaatgtttncatgttacttatactagacattagnttcttntatagggtgatacgattgtgnccnatngg

SEQ ID NO: 3242 - DNA, 298 bp, Homo sapiens
  misc_feature (1)...(298): n = g, a, c or t
tnncgaggtccacttgtgtgggccctcantttcaaananagcnctaaacttgacattgggggcccaccactccaactttgctttctgaaggttttggtgtacattgagccccagaaggaaaggagagcatttgtnaggtgggggcctcccttgaccccantacgaantctatgccctgaatccccagagtnncccttgctggggcccaactggcctggggacaaacagtgtccactacntntaggactgctcggntaagtggacacacttnttgaccncntaccaggaactttngtan

SEQ ID NO: 3243 - DNA, 293 bp, Homo sapiens
  misc_feature (1)...(293): n = g, a, c or t
aaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagntctgaactggggctgtatttcagtagttgtagaattattgatatttagttttgatagctaatgtttaattgtttggatctgcacagtttggtttttgcacaaaagtcattt

SEQ ID NO: 3244 - DNA, 231 bp, Homo sapiens
  misc_feature (1)...(231): n = g, a, c or t
taaataaacaacattttcagtatgaactatggtaagatttcatcattctataaggcatattatttaggaggtattccttcctatgcatttcctattttacagtaaactcagtatcaggtaaaaattaactgctaatgttcctatcaacaattcatccattcctttttatgacacttttatcttgtatacaaaaaaatacacaattttnccaaaccttgagganccccccnt

SEQ ID NO: 3245 - DNA, 209 bp, Homo sapiens
  misc_feature (1)...(209): n = g, a, c or t
ctgccctacttttcaattcagatatactagtaccttacctagaaataatgttaacctagggtgaagtcactataatctgnagcctattatttgggcatttgctacatgatgagngctgccagattgtggcaggtaaagagacaatgtaatttgcactccctatgatattngtacatttttancgaccactanttgganganattcccca

SEQ ID NO: 3246 - DNA, 241 bp, Homo sapiens
aaatgatctttacagatccctgaagttgctgtcctgtcactgtatttaagtgatggatattcaattgaattattctgcataaataattctgttcaacccagaagtatagtagtatgatgggtcagatacagtcaactgttcaataaaaatgcagatgtctgaaattattaaaatgtacttaaaagtaacaaactgtatcacacacttaggcttagaagtgttctttcaagttttttctttt

SEQ ID NO: 3247 - DNA, 268 bp, Homo sapiens
  misc_feature (1)...(268): n = g, a, c or t
ccatggattaatttttcctgttctggaactttatctatatgtactctaccatattcaaatcctttagcacagcacaatgtctgtaagatttattcatgttttattataatagttctgttttgttgctgaatagtattccatttgtgaatatattataatttatttgttttcctgttaatggacatttgagtttttttcatttggaggctataatgaaggaaactttgtaaatatttgtgtaccagtctttgtgtgaacagatgtttnt

SEQ ID NO: 3248 - DNA, 286 bp, Homo sapiens
  misc_feature (1)...(286): n = g, a, c or t
cacagtaattgaaataatttcaaataactgtaaaggaactgaaaatcttcacagagatgaagtggggtttccattaggtgctttgaaatttgataacaaatcatcaacttccactggtcaatatatagattttgggtgtctgaggccccaagattagatgccactaatctccaaagattccctccaattatgaaatattttaatgtctacttttanagagcactanccagtatatgaccatgtgattaatttcttttccactagataaaattacctggttcaaaag

SEQ ID NO: 3249 - DNA, 101 bp, Homo sapiens
ctgagggatcatgctgatcttcaggagtttgctgcttgcatacttattcttgatggcgatgaatttagttaagttttcatttactttcaccacattcttgg

SEQ ID NO: 3250 - DNA, 330 bp, Homo sapiens; identical to SEQ ID NO: 2

SEQ ID NO: 3251 - DNA, 493 bp, Homo sapiens
ctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggag

SEQ ID NO: 3252 - DNA, 142 bp, Homo sapiens
ccagattacccaggaccgactccttctctcggctgaattgctcaaaggactcctctcctgccaccggggggttcacgacaatgtccatggcggcctgcccagacactggggggcacaggcgcaccgacagcagcttcaccag

SEQ ID NO: 3253 - DNA, 530 bp, Homo sapiens
  misc_feature (1)...(530): n = g, a, c or t
ctgggctctgcacctagggagacggcactgtgttgggggaagcgcgtgggaagccagagtcagccttatcaaccacaacccaggatgttccttcggcacaggcatctcctgagggccccgccacaagccacccctctgcccctggcctcacattccttggaagcacaaatgagtaagatgggaagggggcccagtggacatgtacctttccagaaccttcctaggcacccctcgacctgcagggtaagggccctattcctcaacctggcactcgaggcccctcgggtctgtccttcgcccctgcctatcttacctccaacctttcttcactcaaaatcccacacttgagctacaatgaaaggccagcggctccctaaacacacggggaccgcctgcctctggcttgcacgggcttgctctcttctgccagaagagaaaactcccaagantccctcagtgccaagctccaagcatcacctttttccttggaaaggaaatcttccantttccccaaaaagggggtcaccgtg

SEQ ID NO: 3254 - DNA, 533 bp, Homo sapiens
  misc_feature (1)...(533): n = g, a, c or t
ctgcagagtatatgaccaggtggaaagtccaacagatgccccactcacaagatagggccctccaatcagtcttctggctccctttcactcatagtaactggttgctcttcctattggtcatagataaatgacacctgcacaattctccgagtgctttcaagcaacttcgggaggcagtgactaagaccctttccttgctcccagcttcctatgtcccagggctgcctgtggcacctggactgctgctgcccctgggtcccgtacattccagggcaacaatggaggaagggcaggcaacgcatgangaattaacagtctttattgggctcagaccaggagtccgtgggtcttgaggacctctgtgtatttgtcaattttcttctccacgttcttctcggcctgtttcccgtagcctcatgagctgtttcttctttccggtagtnggatcttgggctttctctttcctcttctccttccanggtggctgacactggctnggacttcccagccaaccctcgtgaagccaggccccc

SEQ ID NO: 3255 - DNA, 187 bp, Homo sapiens
  misc_feature (1)...(187): n = g, a, c or t
ccatggctgatattttgactacaacctcatgagagactgagccacaacaacctaactaagaaactnctgaattccctaccaacanaaacttntgagataatgttctgttgttntaactaanttttcaagccggcaatttgttatacanaatatgtnactaataaagcatggctcctttaggtcttct

SEQ ID NO: 3256 - DNA, 314 bp, Homo sapiens
ccactcctccatttagtcgtcaggagaaattctatgctacattagttaggtacgttggggatcgcaaaaacccagtctgtcgagaaatgtccatggcgcttttatcgaaccttgcccaaggggacgcactagcagcagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatgg

SEQ ID NO: 3257 - DNA, 235 bp, Homo sapiens
ctgaccatgactgaagttccagctttactttttataaacttgaatgataaagaatagaccatgggctactactgggcattagtgcaatataacagcgataataaaattctctattagtctgttaatttatgacatgatctcggaatggaaaaagatcatttcagagtgtgcgaaataatagtctttaaccatgtaattaaatatgtgtgtttattgtcaaataaggatttgtttt

SEQ ID NO: 3258 - DNA, 194 bp, Homo sapiens
ctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcagg

SEQ ID NO: 3259 - DNA, 230 bp, Homo sapiens
ctgaggtctgccagatcatcgatgaaatcaaacaactgactgatgtcatatgtgatagagggactgttgggattcattcttttcagatgttcttcatacattttacaaacaccttccatgcattcattcacagattcgtagtcagcataagttctgcctcctggcctcttggtaggctgtaccagcaaaatggtgtgagacatcgcgccaaactctcttcgctacagcag

SEQ ID NO: 3260 - DNA, 406 bp, Homo sapiens; identical to SEQ ID NO: 1

SEQ ID NO: 3261 - DNA, 486 bp, Homo sapiens
  misc_feature (1)...(486): n = g, a, c or t
cctgaaagaagggtactagtccagaggtggctagatgggattgggtctctaagggagaactcctgctctcaggcccaaccctccacctcccccccgaaaacccttaccagagcctggggaccaggtttgtgttgtccacatattctccccacatacaagcctctccaccaatcaccagagccttctgctcaggggtaccttcaaatgccaggggttccactacgtagaaatccttccagtcagggccataggatatacggttcaggtaccagggggcagagagaagggcccggaagccggccttggtgaccagttccagctccttcatatagttcactggaatatcctctcgccacacctgtatgattgtgtctggctgaatctttactttattatcaaacacctcctgccacaccacatagcccttgccataagaaagagacgaatgtccagcagcgtctggatgtagaaggactccagacctcn

SEQ ID NO: 3262 - DNA, 227 bp, Homo sapiens
cctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaagg

SEQ ID NO: 3263 - DNA, 182 bp, Homo sapiens
aaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatgg

SEQ ID NO: 3264 - DNA, 269 bp, Homo sapiens; identical to SEQ ID NO: 4

SEQ ID NO: 3265 - DNA, 197 bp, Homo sapiens; identical to SEQ ID NO: 532

SEQ ID NO: 3266 - DNA, 279 bp, Homo sapiens
ctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccag

SEQ ID NO: 3267 - DNA, 389 bp, Homo sapiens
ctgtcaggggcggcgtgcctggtgatgcggcatcttaccttcatccccatctcagaatgggcagccagtctcagattcaaggaggaggaatcctgaggtgtggcgttcagtcctgaggtagatctgaggtcccctggaaattgtgttgatgctgagatggatgaggggtgctcattctctcaggtagacagtgaggagtcctggttcagccgagcctccatgtctgcatggatggttatgaccctgattgtttttggaaacagccaagctctctaggtgtactcagcaaatgcaaggtatagtgggtcctgcatacccagggtattatttgagccatggaagcaaaacagagactgcttagcctccctaagagtagttggtgggagtgg

SEQ ID NO: 3268 - DNA, 113 bp, Homo sapiens; identical to SEQ ID NO: 3
  misc_feature (1)...(113): n = g, a, c or t

SEQ ID NO: 3269 - DNA, 492 bp, Homo sapiens
aaaagtcctaagagaaatatgtgacaggtagttactgtcagtagggatattttctacctttttttccctattgttgaagtgtcggccacaacagcttctgggcatgttacagcctcaaaatcaccacctaccaaaaagggcaaaactaaaaatccctataaaataaaaaagaaagttccacccaaatgtttagtgcatttgacaaaatattatgggtatttagcaaatgaataagaaaataaagaaaacagtgcaggaagaactatataatgttttaagatttttatattacagacctgcatctctgtacatttttcacaggatgattaccagtatctcagatagcctgagtgtgcaaaaatcttcagaataagaataccatagttgctaaatatcttttaccatgaacaataatttcttcttctctccccactccccaattataaacattttatccttcaaaatacagctctcctgagttgtacttcttgt

SEQ ID NO: 3270 - DNA, 294 bp, Homo sapiens; identical to SEQ ID NO: 280

SEQ ID NO: 3271 - DNA, 587 bp, Homo sapiens
  misc_feature (1)...(587): n = g, a, c or t
ctgctgacagttctttggtggaaaagtaagttgcgtacttacccaagctgcccaaatgattatcaagccaagtttgtttttcaaaaataggttttaagatacaccaaagaaactatacaatacaaaaatttaacaatgaagttaaagtatatagcaaaagccaaatatgacaacacacatgtataatgtagaaaagaatcctttcagtcctagaaaactaaaatggggagaacttactgaagggtaacatacataaaatgagtactaatagcaaggaataatcctaaacattttcccaataaactgactaagcctcaaaaggacagcttaggaaaatgattaacatgcagtttttctttttccctagccaattcaggttctacttagataaatctggttgccaatcaatacatatataaattaatttttttctgctcaattactaccattttttctttttcccttttccctaattttctctagcaacacttttcctttggtttgatcangttgaactcaaaaggtttggtacctaaaatgaantatcaactgttatttgcaatagcaccttgggaaatgcaatccta

SEQ ID NO: 3272 - DNA, 233 bp, Homo sapiens; identical to SEQ ID NO: 620

SEQ ID NO: 3273 - DNA, 466 bp, Homo sapiens
ctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaagccagtttgcagcaattgctcctgttggcatcaatatga

SEQ ID NO: 3274 - DNA, 326 bp, Homo sapiens
  misc_feature (1)...(326): n = g, a, c or t
caaagctagaaccctgggaacaggctatgtgttgagggagggagaggaagaaaccaaggaccccctggtcctggcctgagcgccgctgtggatggcgcagcccttcgccagaacagggtgcaacgagcatggggagaggagagcaagtgcctcctcccccacaaccagatgcccaaggccacgtgagacacccagcggggagcccacaccccagggccccttctctggacaagtcactcccccacccacctttcaactcangcaagacagtactcacctccgctcgccanggggtggcttcttggggcttgcaggtttgggcaagg

SEQ ID NO: 3275 - DNA, 181 bp, Homo sapiens
ccttcttgaatctctagtcgtcgtcaggcttaggtcacactacccatgcactgatcagccctgccacgtgggggaggttccaaaaaatgaagcggttccaggggtgccaaggttcagagcagagtcttgagagcctgaggggcaggaggaggcaaaggtctctgaggacgaaggggtttgg

SEQ ID NO: 3276 - DNA, 546 bp, Homo sapiens
  misc_feature (1)...(546): n = g, a, c or t
ctgatcacttatttcatcattttgcatgttttattcactggggagggctgtgttacctgtatcagatgactgattctaaatagccttgttactgtgaaaacgaagttctatttatgattaccacatggtgtttgtttttttcttttttttccaccaaatggagcatcacagtcaatatgcttttaacagtgggagcagagaaggtagtgcttactctagtacaccaacctgatgggtcattagtttcaactggcttcagaagagtgattcttcctctaattagattttattgttgaagttccttcatatggaagatattttccatagtatttggataagctggactgtgttttaagaactcatatggatgttgaaggttgttttcagtttatctttccagggaacttctgttcagctctgatgggtctggtccttttcatgcctgagggagcagatgtgattgcctgtgattgaagccagtggagagttataaactatttttgttctaacatggatgatgcctaaactcttccctcttccacanaa

SEQ ID NO: 3277 - DNA, 461 bp, Homo sapiens
aaatattgttaaagaattctcaaaggagtaaggttaatgagcaagattaaaatggcagcagcagatccaattgcgttttctttttcataagcctaaaagcatcgcggtgtgtttcagagctgcttcctctacaaattctgcatccacattgtcatgtccttcaaaaggatacagggcttgattggaggactctatatctgtcagaatttcaatgaagtagttcagaggcagaaattctacactgaacgatgacttgttaatcatagaattccgaggctgtttcttatagttctgaagcagtcgcgtcacgtggttccgcgaaatgatgttagaactcataggatgatcccaaagtctacaaatcttctgcccaataagcggaggaagccgcacaatgatactgaatttcagtttttcatttttctctgtattatccagatctttcatgagccttatgacag

SEQ ID NO: 3278 - DNA, 569 bp, Homo sapiens
  misc_feature (1)...(569): n = g, a, c or t
ccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccattgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatggccagaaaccctgatggaagtggaggagaatcatctcangcaaactttttgtgtgccagtaacagaaaccctctttgtgtgatcacatgcaaagtataggatatttgcaatatanccatgggggaggantgcagggcccaagggtagattttanccagga

SEQ ID NO: 3279 - DNA, 478 bp, Homo sapiens
  misc_feature (1)...(478): n = g, a, c or t
ctgctgaacaatgacatcgttttctccaggggttgaaatccatgtccatggctgacaacccaacaaggctgggacccaaattcgtacagagatgaggcagagtggagagaaacaactctggctgagccagagtctccagccactacttcttattcctgggctttagctcttcggctgcattacgcaggaaaatgtaattttttttctggggattataaaattcatgtccctttgaccagtcgtagctggaagcgtatgcaaatatgtttccattgtgattgaaacagcaagctgagatgggctgatctaactgttccgaagtttttagttttgttctggcatctttgtcccagaagctgaatctaccatcagatcccacagttgcaagggtgccatgaacaggatggaacgcgattccatttaccgcataaatgtcctgaggagctgaagngttggttccattanatcgatgacattt

SEQ ID NO: 3280 - DNA, 184 bp, Homo sapiens
ctgcacagtagtatctccctgcatcactctccttcacggtgagaacatgcagctctgccaacagggaacgctgggtctttctacccaggcttcttactcttccttctttgtgccaggagaatgtgacagtccctgaaccctgggctactgagcaaataaggaccatattttctccttcaatcag

SEQ ID NO: 3281 - DNA, 364 bp, Homo sapiens
tgaaattagtacagacttacttttttattttaaaatttttgctataacatttctgagccaaaggcagagggtatccattaacttcattgttgccttaattgaggggtgggtggcaatgccaagggtgggaacacaaggaagaaagaaatattaacgtcagctaagaaatcaacatgttatcaggctatactgtagttggttgcttctgtgttactggacatgacaaatgatctggtaaatgatgttaaattggcttgaaacaagagagtctcccaattcttagccacggtttcagtcagcccttccattccaggatgggattcacaagggcccttggtgtctggaagcaccaactgaacgcagg

SEQ ID NO: 3282 - DNA, 372 bp, Homo sapiens; identical to SEQ ID NO: 5
  misc_feature (1)...(372): n = g, a, c or t

SEQ ID NO: 3283 - DNA, 245 bp, Homo sapiens
ccaggccgaagctcactgtcccccacccattggaggttcctccctgatctgtctgcacatgggaaggagcagagcgcgcagggagaccgggctgtacaacaggaacatgctggctggacagtctcttgctggagggaatcagtagcactcacgtgaaccacctgcgctgcctccacgagttcgtcaagtctcagacaacctactacgcacagtgctaccgccacatgctggacttgcagaagcag

SEQ ID NO: 3284 - DNA, 251 bp, Homo sapiens
ccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttagttttcaaatttcattt

SEQ ID NO: 3285 - DNA, 224 bp, Homo sapiens
aaatgagcaataactcagatatattagagagaaatcaccgcttgccttacaaataccaaataaattccctagactcccctcccctgtagagaccatcagctcactgtgaaggcttgagcctcagtaggtaaaatttgaggaaaaaaatgagaaatggctaaaagaggcatctgctgcaggaaccttctgtgactgtcaaacattccctcttcaagctccctttt

SEQ ID NO: 3286 - DNA, 481 bp, Homo sapiens
aaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtaagtgg

SEQ ID NO: 3287 - DNA, 469 bp, Homo sapiens
ctgtgttgctcaagttgagctttgaagcaccgatccccaaagaaaatccagttccccccgaagcaagagtcgctgttccaaaagtgaagcctgtcgtctgtgtggccggagtctgggtggcaagtgagaacaggccggtggaaggggtacttgtggctggttggaagggagccccaaaattaaaccctccagtgccagaggtggagaaagaaaaccctgtagcaggtgtggttgttgccgtctttgcagtgccaaacgtgaacccgcctgtaggggccccagtgcctccaaaattaaacccgctcatggctccggactctggtggcggcagctactctggctcccaaagcaaatccgtcggtgtctgcagccttgggaagatttcgctcagtatcaggattcctccaccttctctggaccttgattcagtctcctaactgccacagaagggatgaaggttgaactccag

SEQ ID NO: 3288 - DNA, 502 bp, Homo sapiens
ctgaaaagctagattaaaaaaaaatcaatcaagtttcccaaagtataatgtttggaccttcaaaatatttagttctagggaaagatacaagtcagaagcacacacagtgacaagatatgccttgaaaacatgtctactgtgtagtatgataatcgatacaccaagtgcttacgttctgtttagacttcaaagtctgatcaaccatgaagtcaaaggtgtattacagaaacgagatgtaaaaatgaacaaatcccttctgccctttttccttttgggaaaactgacctcataggctcgttcctcaacaaacactgacatgaagacttacctgttggcctctcaattacatctgatgtcccaaacccactgagagtaaaacttggaactgttttcattaaaaaattcactttacagtagatctcaagatggacaaagataaataaggaaagaaacaagaaaaatgtaaagagggaaacaggcagatatttcagccaattagttt

SEQ ID NO: 3289 - DNA, 305 bp, Homo sapiens
aaagatttttctctaataaaagtacagaggaaattgaaagcaggatcagatagatgaatcaaggcttcttcagattcagtggtttacaaatatacctcaaaattcataaacaaaaataatacgtaaaagagaacagaaggtaacgcaataaaggtaacagagatagtgtcttcagtatataaagagatctgaaaaatttaagaaaacactagcaatgcaaagaaaaaacagacaaaagatttggaattcacgggaaaaaaagaaatggtcagtaaaaatgcaaaactgtttaagcattatatttt

SEQ ID NO: 3290 - DNA, 348 bp, Homo sapiens
ccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggagg

SEQ ID NO: 3291 - DNA, 373 bp, Homo sapiens; identical to SEQ ID NO: 6

SEQ ID NO: 3292 - DNA, 117 bp, Homo sapiens
ctgggctgctcccgccccagcccggcccagggtgaaggaagaggcacgtgctcctcagagcagccggagggaggggggaggtcggaggtcgtggaggtggtttgtgtatcttactgg

SEQ ID NO: 3293 - DNA, 464 bp, Homo sapiens
ctgcaggtctgacaggttctgctccagggccatgggcccagactccaggccacagcccagccgggccttccactgtttcatgaaccccaacagcaggtttaggtgggaggtctgggaggtgacctcatgctcttgcacagactgtgggcttcccttgaaggagcagccgacacctgcaaaggggcacccaattccagcctcagccacctcggggtgagccttctcctgagttcgaagacggcttcctgggcttatagactggaggtcttcccctctgcatttggggcagatctgatcctcgccattcctcgggttctcagagagacagcctgcacagcagagagccctgggctcctttgggtcctggcagacggtgggagggcacccaaagggaaactcattctcatcaggggccgggcgaggactgctgcctgagctggagccatctcagggttccaggctgg

SEQ ID NO: 3294 - DNA, 299 bp, Homo sapiens
ctgagggatttccacatttcgaggcagggagcagacaaaggccataagcagtgcaatcagccgcctctgccctgaggagccatcctggaatggctggaatctgctcgggaagctgttttcaggcagaaaggacacgttgccatccaagaagaggggcacaatgtgtgtcacactctgggcagctaactcagggctcaggggggttgtagcagtgccaatgacagacaccatggcagccaacacctcatcctccaatagtacttttctcagaactgagggctccttctctggcatagagg

SEQ ID NO: 3295 - DNA, 169 bp, Homo sapiens
ccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcag

SEQ ID NO: 3296 - DNA, 147 bp, Homo sapiens
aaagtcaaaccactaggaaaatatatcacagcctggaaacagcaaacggacaggctatattataatttcaagtaataagttggtgaaaattcaacgaagttgctatcgaaacaataaggtgccatgctggggcaggaacactgccag

SEQ ID NO: 3297 - DNA, 253 bp, Homo sapiens
ccttgtccaggaatacaggtaaagggttctgcgtacagaaaatgggtcccgctacattttaattttcaacagtcacacaatttttgcatcaaaatgacataaaagaatactagcacaaaaaccctaaaatgggcacctcagactgcagtccaatttacagatctctggcttacgttatcctaaggtgttaccacaaatataaccaaaatgtgagatataagcataattctttcaacagctttcggtgcctttt

SEQ ID NO: 3298 - DNA, 441 bp, Homo sapiens
aaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgttttt

SEQ ID NO: 3299 - DNA, 491 bp, Homo sapiens; identical to SEQ ID NO: 282

SEQ ID NO: 3300 - DNA, 209 bp, Homo sapiens
ctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacagg

SEQ ID NO: 3301 - DNA, 262 bp, Homo sapiens
aaaggtaccattctggcctgagatcttctgtaaatctattcctagtctttccattaccataaatctgtaactgtaagaaaaaagcatcaaaaagagatcatcctgagaaagtaatgcttgaaactgtctatttaatttgaaacaagaaaaattacgctcaacctaacaactaagtataatgcaatctaaaccattagagaatgaatgcacgttcataattctgctattcttttgcagaaactgctcaatatttactttgcag

SEQ ID NO: 3302 - DNA, 477 bp, Homo sapiens
aaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcctgtctcagaattgacacggtgaatgcttagtgtctggattttcttgtgccagtgtttacatatctgacatcgagctcctctaagaggccacgttcaagcttgtgtgtccctgacccaagatagccagtgctgctcccaggtggtacttctggtaccgtgttgagacacttgggattctcagactgtggacaggagtgtttgtcatttttcatactgttttcttaataagcgctcaag

SEQ ID NO: 3303 - DNA, 555 bp, Homo sapiens
  misc_feature (1)...(555): n = g, a, c or t
cctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactggaagaatttgaatttgatatttaagtnaaaatgg

SEQ ID NO: 3304 - DNA, 158 bp, Homo sapiens
ctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacag

SEQ ID NO: 3305 - DNA, 457 bp, Homo sapiens; identical to SEQ ID NO: 8
  misc_feature (1)...(457): n = g, a, c or t

SEQ ID NO: 3306 - DNA, 345 bp, Homo sapiens
ccttcaaggaagggaggggtctcagaaccactaaggggccttcctcactcccacttactcaggggcagaagactcagttgaagacctccaaatccagagacttggtaattaagtcaaagcctggctatgctgggagaatggcctccagaccctggcagaaaatggggtaagggctggtgaggctccccaccttccttcctctacaatctgctagaacccaaaacgagaaatgaggctttgggaaagggagcacaggaagagaaatcacacagcttccctcctcctcccacttgctctattgggctcctgcatctgttgctgggctgctagcagagaggctggcag

SEQ ID NO: 3307 - DNA, 216 bp, Homo sapiens
agcaggccctctttccatcccgtgtcggatgagctggtcaactatgtcaacaaacggaataccacgtggcaggccgggcacaacttctacaacgtggacatgggctacttgaagaggctatgtggtaccttcctgggtgggcccaagccaccccagagagttatgtttaccgaggacctgaagctgcctgcaagcttcgatgcacgggaacaatgg

SEQ ID NO: 3308 - DNA, 385 bp, Homo sapiens
ggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctccgctgattggctgccacggtgggagtcagccaagattt

SEQ ID NO: 3309 - DNA, 322 bp, Homo sapiens
ctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacgccttcccacttgctgaaaaggtcaagg

SEQ ID NO: 3310 - DNA, 305 bp, Homo sapiens
ctgaggtgttttagtgtcagaagagggctggctgacccccctagctcaatttggtctcacaggtgagaaggtacctggctataaatatgaatactgattgaggcaggcttgatctgggactttcagggcaggcagaatgactatggcccaggtcccacaggatgtggagtttccgggctcagcatcatggtatctggggcccatgtccaagtggagtgaattctagctgggaaggtccgctcaggcacacgggaaccccggtctgcttttccacccccaccccatggagtatccaaggctggtac

SEQ ID NO: 3311 - DNA, 484 bp, Homo sapiens; identical to SEQ ID NO: 7
  misc_feature (1)...(484): n = g, a, c or t

SEQ ID NO: 3312 - DNA, 364 bp, Homo sapiens; identical to SEQ ID NO: 9
  misc_feature (1)...(364): n = g, a, c or t

SEQ ID NO: 3313 - DNA, 311 bp, Homo sapiens; identical to SEQ ID NO: 621
  misc_feature (1)...(311): n = g, a, c or t

SEQ ID NO: 3314 - DNA, 187 bp, Homo sapiens
ccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccag

SEQ ID NO: 3315 - DNA, 443 bp, Homo sapiens
ccagggtgattgaaaactcagcctcaaaacaaaaaattcactagttatgattcaacgcgttcaacagaagccatccccagcccagcttaaattataaagatagacaataactctgttccaatctgcatggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaattt

SEQ ID NO: 3316 - DNA, 303 bp, Homo sapiens
  misc_feature (1)...(303): n = g, a, c or t
aaatnntttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaacccttaaactaagttttgaaagtaaggttattt

SEQ ID NO: 3317 - DNA, 148 bp, Homo sapiens
ccatcacttaggttattccaccacttgttaatctcctttctgaagtctccttctttttgtggtcttatgctatccaaccaatcagcttttataccatcaaaataactctggaccctggatttcagtgattcatattgccaaatagcag

SEQ ID NO: 3318 - DNA, 270 bp, Homo sapiens
ctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacagg

SEQ ID NO: 3319 - DNA, 382 bp, Homo sapiens; identical to SEQ ID NO: 10
  misc_feature (1)...(382): n = g, a, c or t

SEQ ID NO: 3320 - DNA, 271 bp, Homo sapiens
agaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcagacatgaagtcatcaatatcaacctgaaaaataagcctgagtggttctttaagaaaaatccctttggtctggtgccagttctggaaaacagtcagggtcag

SEQ ID NO: 3321 - DNA, 126 bp, Homo sapiens
aaacactttcaaatatggagattaatcaccaacttcttattttttgggccagttggattcaattttttatttaacatgatttttctctttttggtctgtttgtgagcttagttttcttgggccagg

SEQ ID NO: 3322 - DNA, 277 bp, Homo sapiens; identical to SEQ ID NO: 619
  misc_feature (1)...(277): n = g, a, c or t

SEQ ID NO: 3323 - DNA, 406 bp, Homo sapiens; identical to SEQ ID NO: 615
  misc_feature (1)...(406): n = g, a, c or t

SEQ ID NO: 3324 - DNA, 274 bp, Homo sapiens
aaaaatcgaataatcctattcaagtcaaccagtgttaaccccggtgtgcttcctgccagtctgttcctccccatgggagtcacacaaaatgaaaatctcctagaaagagaaattcctctgtcctctgacttcttcacttagtacgctgcgaccttcccatgttgttcaacatcctcaactcggagcgtcactggctggaggtggtctataaatggaattggcttaactatcccttcactgaaaggtggacatttagggagtgtccagttttcag

SEQ ID NO: 3325 - DNA, 198 bp, Homo sapiens
ctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggccag

SEQ ID NO: 3326 - DNA, 413 bp, Homo sapiens
ccagaggagctgtgtgtgtggaaactcgcaggccacacgggaaattagcgactgcgtggtgctgatgcagaaagaaaaatggccgagacgcgcggagagcgggacccgcaggcgcggcggcccagggacggggacgcggccggtgagaggacgcagaatgagatcagattgacttctcagttgctgactctcaactgcttagaaaggggcagaaacgataaaaacagacacccctgtaccccacactaaagagctgtgttaatattgacggtatttgcagtgtcccttgcccacggccccatccgccacccgtgactggggcacttccctcctgccctctggccgtcagcctcttgcagcaagcatttccatgaacaccaagtcggagattcgtccacgctggtgcctgcagg

SEQ ID NO: 3327 - DNA, 438 bp, Homo sapiens
  misc_feature (1)...(438): n = g, a, c or t
ctgcccagcgaggtcctggtgctgggggctgccaccagggcacagggcctgtgagaggtcaggctcagcccctgctccccacctcttccccctgccccatctcaggaccagcaagcctatacctgctggccttgagggtctgatgtggcacagtgtaagagagttagtgatcctgagtctggtgtcctttccctgacagacaaccagaggtccagcttcaaaggagatacacagggggcaggggtggagtagggcatcttcttcctgtgcccaatctttcctcccgtgttttctagtttctcacaggactggggcaggggtcagtggggaggcaggtggactgccctgagcaaacttccagagaaataccaggccaattttccctttaagggatggggaaaccaaagctgggaggattgggganggtggagagctgca

SEQ ID NO: 3328 - DNA, 472 bp, Homo sapiens
  misc_feature (1)...(472): n = g, a, c or t
ccactccatcctggggacctttcttcagcacccgtattccttgtaagtctagacgccgccctttcatctctagtgcacccccaaagccttccaaaggccatgcctgttgaaattcatccaccaaagccagtatttcttctgacattttggtttcatctgaattctccatctcatcagaaccattgctctcctcaaccaccgtactttcaagtctaagggcatctgagtccctccctgaattctcaacagagaatacagggtcctcctctgttcctctctcagagggctcttcttcagcagcatccagtgactgtgagttgtcaaaatatttctgtttgtcatggctgttgtccagggttttctcatgacaattaccactgcaaacagaanaagtgatgttgtacagaaaaaggataaaaacttgcatacagcgggatcaacttcaggctgtttncacactctgggacattng

SEQ ID NO: 3329 - DNA, 465 bp, Homo sapiens; identical to SEQ ID NO: 12
  misc_feature (1)...(465): n = g, a, c or t

SEQ ID NO: 3330 - DNA, 292 bp, Homo sapiens; identical to SEQ ID NO: 11
  misc_feature (1)...(292): n = g, a, c or t

SEQ ID NO: 3331 - DNA, 472 bp, Homo sapiens; identical to SEQ ID NO: 283
  misc_feature (1)...(472): n = g, a, c or t

SEQ ID NO: 3332 - DNA, 235 bp, Homo sapiens
  misc_feature (1)...(235): n = g, a, c or t
cctatgacccccacccagataggcccaagcctgctgcctatcatgtggcagctctaccctgatggacgataccgatcctcaactccagtttctggcgcttagtgtaccacatcaagaatgacggcgtggaggacatgctttcagctgtgcagatactgatgatggcttgnagactgctctttacccaggctagctgactcggcggacacctaggcaatcacacatgcgcgtctat

SEQ ID NO: 3333 - DNA, 470 bp, Homo sapiens
gggatgtaccagatgcttatgaaactatcagatctcgtgagaactcactatcacaagaacagcatgaggagaacccatccccataatccaatcatctcccctcaggtttctcccttaacacctaggggttatagtacacagagaagtttgggtggaacacacagctaaactatatgaatgccagaggacagtatctatatttaatttcaacttcatactggagcagaatgaaaatgaagcccagtggagaagtgacattcccaagatcaccctgccagacccaggactgtttgagttgtggcccatgctacctcccacctattctcctaatgcttccatctctaagtgtatgcattatctacaggtgacactacatcattatttttatgtcttatcttatatacacctaatacattccctaggaagtagatgttagcatcatcaccagtgtgcatgttaggaggctgggg

SEQ ID NO: 3334 - DNA, 206 bp, Homo sapiens; identical to SEQ ID NO: 13

SEQ ID NO: 3335 - DNA, 394 bp, Homo sapiens
cctctgagggcacagtggtaaatgatggagggggtggactcctcacttccagacagcatcaccccacacatctgtattattgatgctgaaaattccggccctacgtccagaggatagttctcaatgaggtaaaacgcagtggcacacatgaccagtacgtgctgctggctgtgaatgttcacgcagtgggcgatccctttcaggttggagaggagatagtcgctgatgaccgggatgagctgcttggcagtgtcgtccagcaggtcgcactccagcacatagaggatgccgtgcagggctccaaccctgctgggcaggtggctgctcctgagcgtgctctccagcaggcggctgacaggctccgccacggccttgtccatcccaaggacggcag

SEQ ID NO: 3336 - DNA, 199 bp, Homo sapiens
  misc_feature (1)...(199): n = g, a, c or t
ctgaggcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttnaaaaaaaaattt

SEQ ID NO: 3337 - DNA, 179 bp, Homo sapiens; identical to SEQ ID NO: 285
  misc_feature (1)...(179): n = g, a, c or t

SEQ ID NO: 3338 - DNA, 239 bp, Homo sapiens
ccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtttggtccattgtt

SEQ ID NO: 3339 - DNA, 365 bp, Homo sapiens
  misc_feature (1)...(365): n = g, a, c or t
ctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgacttgctgctggagatgttctcaggggagctatnttggtcan

SEQ ID NO: 3340 - DNA, 482 bp, Homo sapiens
  misc_feature (1)...(482): n = g, a, c or t
cctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtaacagacacacagatgccacttgttgctcctgtcattctcccagagatgtataagatcttcaccatggctgaggtggtatggtattcgaacccgttcccgaccgtggagatttttacccttgtgtccatatgatcttgtaacatgggaggagctgggaaaagggtgcaggccaaagtccttgatcntttccccgtgggtncagcanttttcacaaaaggacctcnggccgcgnaccacccttt

SEQ ID NO: 3341 - DNA, 349 bp, Homo sapiens; identical to SEQ ID NO: 284
  misc_feature (1)...(349): n = g, a, c or t

SEQ ID NO: 3342 - DNA, 378 bp, Homo sapiens; identical to SEQ ID NO: 14
  misc_feature (1)...(378): n = g, a, c or t

SEQ ID NO: 3343 - DNA, 303 bp, Homo sapiens
  misc_feature (1)...(303): n = g, a, c or t
ccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagcatggtaggtgaggtggttaaaaaaaattgtgaccaatgaactttagagangtctgccttggactggcncttatttct

SEQ ID NO: 3344 - DNA, 352 bp, Homo sapiens
  misc_feature (1)...(352): n = g, a, c or t
ccagcccagagcacaagaaagcaaccaacaaattctggtgggagaacaaagctgaggtccagatgaaagagaagtttctggtcactccccangattatgcgcgattcaagaaatccatggtgaaaggtttggattcctatgaagaaaaggaggataaagtgatcaaggagatggcagctcacatccngtgaggtggagcagagcccgacaggaggtggttcggtctgtcttagangcctcangcagtgccagacccagaagagggctcttcagcacctagaagcttggaaagggatgaacagcccaagtagcttccanctttacagcancccctcaaaatttggaccctgcc

SEQ ID NO: 3345 - DNA, 170 bp, Homo sapiens; identical to SEQ ID NO: 15

SEQ ID NO: 3346 - DNA, 358 bp, Homo sapiens
  misc_feature (1)...(358): n = g, a, c or t
cgaggtctgatggcgtcatccggctgtttgacatgcagcagcatgagtgcgcgatgagctggagggcccactacggggagggtctactctgtggagttcagctatgatgagaacaccgtgtncagcatccggcgaggacgggaagttcatccagtggaacatccaccaagagtggcctcaaggtattccgagtacagcctcccctcagatgccanngggcccctttgtgctgtctggatacaagcggctacaaccaggttcaagtccccaggggcccgactcttcgctttttgacttnggaggggaaattacattgctngacatgttctttgccaccaggcgggngttaatcttacaa

SEQ ID NO: 3347 - DNA, 473 bp, Homo sapiens
  misc_feature (1)...(473): n = g, a, c or t
ctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtnatgctgtccctgtgggtaacagacagggaattgaccatcttactgttgtaccaggtagctggggggggttggataatcccattgaagctgggacagncctt

SEQ ID NO: 3348 - DNA, 179 bp, Homo sapiens
ctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggcttt

SEQ ID NO: 3349 - DNA, 299 bp, Homo sapiens
  misc_feature (1)...(299): n = g, a, c or t
gttggatttgcaaacctccccaatcaagttcaccgaaaatcagtgaaaaaaggttttgagttcacactgatggtggtcggtgaatcanggtctaggaaaatcgactctcataaacagcctattcctacctgatctgtncccagaaagangtcatacctgggacancaggtaaaaacattcttatgttactgnaagtgtaattctacatgaaagatgcttgaagactgcctaattaatattttatgtctnagctggtgtgttttgtttgttcttgttcanctttgancncaaggaaaaac

SEQ ID NO: 3350 - DNA, 308 bp, Homo sapiens
aaatgattctttatttcaataaactttaacaaacaatatataatatttcttccttaaaaagctcattcaaagatcataggcagacttcttccccattgtattttagttggggagataaaggcaaaaagaggaaatgtaagctatcttacagtcattctgagaacctctggtttcatgctatactttcccagctaaaagttactaatttacgaagttcagatactgaaacttaaaaatcaagatccatatattaggatgtcctgctgtcacactggtggtggcccattgtgtcggagtctggtaaatgg

SEQ ID NO: 3351 - DNA, 466 bp, Homo sapiens
  misc_feature (1)...(466): n = g, a, c or t
ctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggtgagtagtttgttaggaaaatggtaagttagaacatctttgcaaagaatgtcttatctaagcaatgagcaaaaaacctttttatttactgaatnctgccatctggtttttatgagctggtaaattttttattggttttccaagactgaatgaagactcncacacagagaaattatntataaccttctttggaaaagtaattagtgtaacacacaanttcctccattgggaataaatatgnggt

SEQ ID NO: 3352 - DNA, 243 bp, Homo sapiens; identical to SEQ ID NO: 622

SEQ ID NO: 3353 - DNA, 337 bp, Homo sapiens
  misc_feature (1)...(337): n = g, a, c or t
cctcttccctgatggccgcgtcttcatggaagtaggagagaagactgtaaaaagcgaaaggcagcagcctggtgtgctgatccggggccacacgggaggaggagccgccccagcctgaggtcactctctgtcaactgaaagagtgccagccaggatatcttcctcttctctaaacactcgaggattgcttgcacaaacgtggaaaagcctttggcaggtctgtggtgctatttgaggtcagatgtgacgacagcanggcccatcaaggagaagaagaaaaggaaaaccaatagctcctctctctcgcagtccagctttctttacttgcttcctgatg

SEQ ID NO: 3354 - DNA, 337 bp, Homo sapiens
  misc_feature (1)...(337): n = g, a, c or t
ctgcataatgctcccacatctgtagatagagccgctctagttccattgtgtattgtttggtgttgaacagagggctagatattctttgcttccagactttgccacgaactttcttcaggtattctagatcagttcccaccttcacagctatgtcttcatattcttgtctgtttttagcaataagctcaagacaacctaagcaagtgagctgggatgctgcaactcgagaagcaanagtctctcctggcatagcaccatgggggtccctgcccaaaggacntccatccctgtggtgtgcccattacagagtgggagtgtccaagcagacatcagccan

SEQ ID NO: 3355 - DNA, 198 bp, Homo sapiens
ccagaagaaggggtaatttatatataattcaaactatatacagcataaatggaatgcagcccatcccaaactggctctgtgaaacaattggacctttatagttaaaattataacaagtgtaataatacaatagatttacatgggaagcaaaatccaagggacattttatattaagtatttactgtgctgtttcaattt

SEQ ID NO: 3356 - DNA, 201 bp, Homo sapiens
  misc_feature (1)...(201): n = g, a, c or t
ctgcaagaagaatggaatgaacataatgccaaaataattaaatatataagaactaagacaaagccccatttgttttatattcctggaagaatgtgtccagctacccaaaaactaatagaagagtcacanagaaaaatgaacgctttatttgaaggnagacgcatcgaatttgcagaacaaataaataaaatggaggctagg

SEQ ID NO: 3357 - DNA, 281 bp, Homo sapiens
  misc_feature (1)...(281): n = g, a, c or t
aaaatattttaatcaggcagagttttatggatagagaatagaagagaaaggtagtaaatattgaacatattccaatataggaacctatctctgtttttagtacaaaatatttctgacatctgaactagaggtcaagagaataaattcatttgtatacatctgagcaacctgtctttcagatgataaagtatctagccttttctgacaccataatagttcattttgtagggaataagccattaggngtatataattgctttctagaaatggacctaatgtcc

SEQ ID NO: 3358 - DNA, 292 bp, Homo sapiens
  misc_feature (1)...(292): n = g, a, c or t
ctggtggtgcctcagccatggcctggaccgttctcctcctcggcctcctctctcactgcacagactctgtgacctcctatgtgttgactcanacaccctcagtgtcagtggccccaggaaaagacggccaagattacctgtgggggaaacaatattgggagtaacaatgtacactggtattaccagaagccaggccangcccctgtcctaatcatctcttttgataacgaccggccctcagggatatctgancgattctctggcttnaattctggggacatggacctcngcn

SEQ ID NO: 3359 - DNA, 267 bp, Homo sapiens
  misc_feature (1)...(267): n = g, a, c or t
ngnaaaatagactcaggatttatttattttctttttagctttatagcaattaattggctattgattggttggaatgttcaactctccatttcctcaaatacaataaaatagtttcattaaaatgtattcatgcttgaaaagaagggcgccattaaatggtttcctttctgttccactccaagggaaatgcgccgtttgtaaatcaaaaatccatcatccaaaatcacttgttcttaatgatgcttttggagaagatgagggacgtgg

SEQ ID NO: 3360 - DNA, 462 bp, Homo sapiens; identical to SEQ ID NO: 16
  misc_feature (1)...(462): n = g, a, c or t

SEQ ID NO: 3361 - DNA, 235 bp, Homo sapiens
  misc_feature (1)...(235): n = g, a, c or t
gtctgcatggggggccacggatcagatacttagtcctattgcttatcctcaccaaagggtgtgccacccagggccacagtcatggaagaagaccatcccggtcctcacccataggcgccaagccctgttcatgatgggatcacagggcananatcaattcattttactccanaaactaaggccccacggggtgangctcttttgggnttctaagggaaatggacctctgncccca

SEQ ID NO: 3362 - DNA, 471 bp, Homo sapiens
  misc_feature (1)...(471): n = g, a, c or t
nccagcaggctgcggaggtaacgctcccgaagggcggctcgtgcccgctgctcctgggattccagggattcttgagctatgggacactcctggatttcaggaacctctggcctcaagggggctctgcgtccatcaggggcaaagccacggctgaagccatcagggccccggggcagccggagcacaggcacgggaatgttcactggagtttgcattgtcttggctcctccactgccagcatcctgctgcagccacagacacttcctgcctggagtactgtagtcaactcctcactgggtccctggcttccaccttcaccccccgccgtctgcaccccaacaccctgttaatgcctgagtcagatcatatccctcttctgctcggagccctcttgtggcttctgtcttactctggatcctgccggcaccctctggtgtaccacgcttgctcttcccaccccagccacacagg

SEQ ID NO: 3363 - DNA, 179 bp, Homo sapiens
  misc_feature (1)...(179): n = g, a, c or t
ccatcgtgtttgatggtaaggtttctcacaaagccgaaaatgtagctgaagatcaaaaaaatctcacaagaaggggagggagaagagattcgattctgagtctcctactcccgggttctgcgtagagaanccgactgctgctggaggtcggcaacncggccacaaccgctcagtcttcg

SEQ ID NO: 3364 - DNA, 246 bp, Homo sapiens
  misc_feature (1)...(246): n = g, a, c or t
ngtaaatatagtcattgatatactacaaattgtatttctctctctatgtttgcctataaaatttatttacttaatcaaaatggttgcctgatataatttcccctgcaaaagttgtcaaaagaataatgttattgccttaggcaggaactcaagcacaaagataaaaagctgtatctgagtatttgctgtattttatttgttcacatttagcctatttgaggttaacactacttcatttgacagttt

SEQ ID NO: 3365 - DNA, 383 bp, Homo sapiens
ctgagcacactgccacccagattaaaatctgggttatgtgaccaaggaaaaagaggagactggatattggataggcaactaacagtctctgccgcaccctacttaacaaactggcccagcttctgtgttcagatctgatgcttggtgcccgcagctccaaggagaccccatggttcaagctgcaattacttgctccacaggcccttaccaaggaaagtcaggttttttccctcctgaggatcctctgaccagcatcttcagattttttttcagttagaagtattcattgggcacctgttttttgtttgtttgtttgtttgtttatgaccacatcagtctttcattagaatctttgctttatctcattgcatagttgaatttct

SEQ ID NO: 3366 - DNA, 251 bp, Homo sapiens
  misc_feature (1)...(251): n = g, a, c or t
gggagatgccggcaccccccaaccctggggctgttccctggctcangatggtgtctcngggctaggattatggtcaggagtccatcggggcctcaagcacctcctgggaggaatcacccaccttgcccagatccctcaccccctcccagtgccaccctacggctgagtttccactctgcaaaccctaaggcagagacataagcccacagggttggttttcacgaatgtcacaagcccatgtgtctgggcag

SEQ ID NO: 3367 - DNA, 192 bp, Homo sapiens
ccacacctgctgctgccagggcagtggagtagggcgtgccaggatgagatggggcttgggccccttttaaggccaggggaaccctcccaggccccactatgggaagccagagggaacagtgaaggagcagagagggcgcccccaaaccaaaagcccagagagcaatgtccccaccaccaagggagtggggac

SEQ ID NO: 3368 - DNA, 303 bp, Homo sapiens
  misc_feature (1)...(303): n = g, a, c or t
nncaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcctatgtgtggtgtgtgtgtggggtggcctttgaggcgctcactcctgtgaggggaatggtcagtaccancccttgtcctctgcctgtggactganccctttattncctctcacacnaccctccgtgtgttagactcttgtccttctgt

SEQ ID NO: 3369 - DNA, 222 bp, Homo sapiens
  misc_feature (1)...(222): n = g, a, c or t
gaatcctttggtccacttctgctgactcaacccctgcccatgccaacaaaggagtactaagaaaggcaggttagcctgaatgtctaaattcaatttgttcaactttataaaagcaagcaaagctactgggggttgccccctcccaccatcattctggnccaccatttgggccacangcttagggaaatgaaggaaagtcgttttctttgaangaaatcctgg

SEQ ID NO: 3370 - DNA, 297 bp, Homo sapiens
  misc_feature (1)...(297): n = g, a, c or t
caaacttgatttgagagcaagtgcaagggagagaaaagaaaaatgttaagtgtaaatgtttttattttcctaaggaagaacacttgtaactgatggttacatacttgaggctaacatggaaacatatcatgtagctaaatcccatccagttttcctaaacttgancctggagcctgctgnggagtagaaacagtcccaccaganggtatagcaactcttctggcagtgcccaganaggcagaactgaatggagttcctgggggctgcatngccaactttggacctgcccnggcgggc

SEQ ID NO: 3371 - DNA, 236 bp, Homo sapiens
  misc_feature (1)...(236): n = g, a, c or t
caagtcctggcctgcagccactctggtggacttggctttgggtctggggtcttagtgtcttaggcttgagggagaggggcagtgaagaggtgccctcagcctccccattaccccgcctctcctccacagaacccacatcctaggctggcctaccacaagcaagggggctcaggaggggcccacgcggatgtgagggttcatgagtgggtccaggttgggatcgctgtcagacctcn

SEQ ID NO: 3372 - DNA, 292 bp, Homo sapiens
caagtaaacacttacagtgcacacatactacacacggtgcaggagtcttgtttcctcccatgaattcttgatatgtacttaccagtaggacagcttgaatttttactaatctgggcattgtgcatactttttgggtaatatataatttcagaaataaaggtgttacatttttcaggctagaacttggtaaatatgaaaccaccaaggtggtgaattactgtatgtaatctttttcctccaaaaaataagataactggtcttacacttaggttagcattatgattctaatttt

SEQ ID NO: 3373 - DNA, 246 bp, Homo sapiens
aaaccaaagatcatgtttagaacaatgaaaaattatttgttgtatctaatacacgcctgtattgtgaaaagcttcatttagcaatgatgtaataatttttaacttctaggaaataatctgtgaatggaaagattttttaagattttgagatagtgtttagtctcatgttgggaacacatgaatgtgatgaacatagtgaatactaaagaaaacgcttcagactttcagaatgatggttcagaattt

SEQ ID NO: 3374 - DNA, 338 bp, Homo sapiens
  misc_feature (1)...(338): n = g, a, c or t
ccatcctggctcctgtctcgtctggccttttgtttcctcatccctgcagtggggaccatgttccagtggggactgagggaggtggtgtgtacagtgttgtgtgcagagcctggcatggcagcgaccttcancanatggangtgctgtttggcatcacccgtttgcgtgcaagtgaccggcaggcttctgtcttctctgtaaatgaaggaggctgcaagggaagcaagggtccaggcttctgccttggacgcacaagccttggtccgcccttccttnttgaacttccccaagggctttggnaaggggtgcctgaaggggtaacnaggaatggggggcaa

SEQ ID NO: 3375 - DNA, 165 bp, Homo sapiens
  misc_feature (1)...(165): n = g, a, c or t
ctgcaggtcccaggagggcctgaggtcaaagctgtggaaggccctcttggtatcagggctctctccccatggcctcttccccacctctgattgctggttgtggccccataactcatcaccccttgtctccttgcttaaatgtgcanggcttaatgtggcacttga

SEQ ID NO: 3376 - DNA, 455 bp, Homo sapiens
  misc_feature (1)...(455): n = g, a, c or t
caagtcctcccaaagacancaatgggagaagtgaccccataactgcataaaataatccctcttctttgaagctcttggcaggaatcgctcagccagcaggaaacctttaacccaatacccagaaagacagacatttggaggaagagggatcttccagattattcttccattctgccccatcctctacagagaaggaaactaagacacttttcaagaatcacaanataagttaatgatanaaagcanagtanaatcttgagtggaggagtgaaaataacattcactttgttcaaatcccanctctaccactttccaatggtgtgaacttgcacaaataactctgagtctcattttcttcatttgnaaaatggagagaacaatctccgcttcaanagattgtcttaaatggaacatgcaaagcatcctgatatcgtttacccaaccacacatagcag

SEQ ID NO: 3377 - DNA, 207 bp, Homo sapiens; identical to SEQ ID NO: 17
  misc_feature (1)...(207): n = g, a, c or t

SEQ ID NO: 3378 - DNA, 237 bp, Homo sapiens
  misc_feature (1)...(237): n = g, a, c or t
caagtctgtgcgggtctggatagaggagaggtcaagggcttggactggggaccctgagctgccaaggtgtggggactccttgcagtcctggtgcagcaatggcaggaaggccagcaggggccctagttgagcaggttgccctgctcctgggcctgggtcangctgtccttgcggtgcaggtggtgaacccccatcctcttggggctgcnctgggggccgactgganctggggagtgg

SEQ ID NO: 3379 - DNA, 435 bp, Homo sapiens
  misc_feature (1)...(435): n = g, a, c or t
gcccnggcaagtaaagctcttaagttcagggtagcggtctcaaactgccaaacactaggatgaggatgtgactctgcatgtgttttggatgagaggaagcatcgtcccagtcacttttctcctcctgtgctgtcctttcaaaaacaggtctggatttcacgccctaccccaagaaaaagaactggttcagaaaacacttccccaagtttctccaacagaacactgtggctgcagggcctggtagtgtgaagggcagcaactgacatataaaaatgtacttaaaatcanagtcaaaaaatggntttaagttttaatactcttaattagctccctgctttatactgtaactccacagaagacatagggccacctaggattcacaggaaggagcagctctgattcttacatggctggctccgatgcccccacagcagg

SEQ ID NO: 3380 - DNA, 231 bp, Homo sapiens
aaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcattt

SEQ ID NO: 3381 - DNA, 186 bp, Homo sapiens
  misc_feature (1)...(186): n = g, a, c or t
tccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccanaggacccaccacgtcctcgcttcgac

SEQ ID NO: 3382 - DNA, 216 bp, Homo sapiens
aaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgatttt

SEQ ID NO: 3383 - DNA, 443 bp, Homo sapiens
  misc_feature (1)...(443): n = g, a, c or t
ngtctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcaccanagtgacgctgatggtttggggcaccagctatacatcagccccagtgccagaccttctattcattattttacgcctca

SEQ ID NO: 3384 - DNA, 388 bp, Homo sapiens; identical to SEQ ID NO: 287

SEQ ID NO: 3385 - DNA, 247 bp, Homo sapiens
  misc_feature (1)...(247): n = g, a, c or t
gaaaggattatgggaaagatggaagctgacccatacctatccaagntcctctaccancttcatgaaaccgagaaggangatctgatcccataggaaaggtccctgagagagcgagtgcntcagtntcgaatggacacanatctggaaaccatggatctcgaccanggtgganaggcactggctccacngcaggttctggacttggaggacctggtttttacccaagggagccactttatggacctcn

SEQ ID NO: 3386 - DNA, 146 bp, Homo sapiens
aagtccttactacgtgtcccacttcctccccgccctgctcacacctcgagtgctccccaaagtccctgactcccgtgtggcgtttatagagtctctgaagagagcagataaaatccccccatctctgtactccacctactgccagg

SEQ ID NO: 3387 - DNA, 415 bp, Homo sapiens
  misc_feature (1)...(415): n = g, a, c or t
ngtaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatccaaaaaaaaaaaaaaaaaaaaaaaaa

SEQ ID NO: 3388 - DNA, 294 bp, Homo sapiens; identical to SEQ ID NO: 18

SEQ ID NO: 3389 - DNA, 555 bp, Homo sapiens
  misc_feature (1)...(555): n = g, a, c or t
ctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacnactgtcatcttcccatttcagacagcaacatgtagaagatgttcagcgtgcaggggcttgctttcacaaacagtgcttccagtccttcgagtgcccccngtgtgcgaggatcacacgaggagaaaacttctggaaagtgtggcctctgcaannacatgatgcccctgagtactgtgaaaaaantgttcacatgccttatga

SEQ ID NO: 3390 - DNA, 255 bp, Homo sapiens
caaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttgg

SEQ ID NO: 3391 - DNA, 396 bp, Homo sapiens
  misc_feature (1)...(396): n = g, a, c or t
ngtaaatgtttctgccttgtttgtatctctcttgaaagactgtatataagtacaggcacagcatatatttgagagaacatctcacaaatttcatttactataggtttctcaataatctttacatttaatcaatgagaaaagtgattcagtctcttgaattttaagttaaaaaaattaaaaagtatttccagggactcttaaagctctctcccaaagtataaaatattatgtactttcaaaatcttaagcattcacgttctttctgagaccaacgcaggatacaaacttactctcaacatagatgcttatgtgcttttgggcacacatagtcttagaacagtggtcaaacagctcacaggaccctgtactcctcttcatcctggactgtgacggtgg

SEQ ID NO: 3392 - DNA, 188 bp, Homo sapiens
  misc_feature (1)...(188): n = g, a, c or t
agtctggcttttcanancagtgccagtgagaggcaccagtgtaacttgaagcangaatagtgatggctcaggtccccacangtagctcctccatacctgtgggactcaaaggctaanggcactaacttcatagggctcaaaggctggatgaanagaacaatcaatgtgttaaatgtcctttcgaccta

SEQ ID NO: 3393 - DNA, 307 bp, Homo sapiens
  misc_feature (1)...(307): n = g, a, c or t
ngtccattttttgtagaactgctcagtcatctgggggcttccaccccatgggcccacaattgcccaatcagtgggtggcagacatgggtgatgacacggaatgggtgaggcatctggggtacactgagtttcccgagtccctctttgccccccganccctggcaggcccctaagggcttgccccgcatcctccagtttgcagacaaggctgtacagatgcaactgagacacanatggggatccacatgggggggtcatggggtctttctgtctctcctcttccaacctgggggcaagtacaggcacg

SEQ ID NO: 3394 - DNA, 367 bp, Homo sapiens
ctgaaccgaaactagctacctgacgatatgaggcaaaagacaaggaagcaggactgtgagcgcgggcagtcggggtaagataggaaccaacggccggagccaaaataggaaaaaagctagaagtagatgtttcccatggactgactttcttaaatagtggttcagttgctgttggtttacatgactctgtccaacttaaatccaatagcttttccacacgtccacgttccaaatttgatgtgaaagctggtagtacacctaaggcatcctcttcaaaatcttcagaaacttctggctgagataattccatttttcttttggaaaatggaattttcctatgttttcgtttggataaacgtaattctgg

SEQ ID NO: 3395 - DNA, 467 bp, Homo sapiens
  misc_feature (1)...(467): n = g, a, c or t
ccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcantctgaaagagaaagtggagatccaaattttgcaatangatattacttaaaagaaaaagaantgttttccanaaggccagacatggttggt

SEQ ID NO: 3396 - DNA, 342 bp, Homo sapiens; identical to SEQ ID NO: 444
  misc_feature (1)...(342): n = g, a, c or t

SEQ ID NO: 3397 - DNA, 396 bp, Homo sapiens
  misc_feature (1)...(396): n = g, a, c or t
ngtaaaaaaaaacctaaatgatcaacagatgttgctttctatatttttcctttgttctgtttgaactgggctaagtaagcacagttagaccctgctgttcacttgaccacgtcctaaacccgggacaagtgagcactcattcatgcacagcagacccggaggcatgggctggggcagcacaactgggttcccgcagcgccctgcctgcaggctcatgctggaggccacggaaccaggcggcacagggcagattctgtttgtcaagcgccccacaagccttgcccagattgtcaagctcagcancgagaatggttttgacgaggaggatggaaacagcatctgctctggaagccgctctggcgtggggagagtggggagagggtgcccttgctgcan

SEQ ID NO: 3398 - DNA, 205 bp, Homo sapiens
  misc_feature (1)...(205): n = g, a, c or t
ngnaaaagatgctgcttccctgttttcttccaggaacacagagaccaacacggtttcaaacacagggcgagcttctcactatttcctgggaatgttacttctcagcccaacacttctcttcccaagaagttcaanttttgagactgtttttctccccggaacagtacttaaaaaaaaaaaaatcattgatnttcaaaaatgggtt

SEQ ID NO: 3399 - DNA, 376 bp, Homo sapiens
  misc_feature (1)...(376): n = g, a, c or t
gtccaccacatcaccccagagaaatttctggaatctgattgagtctccactccacgagcactcagggttccccagcagctcctgtgtgttgtgtgcaggatctgtttgcccactcggcccaggaggtcagcaagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactanacttgtagcaggacctgc

SEQ ID NO: 3400 - DNA, 339 bp, Homo sapiens
  misc_feature (1)...(339): n = g, a, c or t
ctgcgtctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataanaaatgtagctgaagtagagggggcgtgagagaagggccangccggcaggccaaccctcctccaatggaaattcccgtgttgcttcaaactgagacagatgggacttaacaggcaatggggnncacttccccctcttcagcat

SEQ ID NO: 3401 - DNA, 385 bp, Homo sapiens
  misc_feature (1)...(385): n = g, a, c or t
aacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctanttccattgctgtatatttgcctaaatggacttgtgttcaaattatttcttcaattgtcatagataatcctgtaccaaatggggaagaattaggaaanaatcatgntggctaaagggactctngattnaggggacgaactgncatttacct

SEQ ID NO: 3402 - DNA, 272 bp, Homo sapiens
  misc_feature (1)...(272): n = g, a, c or t
gtcctccttcctccactctctcaacccctctgttgggtaacatgaaaagactgtattcctctaagatgttgggattgatatacgtgatttaatctgcaataggtggaataaccaggggaactggttatgaatatgtgaatgcaccagcaaatttatccttgaaggngtgatggtagaaataggaaaacaacaaaagaaaaacaataacanaaaaanaaagtgtgatggctgggtgcaacggctcacacctgtcatcccagcactttgggagg

SEQ ID NO: 3403 - DNA, 459 bp, Homo sapiens
  misc_feature (1)...(459): n = g, a, c or t
aagtccatcgggagaagccggtccctgagacatgtggcgcttggaaggaacttcaacgtccggtgcaaggagaccctggacgacgtcctgcaccggattgtccagctcatgcaggacgacgattgtcctcttcagtctctgtcggtggctgagtctcggctgaagctgggtgccagcgtcctactccgggccctagccaccaatcctaacctgaccgcgctggatatcagcggcaacgccatgggggacgcgggcgccaagttgctggaaaacagtaacaaaaaacaccaccacacatggaaaaatccttgcaactaaacacagtggaccaacagagacaactctcacagtgtcttaaggtctgggaatctgggcatgctgcccacagcttgangagacatcttcaggtttaaggcaaagggaacagcctacaaaaagcacaaccaccanctaccccta

SEQ ID NO: 3404 - DNA, 153 bp, Homo sapiens
ccagcatcccatctgcaccgttggtcaggtcactggcagagaaccttgtgccgttagacgtggaacctgccgtcgtgatgaacacgcctccaacagttccctgagccatttctgtcacgtatggctccagagccttggggaccagacttctgg

SEQ ID NO: 3405 - DNA, 297 bp, Homo sapiens
  misc_feature (1)...(297): n = g, a, c or t
ngtctggcctgcagggaagggccagacggcacctctcagtggagactgaatcttccttccttcaggaggctgcctccagggaagacctggggtccttcctgcgctcagcgctggctggctgtcctgttcatgcagtggaagacattacagaagaattcatacgagaagaacatgaagcctgtggagagggcagccttcagcaagctgggggacaggcccttgaagaagcccagggcgccttccttttgcagcacctgcttggcacagtccatgaggcccttgtatctccgtacctgg

SEQ ID NO: 3406 - DNA, 477 bp, Homo sapiens
aaatcacttagtgcattaacaatgttacaaattccaataatgtcagacatatggatgatattcaaaataaagtacaaaaatacatttcaaaatcaaatataaatgactttatggttatctgccatgctcccctttaatttggcctgatagtctacatttgactgtaattataataacatctgtaatttcaagtacaatagtacaatcataataattttgaagaacgtatgacctaggaccccaaaatgcaatccaatatacaatttggagtatggtttactttttagtgaagtttaatactaattgaagtactaaattgaacaaggccagtactctgaagtactaatctcaagtatttgatcccatgtaagaaacagaagggaatttttaaggcaattttggtattccaaaatattggggatctaccttaattttctattattcccctcaagtctcaattgaatatttccatttttt

SEQ ID NO: 3407 - DNA, 197 bp, Homo sapiens; identical to SEQ ID NO: 19
  misc_feature (1)...(197): n = g, a, c or t

SEQ ID NO: 3408 - DNA, 252 bp, Homo sapiens
  misc_feature (1)...(252): n = g, a, c or t
ctgccacagactccaaaggnacacaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaacttttt

SEQ ID NO: 3409 - DNA, 356 bp, Homo sapiens
  misc_feature (1)...(356): n = g, a, c or t
aggtaaaagcacagagttctataataataggaaaatagagggaatgattgctcaacttttcttgaaaaagagtcaggaaaatattgaccgagaaggcagtcattgacctgagtcttaaagaatgaataaggtttttacagatggagtagggtagggataactttccaggtataaggaagattttgtattccanggacctttgaatattttagaatggctagaaaacttggtattatgtagcacagaaaaagtggtatgactgaagagatagagaacttaccacaaagggtcttgaatgccatgatacatagtttggattttcttctgtagggagcaaggagttagtgaaggatttt

SEQ ID NO: 3410 - DNA, 387 bp, Homo sapiens; identical to SEQ ID NO: 20

SEQ ID NO: 3411 - DNA, 235 bp, Homo sapiens
  misc_feature (1)...(235): n = g, a, c or t
ccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcctntgtgggaaagggggagaaacttttatatatttgtatgggactctnaggaggngcaacctgtatatatattgcttcntgcttgcttttttatcc

SEQ ID NO: 3412 - DNA, 444 bp, Homo sapiens
ctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctgg

SEQ ID NO: 3413 - DNA, 369 bp, Homo sapiens
aaatcctcaagtgttacaacagttagatagtaaacgacagcaggtccaaatgacagttacagagaccaaccaggagtggcaggtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtgg

SEQ ID NO: 3414 - DNA, 290 bp, Homo sapiens; identical to SEQ ID NO: 21
  misc_feature (1)...(290): n = g, a, c or t

SEQ ID NO: 3415 - DNA, 186 bp, Homo sapiens
ctgaatgaagaaaacctctctaccaaaacagaagcagtataggaccgacaagtgtacctctgcacccaatgctggaatcaaatccaaagcttttaattctctcaacaagatgtaaacaggaaagaaatctagttgagcatgaagataggatctaacagcttttccagttgttagatgactttgtgg

SEQ ID NO: 3416 - DNA, 148 bp, Homo sapiens; identical to SEQ ID NO: 22
  misc_feature (1)...(148): n = g, a, c or t

SEQ ID NO: 3417 - DNA, 373 bp, Homo sapiens
ctgtagcttctgtgggacttccactgctcaggcgtcaggctcagatagttgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggcctcatcgccggcttcgaccctgttgatggtcagggtgg

SEQ ID NO: 3418 - DNA, 148 bp, Homo sapiens
ctgtttccttcatcttctggaagaagtccttgttgcagagtccctcggttgcaggtgttaaggagcaggccacgacgatgaaatcagattgggcagccagctcaggggtagacacaaactctgcctggaattccgctgcttcctcagg

SEQ ID NO: 3419 - DNA, 533 bp, Homo sapiens
  misc_feature (1)...(533): n = g, a, c or t
ctgggtgtgttgccaagcgacatcaccatctcctctgcttaattctgcttccaaaataacttcagtggcaccagaaaaatcagcataggagtgaagactgttatcgcctgtcggttctacttgtgctgtatcagatcgcaatttccattctactgttccagtctgaaaagtttgactacttgttctaatagaaatgctatctacttttaggccaactgacccacactcaaacttccaggaaatataagcaaaagatgatccttcctttcgggccaaatataccatgtgccagtctgtttcaacttttctgaatatagattccattttccacacgccattctcccatccagaaatggtttgattgttatttgaaactcgaacataacgatctttcacaatattgtaacaaaggtggagctgtttagaaatcttctcattttcacanggaataaacaagggttcttttctctgtaggacccatttcaccttggggctactcttccaagccactggacccagatattcttccccca

SEQ ID NO: 3420 - DNA, 166 bp, Homo sapiens
  misc_feature (1)...(166): n = g, a, c or t
aaggccccatttctcctcaccacggggtcgcttgtcagctccangagccagtctggccccactgagaacttttcagtcgagggcctgatgagtcttgggaatgcgcttctgcaagagggcccaggctttctccacctggcgttgggtgatatgcggtcccacaagg

SEQ ID NO: 3421 - DNA, 152 bp, Homo sapiens
aggtctgctatttggcaatatgaatcactgaaatccagggtccagagttattttgatggtataaaagctgattggttggatagcataagaccacaaaaagaaggagacttcagaaaggagattaacaagtggtggaataacctaagtgatgg

SEQ ID NO: 3422 - DNA, 214 bp, Homo sapiens
ctggggctgctgcccacccaccctgcccaggctcctgaaggtggcctcaccttccaggtgcttgacaatgccccgcaggctgttcccgtgggctgcaatgagcactcgcttgccggccttgatctggggaacaatctcctcgttccagaagggcagggcccgggcaatggtgtccttgaggctctcgcaggtggggagttccccgggcttcagg

SEQ ID NO: 3423 - DNA, 253 bp, Homo sapiens
  misc_feature (1)...(253): n = g, a, c or t
cctggacctgggatgaagatgaatgaagaacatggactcatgtggatgtggtttggctcanatgnccctgcaataaacaaggggncagtacttagtccctgagtgtggttgaggtttgaggtcctggtcgagcanggcantactggaccangtctacgtcagcattcaggntcaatggggacaccagtggcttcaaacttcctgatctaattatgtttttagacacttagaagntattgaggactttacctgc

SEQ ID NO: 3424 - DNA, 251 bp, Homo sapiens
aaatgaaattcgaaaaccaaatagtaagaaatggaaagagatagttgtaagaatccatttaccaattttacagctaaaaattaaagtgaagtagaaatagcaaaagataacagacaaatatattattttaggtcattaatttatagtgccttatcatcttaagttataaatagaataaggattttgttatataaaaactatcaaaaaagtatcagtgaaaagacatgacctccatgaaatgtgctgagtgg

SEQ ID NO: 3425 - DNA, 153 bp, Homo sapiens
  misc_feature (1)...(153): n = g, a, c or t
aagtccttggagactcangagttttgagagcaaaatgacaacacccagaaattcagtaaatgggactttnccggcagagccaatgaaaggccctattgctatgcaatntggtccnaaaccactcttnaggaggatgtcttcactggtggcccc

SEQ ID NO: 3426 - DNA, 199 bp, Homo sapiens
ctgctgagcttggagcatggcgctgtcactgtagtcgatggctgagcggtagctgctccgcaggcagaagaaccggaagacatcgggggaaaaggtcttcagaaagtccttaatagtaatgtagttctttaatgatttggacattttttcttctttgctttggcgtgcaaatgccctgaaacaaaaacaaaagcattca

SEQ ID NO: 3427 - DNA, 313 bp, Homo sapiens
  misc_feature (1)...(313): n = g, a, c or t
ncaggtaaatgattctttatttcaataaactttaacaaacaatatataatatttcttccttaaaaagctcattcaaagatcataggcagacttcttccccattgtattttagttggggagataaaggcaaaaagaggaaatgtaagctatcttacagtcattctgagaacctctggtttcatgctatactttcccagctaaaagttactaatttacgaagttcagatactgaaacttaaaaatcaagatccatatattaggatgtcctgctgcacactggtggnggcccattgtgtcggagtctggnaaatgg

SEQ ID NO: 3428 - DNA, 352 bp, Homo sapiens
cttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaagagcaccctgtcttaattctccaagcggatgctccatttcaattgctttgggacttcttcttctttggtttttt

SEQ ID NO: 3429 - DNA, 345 bp, Homo sapiens
  misc_feature (1)...(345): n = g, a, c or t
ccccgttggtccgcgcgttgctgcgttgtgaggggtgtcagctcantgcatcccaggcagctcttagtgtggagcagtgaactgtgtgtggttccttctacttggggatcatgcagagagcttcgcgtctgaagagagagctgcacatgttagccacagagccacccccaggcatcacatgttggcaagataaagaccaaatggatgacctgcgagctcaaatattaggnggagccaacacaccttatgagaaaggngnttttaagctanaaagttatcatttctgagaggnncccatttgaacctcctcagatccatttctcctccaatttatcatccaacatt

SEQ ID NO: 3430 - DNA, 462 bp, Homo sapiens
  misc_feature (1)...(462): n = g, a, c or t
ctgaaaaactgtaaaagttacatacatacatacctaatggcactaggaatgtacaatatcaattattggaaaaataagtgagtgactcagagtcgtaagaaattatttaatattagtattttttcttttatagacaaacataacatacacatggtttctaccttctataagacaaagtagaaaactaaccgttactgcatttacctcaaacacagcactgactgtgccacagataacatggtccaaaatattcaattctatagataggccatggtattgaatgcatggttaagttttaggaaaggcatatatttcctgaagtatgtatgttaaatacncaaatatctataaataacaaaaagttaccagcaaaaatgtttaggttataacattcccaaacttcctaacattttaagngtttaagatatatgttgnctgaccagttcgttnggttacagtttt

SEQ ID NO: 3431 - DNA, 228 bp, Homo sapiens
ctgctttccggcaaagatcaacctctgctggtcaggaggaatgccttccttgtcctggatctttgctttgacgttctcgatggtgtcactgggctccacctcaagggtgatggtcttgccagtgagtgtcttcacgaagatttgcatcccacctctgagacggagcaccaggtgcagggtggactctttctggatgttgtagtcagacagggtgcgcccatcttccag

SEQ ID NO: 3432 - DNA, 429 bp, Homo sapiens
ctgagcatgctgagaaacaagctgttcggtacagatttccttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaaggtaactccctgaatcctgtggagctgctggatctagcccacattccaaatactggccttcccacgtccctccttccctacaccagaggcaactcctcagcttttgctacctttccattcctcctccagcgagagagccctcctggcaagttaccattctggacatggctggacaaaattctggagttggtacatgaccacctgaaggatctctggaatgatgggtaagg

SEQ ID NO: 3433 - DNA, 375 bp, Homo sapiens
  misc_feature (1)...(375): n = g, a, c or t
aaatatgtggaagagagcataacgaacgtctaggtgtttatcacttggcttaagcattatcagtttacctattgtattcatccatggatgtttcagaaggaaccaccatgtcatcatcacatagttacttaatatcaagtcgtcagtgttggaaccattctgatcgactaataaggtgttttgttctttggttcccttttcgcagttagttcaagtcaggatacacatcaagtcttttacctgcccgggcggcctcgagccctatagtgagtcgtattagaagggcgaattccagcacactgggggnncgttactagtggatccgagctcggtaccaagcttggcgtaatcatggtcatagctgttttcccgggn

SEQ ID NO: 3434 - DNA, 404 bp, Homo sapiens
  misc_feature (1)...(404): n = g, a, c or t
aaatttgtcttgtgagattttactatatctcagacagcataaatgctgttttagcactggattctttcactgagcacaaagagttgttggggctttagcatctgactgattttgttacggggttgattctgaccataggaantatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaangaaccagttgtaacagtctcaattttaactaaaacttgaagaactaaaacaacaatgcaaacctttcagcattggttgg

SEQ ID NO: 3435 - DNA, 393 bp, Homo sapiens
aaactcgccagtgagactgaggacaatgataacagtttgggtgagtgaaagagcgacggtcagggataagccaggcatttggatatgtgggtgggaactgtcacaacaggagtgagaagtctctctttcctgctccaggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccagg

SEQ ID NO: 3436 - DNA, 265 bp, Homo sapiens; identical to SEQ ID NO: 23
  misc_feature (1)...(265): n = g, a, c or t

SEQ ID NO: 3437 - DNA, 377 bp, Homo sapiens; identical to SEQ ID NO: 24

SEQ ID NO: 3438 - DNA, 399 bp, Homo sapiens
  misc_feature (1)...(399): n = g, a, c or t
aggtcatttctctcccacgcctagctacctccactccagttcagcacccagagacctcagactggatccactactggcccaagaatactgatgagaaacctagtctggattgggtcggaagctggaatttggtgctctgcagaccagtgctcaaaattgtggttatttttgaggactcgccttcaatccagaacatttgcgtttcaccttcctcgcccagatccagttaacaagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggngg

SEQ ID NO: 3439 - DNA, 183 bp, Homo sapiens
aaataacttacatacttttatccaggcaaaactgtctctgcttttcattaactctaattataaaataaatacagctccctattttgttttgctgttagtaattttttctgagaaaagtgttagggtacctgggtgccgctttgatgatgttgtccacacgcagaatcacctctgctgcttcag

SEQ ID NO: 3440 - DNA, 478 bp, Homo sapiens
  misc_feature (1)...(478): n = g, a, c or t
aaaaatgganagtctgaattttattagagctcacacaccatatattaacatatacaactgtgaaccagctaatccctctgagaaaaactccccatctacccaatactgttacagcatacaatctctgttcttggtaagtgttcttggtaagtgtgagattggatttctctccagggaggaaggatgacttgtttattatgagcatgaactctggatccagaccacctgagtttgctagttactgtctgtgtggctttgggaaagaattttaaccacactgtgcctcaatttcttcaactgtaaaatggggatggtaacactatttatctaatagggttgttctgaggaataaataagttaatatatacaaagcatttagaacagtgtttggtacacagaagtgctatataagcattggctttaacattaattattctcaacatcattaatggcattaatatttaccattatattaatg

SEQ ID NO: 3441 - DNA, 241 bp, Homo sapiens
ctgtcccctggtggcctgctgtgtggggtgggtgtggagggtgaggctgtgcagaatggtcctgccagccacagcagggccctggtggggatttgcactgggcactccaatcctggggaggatgccagggacggggatgctgaggaagtcagagagcttggtacggttgaagaaaactgagtcttgggcaatttgtgctaaaactaggtgagttgccaaacccaaggcatcttaccaacag

SEQ ID NO: 3442 - DNA, 269 bp, Homo sapiens
ggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcag

SEQ ID NO: 3443 - DNA, 433 bp, Homo sapiens; identical to SEQ ID NO: 26
  misc_feature (1)...(433): n = g, a, c or t

SEQ ID NO: 3444 - DNA, 362 bp, Homo sapiens
aaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaagaacagactattgaaataaaagaagaagtggttgggctaactgaaacatcttcccaaccaaagaatgaagaagacattgaaattattccaatcca

SEQ ID NO: 3445 - DNA, 419 bp, Homo sapiens; identical to SEQ ID NO: 27
  misc_feature (1)...(419): n = g, a, c or t

SEQ ID NO: 3446 - DNA, 288 bp, Homo sapiens
  misc_feature (1)...(288): n = g, a, c or t
ncaggtgggagggcggttgccgctgggcgcgacttggtgcgtttcgggcaggaccgactgactgtgtgtgcgcggagcagacgtgtcccgggccaggccgggccgtggaaggaggagaaggagagtcaaataaaataagaccaccccccaacaccaaaaaatggatagagttagtacgagaagtgcccagtgaagccaaatgacacgtcattttacagtgtgacctttttttccccttccagacttgcaggctttttcaaaagcagagcggagaattaattgtagcag

SEQ ID NO: 3447 - DNA, 210 bp, Homo sapiens
  misc_feature (1)...(210): n = g, a, c or t
cccagctacacaggaacctgaggcaggaggattgcttgagccccggaggttgaggggtgcattgagcagtggtcatgctccagcctgggcaacagacctgggtgagaaacccagaccctgtctccaaaaaaaaagctggcacttaatcacattagctataatnagcaangnctttagattctctgantcattctacaactttagncattc

SEQ ID NO: 3448 - DNA, 323 bp, Homo sapiens; identical to SEQ ID NO: 25

SEQ ID NO: 3449 - DNA, 207 bp, Homo sapiens
  misc_feature (1)...(207): n = g, a, c or t
ngtccacaggatcaaggactgtcagctttctaacccagagccagggatgtgatgtcccaattggtcccaagtccctcctacccgccgcctctgctccacctaagctccacacccactcctgaaccagccacctgtccaggaaatgaggcaccctaagcctatactagagctcctgatacctctgtggcactcgccagcctttaccag

SEQ ID NO: 3450 - DNA, 201 bp, Homo sapiens; identical to SEQ ID NO: 28
  misc_feature (1)...(201): n = g, a, c or t

SEQ ID NO: 3451 - DNA, 527 bp, Homo sapiens
  misc_feature (1)...(527): n = g, a, c or t
aaaaaggcggagatgactaatcaacaaagttcctaaccaacagcagcagccagttaatattaatatctcagtccagcatatctcatagaatccaatttacctcacaaattttaacagttctcatgttaaattcacaaatatttcagaaaagttctacataaaaatgttaacaatggttaactggggtgatgagatggaggggattggattttttccttcttaatctgtagttttccattttcagacatcatcccgcccctccgcgtatgtgctatctgtgtgaggaaatcctacacacggtcccattaccattcctcgttgggacgtcctcagacactggacacaccccatagtacaggggcggctccttagacgcagtcgctccagctctgtaggtgtcggtgtcactagggggcaccgagcaggtcttggatgtcacagcttcctcctctggaggattcaggcccacactgtaaccaaaatctntgtttcagaaaaaccagcctgatcagttgggttcccttcag

SEQ ID NO: 3452 - DNA, 422 bp, Homo sapiens
  misc_feature (1)...(422): n = g, a, c or t
tggtaagtggcttcgtggtctttatagctgttactcttttgtactttgtctttttcttttattttcttttgagcgattgtgcgaacatagcatagcacgcactatgccttctggggttggaactgcctggccagggcgactggcggataangtcttgtgcgtggnctcgaggcttaaaagtagcagtggggctttgtgaaggacaaaatggcgatggcgggcccgtgtaagtcccccttcctatgatgaggaccttttcacagacctgtactgagctccgtgaggataaataactctgaagagatgggccctgcaagcctcttgcttacccgctgttcanaaaatanccgttttcnaaatgccctgagttgacctaatgcttattgggctcctgtcttgcaggaatttacccccccctttgg

SEQ ID NO: 3453 - DNA, 426 bp, Homo sapiens
  misc_feature (1)...(426): n = g, a, c or t
ccaaatctcttcacatcctgttccatttctttttgcattcctgctaatgcttttactgtctaattaaaataattcactgtgatatcttgaatagagacaacagcttcttcanccccgtctgggtccattcttcagcttctttctccagggcaactatcctggagacgtaggacctacgtcatcctcatccaaggaattataaagttgcaacttctcgcatagccctaaatggctgcagtaagtactggaaaaacatggttgccatggtaactaattcctgggaggcttcatcttcctcttggtaaactttcattaatgctaccatggtgnttggcttttccatgncctttggataacctaaagagcaaaaggtgaataaaagcttaagtcagaacagngggaatacataccccnccaaccaaaact

SEQ ID NO: 3454 - DNA, 169 bp, Homo sapiens
ctagcattcacatggaacaaattgctgccgtgggaggatgacaaagaagcatgagtcaccctgctggataaacttagacttcaggctttatcatttttcaatctgttaatcataaatctggtcactgggatgttcaaccttaaactaagttttgaaagtaaggttattt

SEQ ID NO: 3455 - DNA, 313 bp, Homo sapiens
  misc_feature (1)...(313): n = g, a, c or t
ctgcggccagctagctggaggctcacgcatctccccagtcaccttcaacaggtacagcctgcggtcagacacaaccacaaggcacatgaactccccagtgtggcctgccaatgccactggcaccttgaggcagcactggaactcctcctgggcatcgctgaacacctcaacatccaggaagagccggagtcggtggtccacagagcggaggccacagcgctcaggggggggactgaggctccaactaccatggtcacgggtgctcggtgcctgaggtgggctgttcttggccctgtcaaggnggtcaccatgg

SEQ ID NO: 3456 - DNA, 278 bp, Homo sapiens
  misc_feature (1)...(278): n = g, a, c or t
taaagggaactgtcttctgtcgagaagtaaaggaaacttcatgaaggatgtagaagcttagctgcctcagagaagagagaacctgaagatctgaggcaagctggacaggaagaaggtggatatttgttgatggaagaattcaagtttataatcaattcccacttagcacctactgtgtgctaggaacttgaatgtgtatgtttgacaagtcctgcttggcctgatgggtgggagaaagaaccngacctggctganatggctaggcggagggcttttaa

SEQ ID NO: 3457 - DNA, 279 bp, Homo sapiens; identical to SEQ ID NO: 289
  misc_feature (1)...(279): n = g, a, c or t

SEQ ID NO: 3458 - DNA, 211 bp, Homo sapiens
ctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcag

SEQ ID NO: 3459 - DNA, 434 bp, Homo sapiens
  misc_feature (1)...(434): n = g, a, c or t
ncaggtaaatgtgcgtaatggatctgtgctttgggggagtttgaaatgaagtccagcctgataaagcatttgtttgttaccaccttcgtgatgttggccgatgaagtgaaaacttgctattgaaagaccagtcctctgtagacgagaccttttctaatgtactgaaggacggccaggactgatatccatattcagatgcaaatcgagcttttgggaaaactttccagttccagcaatcatgccagtacgagctctctgatgtttttcacatagagtgtcacatagtccttgatgtanattggccggtcagtgaaactgatatgataccaattcatcatcagcgcctcctcattttcattattgccactccntatgatgatagaaggatgagaattcagtctcttgactggtaggcacttctgctgtcactgaat

SEQ ID NO: 3460 - DNA, 371 bp, Homo sapiens
  misc_feature (1)...(371): n = g, a, c or t
aaaacaccctaggatgcnttgaatcaggcttgattttgttagttgagttacaggagaattttaagggtgagggtatgggggtcagggaagaaaaggaaatgggaaatggaccaaaaaaaatcttgagtcatcatctaaatcaacaaagcactgatagctccaaatattaggtcagacactaaaacgactgatataggctcaagtggtttataaaacctataaaaagactacaccagcaaagtccctgtcaatctgtcagagttcagaaactaaaacagggagtaacattttagcttaaaaccttatctcaagagaatcatatacacttcacatgaataaaaatacctgaaaccaaacatttttacctcngg

SEQ ID NO: 3461 - DNA, 363 bp, Homo sapiens
ctgagaatagtggacacagggtcccagaaacaaggctgcaaagcctaaatatcttgcagcctattggcccagctcagtgggtcccgctgctttagaagcctgcacccacccactcagtctggtgtgatctgagcccctgctacgtgctcagtctgcactagacagcaaaagcaatgcggtgaaaggtgtttgaggtttggagtgagacagacttgggctgaatcctgactctgcgacctaattggttatatgtccttgagcaacttatattaccaacctgagctctagttttaccatctgtaaaataaggatgatcacaggtttcttccagggtcataagggccaaacacacttggtagctca

SEQ ID NO: 3462 - DNA, 278 bp, Homo sapiens
aaaactttccttagataaggaatcatattgaagcccagaagcttttgcaagagtccattccaaagctgcaggtcatagattttgtattctaaacacagctcagtcaccaatcttactgccatggactcgtggctgtggtttttccacagacccttaatcattccttctttaggactgctgcaaaataattcatatgtgatggggatattcaaagtctcaaatgatgccagaaaagttatacatctcaaataagatttcacttcttcaatgggtttttt

SEQ ID NO: 3463 - DNA, 409 bp, Homo sapiens
  misc_feature (1)...(409): n = g, a, c or t
aaatggctttaggcttatagggggtgtaaactttaagaatataattctcccattcaagtttacagcaaacatctagccaccttcaaaacaaagaatatacagaccatcatttancaaatactaatacatgattttccttggggatggcaggtttgagaatcctttagcaacaggacataattcccctaaattacagtgaattatttataacgagataaagctttcaggtacaagctgaaggtggggtgtctaacaactaaaaactatcactaaatctcaaagagaaagttcttgcaaaatatgtaaaggtcacaaggngcagacattctccttctttaggcttttatctaaggaaaggctatgaaactgggcccatctgtatacangctcaaatttacctttttacctc

SEQ ID NO: 3464 - DNA, 283 bp, Homo sapiens
aaatatatgggaggatgtgcgtaggttgtatgaaaataccaagtcattttatatcagggacttgcgcacccacagattctggtatctgtggaagtcctcggccactcccccgtggagacaggacaactgtgtgttgacagaagtcacatgggagaatgctcatagcagcccccacgcagtgacacaacctggaacaccgcccagtctgaccagcacagaaaagcagcacctgctgaattcatgccacgggggactccacagcagccaaaagagtgggctgtgg

SEQ ID NO: 3465 - DNA, 307 bp, Homo sapiens
aaagggaagctgtggctgggctgtcctcttgtcccttttttctgtaacactcaaccatgcctgagctcttctggcagccccaaccatctgggtgatacacacacccagatgtctgtaaaatctctgttgtagacccaactaattctaaagctgggactcagtgattaatataatgggtgaacaatcgaaatatagaaacatgggaacaacaaaaatgaagagaaggaggatttgcagattatatgttgacatgttgaagaatgaataaagttaatggggaaaacttgtgagatctgagatgaaattt

SEQ ID NO: 3466 - DNA, 235 bp, Homo sapiens; identical to SEQ ID NO: 290
  misc_feature (1)...(235): n = g, a, c or t

SEQ ID NO: 3467 - DNA, 208 bp, Homo sapiens
gcgagagccactcaccactctacatgcaccccccgaagtgcacgtcctgcggctctcagtccccacagcatgcagagatgtgcctccacaccgctggccccacgttcccttgaggagatgggagagacccagtctgagtactcagattctagctgtgagaacggggccttcttctgcaatgagtgtgactgccgcttctctgaggagg

SEQ ID NO: 3468 - DNA, 340 bp, Homo sapiens
cctcgtccagccgcacacggcgactctgcatgaggtatgccagacagatggtggcagagcgcgagatacccgcctggcagtgcaccagcacccggcctccgctgttctttacccagtctgcaagggagatgggggagtggtgtcagacggaatgtgcacagcccaggagacaggtgcccccagtcctctcctctggagcccctcgggatttctgggcagaggtgcccccttaccaatgaagcctatggcctcctggaaccaggcactgatctccaccatctggttgtcctccacagggatactcttgtagcggaaaaggccctcaaagtggttggggcag

SEQ ID NO: 3469 - DNA, 154 bp, Homo sapiens
ctgcattctattccactccagtgcctgggccagttagcaccagtgtggaagacagtgagctggctccggacaacagggatggaggaaaggtcccacattcacattcctgatacgtggacaaggtgaggggccgcaatcgctctggcagcatttt

SEQ ID NO: 3470 - DNA, 482 bp, Homo sapiens
  misc_feature (1)...(482): n = g, a, c or t
aaaacaagcaagcttaattcagtcaggcatatattgcaaataaaaacatgtttccaagtaggctggaataaaaatgctaaataagaactgggccaaaagatcatagataatgggcttcttctcttggtaatatgtgaatacatttacccatggggtagaagtatttcacctgccccatgaagaacctgatggcttgtggtgtctgtgctgtgtcaatactaacagatgtgaggagacagactatggaatggacgctgtggctatctgtgagatagtggaaggggttatacacactggccacaggaagttgcaaaaattagatggactctgtgtagctagccactcttgagtgtcaggnctgcatatgtgagttttaaagaaggngcaagatagcaataaattcccttaaagagcangatatgtcctggnagctctatagttncatgatcaangacctggacctgcccgggcgggcgctcnaa

SEQ ID NO: 3471 - DNA, 258 bp, Homo sapiens
ccatcatatagcccatggtggagttgtcccgaagtgcctgggctttcatgatccgctccatattggctgtccagccgtaggtgctggtcacaatgcagcaaggtgaagacacaaagtctattggagattgtcacctgtggacgatcacaaaagccttagattgacattaccactttgaaagagaaaacaggcattgtcaagcctaattccagcagggggaggaggtggacagaccacttgagtttgagaccatgctgg

SEQ ID NO: 3472 - DNA, 184 bp, Homo sapiens
aaaacaacaattaagtggattatgggaacaggaaaaccatcttactttggttccaggatatactggtaatatagctaaggatgtagatgcttatttattacagttacattgagaagatttcatctactaaagagcatttggtttttcaaaacatccctgaactgtataatttacaaaaaaaaaa

SEQ ID NO: 3473 - DNA, 364 bp, Homo sapiens
  misc_feature (1)...(364): n = g, a, c or t
aaagtaaaaacataaggcttttaatcaaacaaattcatagttagttgttctctaagccatcttggtattccaggcacagtcatatctggagagacaactgctaaatagccagagccctgaaatgttcaccctactcaatgcctggttttcttttctccctttacctgataatgagcctgggcttgctgtgcagagttcaaggtgacattgcagagtttgcagtacaggggcttacatagctcctccagggcacagtcttgctcccctcccttcgataactcttcttcccctgcaggaggcaaggaagcctcctgcccaaaangcttctgtggtggaagctgcaagggtcctgtagacctggtgg

SEQ ID NO: 3474 - DNA, 484 bp, Homo sapiens
ctgaacgccagtttgctgctcgatatggcaaacctatattagcaagtagggatgctcgaagctccagtcgagagcaagaagcaggtgttcttgctatggatgcgctgccccgccaagtactaccgtttcttttgagaagaatgaaagaagatgttttgcaggatcttccacctaaaattatttaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagt

SEQ ID NO: 3475 - DNA, 441 bp, Homo sapiens
gcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcacgccctacgttggtcaagcagacggcttagtctggggctcatctaaactagttccagtgggacacggaattaagaaacttcaaatacagtgtgtagttgaagatgataaagttggaacagatatgctggaggagcagatcactgcttttgaggactatgtgcagtccatggatgtgactgctttcaacaagatctaaaatccatcctggatcatggcattt

SEQ ID NO: 3476 - DNA, 348 bp, Homo sapiens
  misc_feature (1)...(348): n = g, a, c or t
aaaaaatgggaaattttaatattaagtatgtccatgattgaaagaatcattccagaaatggcagcaaagaggctcaatgaattcattatcatttttcctttgaccaaacactttccttggagtttttctccgttgctgccaggagtgatccggaaataatatacataatgcctccccagagagggtaccacacagtcacacagatgggtgcatagatccctgctgggatcatcagaanaccccccanggcaatgtggaagagcccattcatagtctggacagcccccaaagtcttagattccctcatgaaaaagctttgcgggggcccnccagtgaagacatcctcct

SEQ ID NO: 3477 - DNA, 412 bp, Homo sapiens
ccgctgacacatgtgtctatgtatgctaattggaagctccccaatacatgtctatgacaaaacttttacacaaccaatcaacatttgacattttttacatcctcttcctctcatgaattatattccattttcaagaaaataatagttatcctttgaaaaggcaaaacgctcaagccactgaaaaacagtatctaaatttctgtaaagtgcaaaaatactaaggtggggggcaattattatattctgacaaataaatattctgaacttttcaacatgaccctttggcactagtggtttgggagccctgacattcgcctggtgtcagttcagcatcagggttgagctgcttggaagcaggaagttcagcgtcatttattacaaatccagtgcaacagaatccacgtgtttcaca

SEQ ID NO: 3478 - DNA, 408 bp, Homo sapiens
  misc_feature (1)...(408): n = g, a, c or t
ctgcatttcacatgccttgcaatggatcagccaaggccgagaccccatcttccagccacctagtcccccaaagggcctcctcacccaccctgtggctcacagtggggccaagcatactccgtgaggctgctgccatccatgtgctagtcactggcagcctgcacctggtgggtggtgtcctgaagctgctggagcccgcactgtcccagtagccaaggcccggggttggaggtgggagcttgccacacctgcctgcgttctccccatgaacttacatactaggtgccttttgtttttggctttcctggttctgtctagactggcctangggccacggctttgggatgggaggccgggagaagatgtcttttttaaggctctgtgccttggctctccttcctcctggct

SEQ ID NO: 3479 - DNA, 392 bp, Homo sapiens
  misc_feature (1)...(392): n = g, a, c or t
gtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcanagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctattt

SEQ ID NO: 3480 - DNA, 437 bp, Homo sapiens
cctggccctgaagcaggtgggtggcagagacccagagtgggcagtatggcagttccttggttccttttctggcatcttcccacagccgggacatcttgggtagcagagatgatgtgcgggctgagcaactcctcacatagagtcaaggcatcttgggctctgcctgcctggatcagtgctaccgctgcctccaaaaacacctcaggcatacagggccccttggctccgagctatccagcaacagggccagcaggtccaagtaatgctctgcagcgtctcctgccctccccgtctgtaggcacctgcttgctaatatgtgcttggtctggctctgagtgccacaatgaaagggtgaggctaggtcaagtggtggcagtagtaattctacctcaaatgagaaactgcggggctttggaacttgcatgggacattcaagg

SEQ ID NO: 3481 - DNA, 292 bp, Homo sapiens; identical to SEQ ID NO: 29

SEQ ID NO: 3482 - DNA, 381 bp, Homo sapiens
ccttatatttgtacctgtataaataccatatcacagcacaaaaacataccccatctggctctcttaaggtacatgataaatcagactaatgcacattcatcaaagtgggatcatctcaggatatgtgcatatttgacgtgggtatgaattcagggtttccttgggtctctttcaaggactctcctttctcgtcggtatttctatttccttattttccttctgtttatgaagaactgttatttttatatttaatgcccaattttcactacttgttcatgtcagttctctgaaatgttactgcctatgaaccgtgacatgtactctttataacagaaccagaagttaaaagatgtagacatcacacaaatcaatgattatttt

SEQ ID NO: 3483 - DNA, 318 bp, Homo sapiens; identical to SEQ ID NO: 291
  misc_feature (1)...(318): n = g, a, c or t

SEQ ID NO: 3484 - DNA, 265 bp, Homo sapiens
  misc_feature (1)...(265): n = g, a, c or t
cgaatagagctcttggaagtccctccaaccatggcctgggtctccttctacctactgcccttcattttctccacaggtctctgtgctctgcctgtgctgactcancccccgtcttacatctgccttgctgggagcctngatcaagctcacctgcaccctaagcagtgaacacaacacttacaccatcgatcggactttctgttgtttttgnttgtttctgtatcttgtctcaacttgtggtcagcctttctccctgcatcccang

SEQ ID NO: 3485 - DNA, 326 bp, Homo sapiens
ccttcctttcacacacatcagaaatagggaacccaagacctcgagagaggaaatgggcccagggacatgccttggcttggggtggcttaggaccagggcaagacgcctgaccccagagcagaccatgctgacactgggcaacacattccctgctctggacctcagttcctttggctactaaggaggcccaacgatcctcgcctgtgtgggacggggctacctgcagacatagagggcctttgagcacctcgtagcttgcttcccagccagcctgggtgtggaaatggccgtgctgacaggctctctgcgatagggcccagccatgg

SEQ ID NO: 3486 - DNA, 283 bp, Homo sapiens
aaacatgacttggtgctgaaagacacactgctgggacccaagttccctcccacatggacgggatggaggctggagcccaaggtttcagggaaacgtatgtggcctgtgcccctgggtgtgatcatgggcacacacatttatctggcagggccagccttggctgctgaggggtcatgggcacagaggaggaccatctggtgacactgaggaccagtgttgcccacagccagggagaataaggatgaagaatgagtgttgccacacccctccagatgagctcaag

SEQ ID NO: 3487 - DNA, 445 bp, Homo sapiens; identical to SEQ ID NO: 616

SEQ ID NO: 3488 - DNA, 411 bp, Homo sapiens
  misc_feature (1)...(411): n = g, a, c or t
ctgatcaggagcccagatgccagggtggattttctcagtgggatctagtattgctagaagagccttccttacatggcagaaacaggcacatgggcctcttcccttaaaatgcatctgtctcacatgcttggggactgctgtgcgggaacacctggtgtggcctggcgaggcagcgtatacatggcccccaaaaactggtctgcaattcttcccgcttcttgcagcccactcagcagagcaccatgcactgtggctgggtagttacggatcgtatgttctcccgcaaagaagagtcgtggaatcggctgtggggcacctggaatcgaggggccaggagtgattggctgagccattaaatcatagtcattttccagatgatccttgcagcaacnttaggaataagagccccga

SEQ ID NO: 3489 - DNA, 281 bp, Homo sapiens
ccaaaactgcgaagagatgcagaataatgttgacaataataagttgctgaatcgtcaggctgcagactggtgatggttaaattgaattgtgtcccagatccactgccagtaaatcttaatgagaccccttcttctaaactggaagtcgcataaattaggacattaggggctttgcctggtttctgttgatgccaggccaaccaccgatctatattctgagaggcccgacaacttattgtaactgtatctccgacagatgcagacagggtggaaggagattg

SEQ ID NO: 3490 - DNA, 216 bp, Homo sapiens
aaaatcataaatatttggtttcccctcaacatagcacatcacaaaaatacatttcaaaaacttttttcatatataattcctgtaaatgatcatatccctacttattaaggaaaacacctgatgacaagcactcaaacactcttgaaattttctgtacagtaattacaaaagtaaaaccaagagttctgttggccctttaacaggtgaaaccatttt

SEQ ID NO: 3491 - DNA, 376 bp, Homo sapiens
  misc_feature (1)...(376): n = g, a, c or t
ctgtcccttacaaaggatactgtgcgtggagtcctggcatggttcctggcacataggccccagcacgaggagaccgtttctgttactgctttaggagtgcataggggagtcaggctttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggacaaaaggnccctacattananactatcctgaggncccttttactttgganccaaaanccttatttnaaatggggggaaaaagggganntggaa

SEQ ID NO: 3492 - DNA, 454 bp, Homo sapiens; identical to SEQ ID NO: 31
  misc_feature (1)...(454): n = g, a, c or t

SEQ ID NO: 3493 - DNA, 240 bp, Homo sapiens
aaagcgggctgcatgtgtctgcatgctcagattagaaactgtgtatcttgaagtgtcttgaagctgattttctataaatgggcatttgggaaaatgtctcaggtgttctgacatagcattatccttcggttcccaattgctcaattttccaccacaggcaaagcaagccactctgtctccaggtcctatgtagtaaaagcctgcttttgccagatctgttggcgacagaaaagtcaatgg

SEQ ID NO: 3494 - DNA, 250 bp, Homo sapiens
  misc_feature (1)...(250): n = g, a, c or t
ctgcctctgttaccttgactgtctcagatttcgttgacccgagacgggtcctggcactaggaatgaaagactgtctctattattttggtttgctccaggttaggganaancccacgcaaggctcctactgaccatatgtttcatttctagctttgctgtctgggcaccaatttccctaggnttaactaattgctcaatgttaaggcagctctggggaaattcgtcttgtgtaactggggtgctatgcagg

SEQ ID NO: 3495 - DNA, 178 bp, Homo sapiens
ggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacagg

SEQ ID NO: 3496 - DNA, 191 bp, Homo sapiens
aaaaatacagttccccaggttgaggtatgtggtggcctgttgtcacggcagcatgagcacggcggcgcccagggcgggggcggaagggcctagctggagactgccatcacgtagttcttggaggggctgctccggcccagcagcacttggttcttgcaggtgaggagcccacaggaggcggccagtggggc

SEQ ID NO: 3497 - DNA, 417 bp, Homo sapiens; identical to SEQ ID NO: 30
  misc_feature (1)...(417): n = g, a, c or t

SEQ ID NO: 3498 - DNA, 219 bp, Homo sapiens
ctgtcacctctggggtgtggcttcttcccggaaccgcaccagaggcccctggagcccagggagggaccacggagggcaggtgtaacccctggcctggagcacagctctcagagccctgaggctcccggggacagaaacaagtaacaaagtgagaccacgagagaaaaagaatccacagtttctacaaaaagccccaccctccccaagcaccctggtcag

SEQ ID NO: 3499 - DNA, 476 bp, Homo sapiens
  misc_feature (1)...(476): n = g, a, c or t
aaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctngaa

SEQ ID NO: 3500 - DNA, 383 bp, Homo sapiens; identical to SEQ ID NO: 33
  misc_feature (1)...(383): n = g, a, c or t

SEQ ID NO: 3501 - DNA, 312 bp, Homo sapiens
  misc_feature (1)...(312): n = g, a, c or t
aaccanaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtcttt

SEQ ID NO: 3502 - DNA, 232 bp, Homo sapiens
aaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttagg

SEQ ID NO: 3503 - DNA, 423 bp, Homo sapiens
  misc_feature (1)...(423): n = g, a, c or t
cgacaccgtaactatccgcactanaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtgg

SEQ ID NO: 3504 - DNA, 184 bp, Homo sapiens
ctgatgcctcactactagatgcagtgctgggaccttcctcttttggagctgtcccatgtacagtggacccaagctcaggaccttcgtggagctgcttctccaacctgagaaacttcaagacccatcctcccgctgtcactttggacaatggaaatctacattttcttttccctttttttttttt

SEQ ID NO: 3505 - DNA, 430 bp, Homo sapiens
aaatcattcattcaatagataccaccgtgtgacctataattttgcaaatctgttacctctgacatcaagtgtaattagcttttggagagtgggctgacatcaagtgtaattagcttttgggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaagggattttt

SEQ ID NO: 3506 - DNA, 324 bp, Homo sapiens
  misc_feature (1)...(324): n = g, a, c or t
ctgtgggaggctgaaaaggtcaaaatgcggcaaatcctggacaaacagcagaagcagatggtggaggactaccagtggctcaggcaggaggagaagtccctggtgagcaccccaggaaggatgtcggtgccctgcacccatctgtgtcctcttccacctccccaggtggctggggcaagggtcccctgcattcttggtgctttcagctccagaattcttagtccttcactcttgtttcttcctctgcaggaccccatggtttatatgaatgataagtccccattggtgagttgccaggagaggccgcctcctccatgccaagng

SEQ ID NO: 3507 - DNA, 240 bp, Homo sapiens; identical to SEQ ID NO: 617

SEQ ID NO: 3508 - DNA, 198 bp, Homo sapiens
aacctaccaatctaaagaaaactttgaaaactgaactgtgtaacgtggaacaacacgtcgaactctccgaggtgatcgctctcgctctcttcgtggagatctttcccgggaacgtttcctctgaggtgatctttctctcgatctacgtctttctctctctctctcacgacttcgatcatcttttctgcaagagcactt

SEQ ID NO: 3509 - DNA, 482 bp, Homo sapiens; identical to SEQ ID NO: 32

SEQ ID NO: 3510 - DNA, 339 bp, Homo sapiens
  misc_feature (1)...(339): n = g, a, c or t
ctgctgcccctcagtcttctttccttctccttttcttttcctttcttctctcttgtgcattcttcaggtcagtcatcacattcaaagtcttccatacccacataaccacaatgatcatggcattcaccancagtggggctgaaaatactatagaaatgaacatccccctggagtcgaaatactggtatttcgaaaataatctccagttcatcgcagccgcctcattgatgtattcagcacagtagactaagatgactagacacagaaagtgcccgatctgtagtctgtagcttcgggaggacaagcaggtgaggagcacgcanagcgcgtggaaggtgg

SEQ ID NO: 3511 - DNA, 184 bp, Homo sapiens
aaattcacaaaaaactgtacattatcaaaaagtcactaaaacaccacatttggttatataaaaagtcccttttgctgtaaaaggaacacagaaacttgttggtgttgatggtgtggtttcttcctgtcaaccagactgatgggagggaagcaaaagggcagggggtgggttgtctttttatttt

SEQ ID NO: 3512 - DNA, 381 bp, Homo sapiens; identical to SEQ ID NO: 292
  misc_feature (1)...(381): n = g, a, c or t

SEQ ID NO: 3513 - DNA, 323 bp, Homo sapiens
ctgggtcttgacgctgttcatcagagccagggcggaggacgcagcctccggaggctcctcgaagtttctccgagaggggctcagactgtaaaagatctgtgggtctaggtggggtgcctcatcgaagggaatggagatctcgaaggtctcatcgtccttcattgtccgcctccgactgctccggtcattcatggcgcggcttcctgcggaccccagcagccgagggcctcaggggcactgcaaaatggggaaattacaagcccttctaaatttattgtgaggatgcagtgatgcgacacacagaagctcagcccagcacctgg

SEQ ID NO: 3514 - DNA, 406 bp, Homo sapiens
  misc_feature (1)...(406): n = g, a, c or t
ctgtggtcaagtacacggatatgcatgtacaaggatatttattggtgttgcatataatgataaattattgagagttttctaaatgtacattttcctccttctggtagccatcttctctacgaagagtgactattgcctctttacccanaaatattggaaatgcaggaatggtaagacaattcctaagtgttcttagtcaaaggtaaattcattttcatatgacagaaaatataaacgtatattttatcatttcttttaacatttgaacttctactaaaggtggctgggatggaaaataatgatcgattcagtagaaggtcaagcangttggtaaagtgtaattttatggttcctctntgggaaccttactattttatacttggggctaaccttaaatgagtgctca

SEQ ID NO: 3515 - DNA, 190 bp, Homo sapiens
aaagtagtcttccgtggttgggaagcctcacctcccaagaccagagtcagttggagctggttgttgttggaagggagtgggttggggaactggggtgggggcagggagatccccccgctctgctggcggtcctaggtggagaagaactgcacttcacagagtctggggtttggtgggaaggggatgatgt

SEQ ID NO: 3516 - DNA, 329 bp, Homo sapiens
cctccgtgcatgatcagcactttgccgttgatgcactgggccaacgggagccactcgaacacctcgctaaagagctcgtacatctgggctgtgtacttggccttcacctcaccctcgaaaccgtagatctggttcatgttgtctgtctcgtggttgcctcgaaggaggtgaaagtgatctgggtacaggagcttgaagccgaaaagggtgaggatcacttctacagagaaggagcctcggtccacaaagtcaccattaaatatataggggttggtctccgagggtaaaccgttgagctcgaatatgttgaggaggtcatagaactggcc

SEQ ID NO: 3517 - DNA, 246 bp, Homo sapiens; identical to SEQ ID NO: 34

SEQ ID NO: 3518 - DNA, 515 bp, Homo sapiens
  misc_feature (1)...(515): n = g, a, c or t
cctacaaccctggatgcttgggttacttaagcgctcctccctcccaccagatccctgcctccagtgtccctcccactccaacgcatcctaccaggctcctttaagcctactgtcatgacattgctaacagctaacagcataacctgttctccaactccctatggtcagggcactcaccatcctttgcaacctggacccaccttatttgtccaatcataccaggaccttcaggtcccacattccctactctttagtttccgctggacagaaaactctcctcactatcccacaaatggaccgtacttgtgttaagctttgagtgacagcctctgtatttcctccctcccagcacataacatgtggtcctccaattctncagtattntataattttacccacctctcaaagcctacctcttaaaagtatcttctctatgaaacctcctcctgntactctaagtnttttcttacattccttctggcgcttacaggttgcattggnatnacccccgcccc

SEQ ID NO: 3519 - DNA, 315 bp, Homo sapiens
  misc_feature (1)...(315): n = g, a, c or t
tcgangtccaccactggatttctgattaagtcactgactaactctaaccaccactggaagtaccattcaacttctggacaacctctggttgtgtaaaataactcaatttantaatagcttaaacattaangttatctattattnngcaactnaaaggcatcatgattcagaaaatatattgcntgaatatcataaccagaccaaaactaacaaaagaaataatnttttgcaatatganaataatatttacaanaccaaaaacaanaacaaagtttttgctctttttanatttnnccctacaggaacttctgtgtg

SEQ ID NO: 3520 - DNA, 155 bp, Homo sapiens
ggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttattt

SEQ ID NO: 3521 - DNA, 309 bp, Homo sapiens
  misc_feature (1)...(309): n = g, a, c or t
ccatttaccagactccgacacaatgggccaccaccagtgtgacagcaggacatcctaatatatggatcttgatttttaagtttcagtatctgaacttcgtaaattaagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaanaatcattt

SEQ ID NO: 3522 - DNA, 273 bp, Homo sapiens
ctgcatctcctgccctgctgtcattacagggatgggcaggctggcatgggggcacccgctgcccctgcctgggtgttgctgtgtattcctgccggccaggggccactgccaggaccacgcctcccttttcatatcccgattcttaagttctgctattgtggtattctggtggagaaaaaagaaccgcgtggctgttttcgaactgcctggaacctaagaccctgaattcttttcccccccaaggggaaaatctatatggaaaacatttatttt

SEQ ID NO: 3523 - DNA, 301 bp, Homo sapiens
  misc_feature (1)...(301): n = g, a, c or t
ccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtnatttttaccaactgtgtaaaggatgaaaatgtcaagcagatcatnccgntggtcacttgancttgatctgggagaaagccacc

SEQ ID NO: 3524 - DNA, 306 bp, Homo sapiens
  misc_feature (1)...(306): n = g, a, c or t
aaaaattcttggtagttgagcagctctgggggaataagggcaaatatgcttgttatgaactacactgaaatctaccaaagttaatgtttactttgtgtagatccatttgtctattttatttatttttcccagtgaaaagtgtatttggatagagaacttttcattctataaatacactatgagntactaaaatatcatggattttgtttattcctgaaacatagttacatagttaaactgtacatatgacatggcttatgttaaaaatacccagtgctcagttttgaaagataggccaaaaaaaaa

SEQ ID NO: 3525 - DNA, 421 bp, Homo sapiens
  misc_feature (1)...(421): n = g, a, c or t
ctgcctcctctttctcccagagtctgagccgaaactacagtccagaggtatagccaggccctgggtcccgtaggcacagaccgttatcattattcagagtatgcagcagcttcagggcagtgtgctantcaagcagagcctagcctgtatttcatagaaacagaactcactttaactgaattattattttttctttatagagtgcaggatgtttttgttgttaacacaggcgtctttctcaggtccgtttgaatcctgaggagtgtgccnatgttttaaggcggngggttgaccacctttgttctncacaagtnaatcanaaatcaaaggctctcctggttctcctctctctgggctggttttttagcgaggcngnagacgcttcacangtaaaccgagagttcacatgggnttgctcang

SEQ ID NO: 3526 - DNA, 140 bp, Homo sapiens
aaacctgagactaacttaaacacttccttgaccttcttgttgcctgttcatttttgtgccaaggaagtagctgccccagtgtatgtcttgccttctccgcgtcattgttggaagaggagagatgcatcgagcagtcccag

SEQ ID NO: 3527 - DNA, 511 bp, Homo sapiens
  misc_feature (1)...(511): n = g, a, c or t
ccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttacctgcccgggcggcctcnaaggcgaattccacacacttggcgnccgtcta

SEQ ID NO: 3528 - DNA, 513 bp, Homo sapiens
  misc_feature (1)...(513): n = g, a, c or t
tatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgaggccctgctgtcccagaaccagggaggcaagaccttcattgtgggagaccagaatctcctttcctgactaccaacctgcttggactttgctgctgaatccattaaggtcctaaccccctggnttgccttggatgccntttcc

SEQ ID NO: 3529 - DNA, 238 bp, Homo sapiens
  misc_feature (1)...(238): n = g, a, c or t
aaattttgaacttgtttcaatcaagttgtagccaaaacaaaaaggtcataattactgtgctcatataagagatgtgacgagggaaggagggagggagaaatgcangaaaggagtggggagaggaggaagggaggaanagagggaggaaagagtaaggtacacatcangttaaaaggggcagaattangaataaaactaagcacttaatctaatctgatcaggaagaaactctgccctt

SEQ ID NO: 3530 - DNA, 519 bp, Homo sapiens
aaaataaataattcagtatgttttattatactcagttgtgcaaccatcaccactacagaacatttttaccaccccaaaaagaaaccgtatactgactagtgctcattccccctgtcccatccttagcagtcaccagtctgtactttctgtctccatggatttgcatattctggacacttcctaaaaatggaatcatgtaattcgtggcctttcgtatttggtttctttcactccgcatgttttcaaggttcatctatactgcagtatgtatgaatacttcattcctttttattgccaagtaacatcctactgtatgaatgaatgcacactctttatccattcattaactgatggacactttgggttgtttccccttttaggctattataagtaatgctatgaacatttgtgttttttgtgggattatatagctaggagtgaaattgctgggtcatagggtaactctatatgaccttttggtaaccttctgaggaactgctagattgttttccaaagcag

SEQ ID NO: 3531 - DNA, 379 bp, Homo sapiens
  misc_feature (1)...(379): n = g, a, c or t
aaaagctaggaatggggctggttatggtggctcgtgcctgtaatcccagcactttgggaggccagggcagaaggattgcttgagcccaggattttgagatcagcgtgggcaatgtagtgagaccccgcctcttaaaaaataaaataaaagctagggacagaagaatggactaaaattgaggaaggctgtgaatggaggctaaagatgaacataaagattcatctctgcaaagattggtttttgtgccccctgtctggtgaccatgacagatgacacctgctatcccantgctgcttcctgcanagcacggctgtggtcactcttcaacaaagcagtccaacaaccagcacacatttgattctcctttgagtttttgaca

SEQ ID NO: 3532 - DNA, 388 bp, Homo sapiens
  misc_feature (1)...(388): n = g, a, c or t
cctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggnctctgtcttcagcctcctgg

SEQ ID NO: 3533 - DNA, 309 bp, Homo sapiens; identical to SEQ ID NO: 35
  misc_feature (1)...(309): n = g, a, c or t

SEQ ID NO: 3534 - DNA, 363 bp, Homo sapiens; identical to SEQ ID NO: 36
  misc_feature (1)...(363): n = g, a, c or t

SEQ ID NO: 3535 - DNA, 291 bp, Homo sapiens
cctggggcatctctgtactgaactccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagtaactcgagcatcattctttcaccag

SEQ ID NO: 3536 - DNA, 110 bp, Homo sapiens
cctgcgcagattcaagagccttagatactggctttccaggcttcccagaaaaagtagctgcaactcgagcaaagcaggttacacccctgaacatacccataggaaagagg

SEQ ID NO: 3537 - DNA, 416 bp, Homo sapiens; identical to SEQ ID NO: 37
  misc_feature (1)...(416): n = g, a, c or t

SEQ ID NO: 3538 - DNA, 360 bp, Homo sapiens
aaaatatattagaaatgtaaaaattgtatatggggctcacattatatttctattggacagctctgtcctagagccaagctcggactgccaaagattggacatcctgtgactgcaagtttccagtgagcccttactcagcagcttgcttaggtggtctgtggttcatagaaacagagaggaggccaagcatgcgaaaaaggaacgggagaaaacagctctcagggactttaataactacagtctgtaacaaataagcagtgaatgtttgaatttggttggtggaaagctgggatgcaagtcatctctgcctattacgacaaaagcctatcgaccccagcagccagcacaggcaggctgcag

SEQ ID NO: 3539 - DNA, 122 bp, Homo sapiens
ccagaggctgcggtccgtcaagggcttgcctcgcttcagaatcagtaacatagatcttaagtgtaattgattaataagcagtgagttactgtagcttcctttagctctaccgaactcttttt

SEQ ID NO: 3540 - DNA, 271 bp, Homo sapiens
  misc_feature (1)...(271): n = g, a, c or t
naggtctcgaatagagctcttggaagtccctccaaccatggcctgggtctccttctacctactgcccttcattttctccacaggtctctgtgctctgcctgtgctgactcagcccccgtctacatctgccttactgggagcctcgatcaagctcacctgcaccctaagcagtgaacacaacacttacaccatcgatcggactttctgctgtttttgtttgtttctgtatcttgtctcaacttgtggtcagcctttctccctgcatcccagg

SEQ ID NO: 3541 - DNA, 253 bp, Homo sapiens; identical to SEQ ID NO: 38
  misc_feature (1)...(253): n = g, a, c or t

SEQ ID NO: 3542 - DNA, 138 bp, Homo sapiens
gctcctgccttgcacgttagagagccggtacatgcaggtgggaagctccacacggagaggcgcgccgcgcccgtgataaggttttacctggtacatcggcatggcggaaccaaagcaagagagggtggcgcgtgccaa

SEQ ID NO: 3543 - DNA, 232 bp, Homo sapiens
aaagtcttaggacaaaaacactacgttaagctcaggtacaaactgggtgacaaaaattaaataccgaatgcttttaatgatgcgttattggtaccctgtgacactgcttatagtttctttacttttgaattacagaagcctgtcctggaagacagttttttaacatgctggaaaatcgtccaacatcgattaatttagtactcatccacttttcattttagaaataaacagg

SEQ ID NO: 3544 - DNA, 218 bp, Homo sapiens
gtgctttgcatttaggacacagcccggagccgcagaaggtcagcaggagcacgtctggcaccttcagtaccaggctgggtgagagagcccgagaggggggccgggggggcagtcagggccctgcttcgctgcctgggcccttgtagatggccttctccaggccgtccaccacctccctgtattccaggaacgattggtagtgtgtgcactcaaagcag

SEQ ID NO: 3545 - DNA, 537 bp, Homo sapiens
  misc_feature (1)...(537): n = g, a, c or t
ctggtccccttcatcttccccaggcaagagggggtaacccgtcaggagctctgctaaaatgcagcccaggctccacatatcaatgggcatgccatacctggccccaaggatcacttctggagcccggtaaaaacgcgactggatgtacgtgtagacacgctgatgctcgtaacaactggagccaaaatcaattactttaataccgcttctaccctgctgctttaacaaaatgttctcgggcttaaggtcacagtgaattattctgtttttgtgcaaagcatccaagcactgcagaatcgagtgggcaaacttgcgaaccaaaggcagactgaagccctggaatttattcttcttgatgagctcatagaggttcatgctcagcagctcaaacgtcatgcanatgtggttgcggaaggtgaaattctccagcatatggatgacattcattgngttatccttgtcctgcttcccaggtgttccaggattnngatctcctccctgnttcccggggaagcgctttcattccgncctttttag

SEQ ID NO: 3546 - DNA, 367 bp, Homo sapiens
aaaagggacccaaggtcaggggcagaaatgggaggcagaggggaggcacccatctcacaccccacccctagggactaaagccgtagccaacagagcagtagtaatccgcgtcgtcttcaggctgcacgggactaatggtgaggacacaggcattgtgggcctcatccttggctgccgagaatcgatcggggatgtcagcaggccggtggtgatcctcctccgagcggtagtagaggagatatcgaggggcactgcctgcccgctgctggtaccaggacacaccgtagtccctgatggtgacgtgctgggggctgagcgtgcaggagagttgagccacttggcctgggaagaccagcagtgcatccag

SEQ ID NO: 3547 - DNA, 268 bp, Homo sapiens; identical to SEQ ID NO: 618

SEQ ID NO: 3548 - DNA, 178 bp, Homo sapiens; identical to SEQ ID NO: 39
  misc_feature (1)...(178): n = g, a, c or t

SEQ ID NO: 3549 - DNA, 194 bp, Homo sapiens
tgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctgg

SEQ ID NO: 3550 - DNA, 317 bp, Homo sapiens; identical to SEQ ID NO: 294

SEQ ID NO: 3551 - DNA, 156 bp, Homo sapiens; identical to SEQ ID NO: 40
  misc_feature (1)...(156): n = g, a, c or t

SEQ ID NO: 3552 - DNA, 287 bp, Homo sapiens; identical to SEQ ID NO: 41
  misc_feature (1)...(287): n = g, a, c or t

SEQ ID NO: 3553 - DNA, 264 bp, Homo sapiens
aaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttaaaa

SEQ ID NO: 3554 - DNA, 272 bp, Homo sapiens; identical to SEQ ID NO: 42

SEQ ID NO: 3555 - DNA, 252 bp, Homo sapiens
  misc_feature (1)...(252): n = g, a, c or t
ggcttccacgcgggtgagccttcaggacttcaggtccagtctgcccatttataaataggaaagcagaggcattgaaacctctaggtcctangctgcttgaaggcatcaaagtgcctgactggtcctcagagcctggcaaagtattcagcttacaacatacatttcatgaatatttgtngaatgaataaataaacggacaanaaggccagacgtggtggctcacgcctgtaatnccagnacttttgggaggcc

SEQ ID NO: 3556 - DNA, 219 bp, Homo sapiens
  misc_feature (1)...(219): n = g, a, c or t
gtgcctactatgagaagggcgntgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgancacagaggtcccttctgccacctaccatgcaccatgttccttgccang

SEQ ID NO: 3557 - DNA, 262 bp, Homo sapiens
gaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctatgtatgtccctgggaagctgcatgatgtggaacacgtgctcatcgatgtgggaactgggtactatgtagagaagacag

SEQ ID NO: 3558 - DNA, 288 bp, Homo sapiens
ctgcaccgtgtcattggagaggaacttcccatctgcatcctgaagctggcaggtcacaatcttcccatggtgactccactgtggggagaacttgagctcgctccgggtgaagacagacttgatggtcaaggaggtcgaggtgacagcagcctgcctcattggaaccccctctaggagccactgcaattggatcggatacccatagcaggagaaattcagcaagcaggtcagagtgacttcctgggactcttgaatttctggagggagctggatatgaggtggaaaagg

SEQ ID NO: 3559 - DNA, 533 bp, Homo sapiens; identical to SEQ ID NO: 43
  misc_feature (1)...(533): n = g, a, c or t

SEQ ID NO: 3560 - DNA, 514 bp, Homo sapiens
  misc_feature (1)...(514): n = g, a, c or t
ctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagcaggccggctgttggacattctacataccaaggggcaaaaggggctatgtggtcttcttggagagcctagaattttattacccagaactgtacaaactggtgactgggaaagacccactcggagattctncaccattgtggtgga

SEQ ID NO: 3561 - DNA, 324 bp, Homo sapiens
ccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccag

SEQ ID NO: 3562 - DNA, 281 bp, Homo sapiens
ctggggcacagctccgcctctcctccagcccctcggtcccatgaggccaaacaatgaggacagaggggctgaggggtgtgtccagggcccagtcccacctcagcaggaaggtggcgtcagcactcgcagtcccagcctcacgccgcatcgcagtcccgggggatcttcacacagggagggtgagctggttaagaaggcgggtgatcctccccccggatgcttcgatacttagccatgtcttccggaaatactttagaaagttcttgaatcaacaggctttt

SEQ ID NO: 3563 - DNA, 388 bp, Homo sapiens
aaaggccacgtgaggaagatgctgcggcatgcggaagcatcagccaccgtggagtacgcatacaatgacaaagccattttggagcagaggaacatactgacggaagagctctatgggaacacatttcagctttacaagtcagcagatcacccaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtgg

SEQ ID NO: 3564 - DNA, 194 bp, Homo sapiens
cctagcaggtgtgagtttggttcccactgcagccagcaagaagatgatgctgagccagattgccagcaagcaggccgagaatggcgagcgggcaggtagccctgatgtgctgaggtgctcgagtcagggtcaccgaaaagacagtgataagtcccggagccgcaaagatgatgacagcttgtctgaggacctgt

SEQ ID NO: 3565 - DNA, 221 bp, Homo sapiens
cctgtctctgaggggaggctgtgaccggattcttccccgacagagtcaccctgggattcctcagagcaagtgctccggtcgcattccagatcatccactggcaaaagcatcacttcttacacgtggttttcagggaagtacctaatgcagaacgcaagggtggggtggcaggagcgaggctgtacagatacacagaggtacactgtacaaggccggggagg

SEQ ID NO: 3566 - DNA, 512 bp, Homo sapiens
  misc_feature (1)...(512): n = g, a, c or t
aaaatttctatccattctgtcaggttctgttggtttatcagttccagtggtagtgtatactgaacaagagcatagaagatcttgaatatctgtttctggatgaggacagactgatcagactggtcagaaagaagctggataaaacgatcctttagaactggcagaaaatgctgcattgctgctaccaatggactccgctcctctggttttttatactcataatttttcacaagctgataaaggcaaagaagaattcctagccaacaagcactgttatcggactgaagataaaagccaattttgtccacaatggcagtccagcggcttggataatcatgtttgatgatgtgatgaatgcatgtagtaagctgtaccctgatgagctcaggagaatggataatggcttctacaatattttctcgaatacaatggcgatcttcttctnggaatagtataagggggatatatcccctggtgctgtttcttcgatcaggccaantctgtgttatcat

SEQ ID NO: 3567 - DNA, 254 bp, Homo sapiens
gttaacataagccattttaattccctgggaagtgggagagtgggtctcccattttccccaagcaccctttttggtaattgtgttctgtgggttggaaggaggtgaagggggacctgggagcgagctgttggtgggtgggaatagggatttggccccgagtggagcagccgcctgttaggagcccaacatggcgcctgaaaagcacatgatgcgaaagggaagagaggagaatccattccctgccagccaggcag

SEQ ID NO: 3568 - DNA, 487 bp, Homo sapiens
aaatctgtttttctaactgggggaaaagattcccacccaattcaaaacattgtgccatgtcaaacaaatagtctatcaaccccagacactggtttgaagaatgttaagacttgacagtggagctacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgctccttaagtcagaacagcagactcagctctgacattctgattcgaatgacactgttcaggaatcggaatcctgtcgattagactggacagcttgtggcaagtgaatttgcctgtaacaagccagatttttacctc

SEQ ID NO: 3569 - DNA, 532 bp, Homo sapiens
  misc_feature (1)...(532): n = g, a, c or t
agaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcangagccggaccggacaagtcccgttctgttagtaggtctcccgtgcctgagaaganccagaaacgtggttcttcaagtagatctaagtctccancattggg

SEQ ID NO: 3570 - DNA, 509 bp, Homo sapiens
  misc_feature (1)...(509): n = g, a, c or t
aaaccttaagaaccacataatactatataatgcttttctgtacaaatctcaagaaacactttcattcattaaaacatcatgaaaatccttaaatgtgttaaatggaaaaaaatgaaaccatgaacaaaaaagctatacatgtaggtgcatatttatctcctcctgagttgggagaaatctttctaagcatagaaacaatggtagcaaaagagaagaatagatttggctggattaacaataaaaaatttctgccagaaatatgaaaattcaatttagacaaaattcaatataaacaaaattaatatagacaaaggtggtaaacaggtggttctcagagaagataaatacatgattatttaacataaaaagaaatgttcaatgtttctagaagacaaataattacaaacctaaacaaattgtatatttgttagattggcataaattataataatccaacattgagttangtggaatataaattggtaaaatatttctggaagacaatttgg

SEQ ID NO: 3571 - DNA, 396 bp, Homo sapiens
cctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgtctcag

SEQ ID NO: 3572 - DNA, 162 bp, Homo sapiens
ccagcctggatctcctcaagtccccaagattcacacctgactctgaaatctgaagacctcgagcagatgatgccaacctctggagcaatgttgcttaggatgtgtgcatgtgtggaagtgtcactggcatgtatacacacacacacacacacacacacttac

SEQ ID NO: 3573 - DNA, 309 bp, Homo sapiens
aaaatcaagtctgttttgttttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtataccttttt

SEQ ID NO: 3574 - DNA, 174 bp, Homo sapiens
ccacgtgcaggggcaggccctggcccgccatgagcagaagtggagtggatcttcaaatcccactttgtcctcctggacggatcacaggcgccgtaagcctggcgtttgagcacttggaaaattcctctggcaagccaagcccttcctttcccgtagctctctggttgtttcagg

SEQ ID NO: 3575 - DNA, 221 bp, Homo sapiens
ccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgattt

SEQ ID NO: 3576 - DNA, 303 bp, Homo sapiens
  misc_feature (1)...(303): n = g, a, c or t
ccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacccaaaaaaaaaaaaaaaaaaaaangcccttcccgggggg

SEQ ID NO: 3577 - DNA, 531 bp, Homo sapiens
  misc_feature (1)...(531): n = g, a, c or t
aaaaaggtaattttcagcattttggcacctaaaagggaaactttcatctgcttacacaggccagaagcaaagacaaagattgcatgttgttcttacagatgacttaaatcatctctttgatgataaaaatatttttaagccgtgaaagttatgagatattctgggtaagcctgattatcaaagaataccacaaatagctttggagatcgtgtattgtttgtcactgagtcaaagagatctgtgggattgtgaggattcttgggtggaggggtgactaatcctgcacgtccctttgtgaagactccagtaagtactcgcacaacgtacatgtgctttctcccattgctgtctggcttggagtaggtgtccttggcagaataactggcatccacagcaaaataggttccttttccataggatacagcatttttcccacacaacttctattaaagccgtgctgattgacatatggcactgagtctgcatctgtcccatggaagaggagtctctcattattcntatggtcattct

SEQ ID NO: 3578 - DNA, 479 bp, Homo sapiens
  misc_feature (1)...(479): n = g, a, c or t
ctgggcccggtgccagcagccctgcccctaatctgcctgcccgggggctcctgagggagacaccctctccccagggctggaggctggacttcagcaggacccactgcagcccttaccccctttcccctgctgtactgtcaggaccccttcccacacaggaaccaccggcccaggctctagctagtcatgacagttccccagtgccaggcactgcaggaggctctgagaggggtcggtggcctctgtctcaactcagctcgctcagcggccctgggaagccaggggaggttctggagccaagctccagccagacccatcccatcagcattgctgcagctccccaagggctctgctgcgtgcttggaagtgaaaattgctgatggagggggtgggtccgacgagaagagaggaagggacagagtccagccacaggtggttctgggcattctccaactcctccanacctctctgaggacctc

SEQ ID NO: 3579 - DNA, 276 bp, Homo sapiens
aaaaaagagagctacctgtatgtcatgcatcccatccaaaacatgtcacaatattttatatatattacatagtatttacaacaaagccccttccatagtatttacaataaagctccttccaaaatcaccaagaggcttctttccagaatagcaagtgctttcaagttactgtaccaagtattctcactaatacagtagtgtatctaaatgggggaggtgggggagtatcaactgcctaatattagttactgaattttcagattagatccctagttt

SEQ ID NO: 3580 - DNA, 273 bp, Homo sapiens
aaagttttattatgaaaacacacagaatcaaatgtgttatccatgtatttgcaacagcagagaaacagtgacagtggaccatccccataggggacacttatcctttggctaaactaatataaataatggaaatgacacctaatacaataacacggcacataaaaaagattaaattaagagaagggacaggaactgcggagaggagtcctgggtatggaggagatgtgtctcatggagaagcatccgggctcaagtgacctttcctgaagactt

SEQ ID NO: 3581 - DNA, 225 bp, Homo sapiens
  misc_feature (1)...(225): n = g, a, c or t
ctggagcagcttgagttagaacggaagcaagcacttgagcagtacgaggaagttaaaaagaagctggagatggcaactaataagaccaaganctggaaggacaaagtggcccatcattgaaggattaattccgactgatagaaccaggttcaaagaaccctcacctgatcactaactggggacctgcagcttttcactgaggcagaacttgaagagagagaagaa

SEQ ID NO: 3582 - DNA, 486 bp, Homo sapiens
aaactctccagagacactactttgaagtgctggaggtgggttttgaaagacaggggtgcataggacctctccgacatcctttcagaatatttcaggtaccaagaagaggtagcaagctcctaactagcttatggaactacctcattctagcatcagggcattctccacttgcccaaaggctctctttgcaataaacatggtttgaaaataactttagggtgcaacaggcaaacaatcaatcatatatacaaataacatgtgtctatcacaaaatttacagaaggtaagaaaacgtgttgttgtgtttccttacaaagtccatattaataaacggaagcagcattttcagctatgaaactgaagcacaaagaaagctgaagaaatccacctcttttattaaaattcttgtaaagttcaattccataaagaaattctagtgtctcatcaagattttcacaaaatatatagaaaactgttcatgtattt

SEQ ID NO: 3583 - DNA, 175 bp, Homo sapiens
ccagacacacacgcccaggcgggagctctcactcttttgggaggggtcattcccaggggaccacagcctctggggaaacatctggggtgggggcagggttgcgtgggttgacaatggcctccttggtctgcgccatgtccgagatgaccccatcagtaatgatgaacagcaccga

SEQ ID NO: 3584 - DNA, 421 bp, Homo sapiens
  misc_feature (1)...(421): n = g, a, c or t
ccacngangacttggggagatacgtaatacaaataaagaccttaaccaatcccaacactttcagaaaaactttcacctgtggggaagtgggggcatgtgactggagagcaatgaacggaantttacactggatctgaattgttactaaaaaagtaactgacacgcacacacaagtggccttcctggcggagcatcaacaaagccaagaggtgcgagtacccaagactcccagagttgttccacccctggggctagctgtatttatgccctcgctcaaagaccagctttttcaaacactaatacctacctgccctnggtggtaacaacactgtaangngctgctcattccactgtaggattttacatttttctcaccatggcacagcctctttttanttcatacccaatagtctagcctggg

SEQ ID NO: 3585 - DNA, 195 bp, Homo sapiens
ctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtgga

SEQ ID NO: 3586 - DNA, 429 bp, Homo sapiens
  misc_feature (1)...(429): n = g, a, c or t
aaagcaaaccgtgccccttggcttgccattctttcagcagcacatgccacgttctaagcagatgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatgtcactaattcctgctctaggtcatctttcctttgtgcaagcccacattcccaccatcctgtgaactttgttgtacttggtgttgggcaactgggtgagtgttgtgacaggctcagacctgaatccttnctcaggagcaattnggagaacncaaaattacctggccgggcn

SEQ ID NO: 3587 - DNA, 244 bp, Homo sapiens
aaataagacaatattatcacattaaccaccaaaaaataactagtataacaattcacctggatgatttgcagactatcatttctgtgttctccccatcaaatacaatgaaaagctgatctaaagatatttacaactggagtggaatacacatttttttgaggctagttatatcatggagaatcacacttaatgagatctgactccatcactgtaccaaagaagtcaaggagtcagacgtaaacag

SEQ ID NO: 3588 - DNA, 536 bp, Homo sapiens
  misc_feature (1)...(536): n = g, a, c or t
aaaatatgcatattctaaaagctcttagcagagttgctgttcagaaaggctgggtgagtgtctgtcttcctagtaacagggcagaggtcagcctgtcctaccacactctcctactgcactctagccagtgttagtaacgtgcttctggtcacattttcacatgaaggctattaggagctattgacaaagtttaagtagacaaatcacataaccagatttgcatttttgattccggcttcagagcctaatagctctattagtcttatgtggcccctaggaggcattcaagataatggtgacactaagcaaaggagggcaagttgaggtggagtgtctgaacaagcaggtctctaacctgcagctatggagaagcaattcagtgtttcctgtggcgggtggagggcatacttacccagcagagcatgtgagactctttgatatgcaccttcatgtattatcttgttcaanttctctgaggttgggatcattattatttcccattttgcagatgagaaaattgagcananaaaggtcac

SEQ ID NO: 3589 - DNA, 332 bp, Homo sapiens; identical to SEQ ID NO: 44

SEQ ID NO: 3590 - DNA, 529 bp, Homo sapiens; identical to SEQ ID NO: 297
  misc_feature (1)...(529): n = g, a, c or t

SEQ ID NO: 3591 - DNA, 253 bp, Homo sapiens
aaaagcacaaagtgaccttcagccccggagctctccctgcttgccttaaccccttgggcggcgccaggagttacacgagacctctgtcccggagccctgcgctcactcttccctccgccctcactccccagacactgccgaggcgacccctcccagcgtcacctcgaagcccagccaggagtagggggacagcacgtcatagaagagctccacggtgcgcggcaggggccccatgctgcaggctccggaagag

SEQ ID NO: 3592 - DNA, 394 bp, Homo sapiens
ccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtggaacactgagcaggacaactgacctgtctccttcacatagtccttatcaccacaaatcacacaacaaaaaggagaagagatattttgggttcaaaaaaagtaaaaagataatgtagctgcatttctttagttattttgagccccaaatatttcctcatctttttgttgttgtcatggatggtggtgacatggacttgtttatagaggacaggtcag

SEQ ID NO: 3593 - DNA, 451 bp, Homo sapiens
  misc_feature (1)...(451): n = g, a, c or t
aaagtttgattacatcagctataggagtaaagtgctaacttacaaagcttacagtttgtgacaccagtgataatgcatgcatactgctattttcaccaccaactggtgaaacaatgaaaagacagtttacttttactgagataccgaaatgagtcaaagactatattagccaatataattcctttgtttttagtgtgaaatactatggtagggcctaattaaaaataaaaacaatatggagaacagtaaaacagtcatcaagtgactctaagcttgtatttactctaagcttgtattaagcttgtattgactctactgcctcttgtattttttttttttaatttctattcagggatccaanaattttagtaattattaactgagcagcagattgccactggactgttttaagatttactatcaccaggtcttacatanatacataaatttt

SEQ ID NO: 3594 - DNA, 411 bp, Homo sapiens
cctcaggaaactgacaatcacggcagaaggcgaaggggaagcaggcacgtccggaagcgctcctccagcagggacagctcgctgatgaggtcggtgatggcgttggtaaaggcttcctgggggctgtagtccggcgtggtctgcactcggatgatgatcttgtgctccaaggggtgggggactttgtagccagcaaatagcacttgcgggtcttttaggagttgtgatttaatgatgtttcccagtgtgtggtcttctttgttgatggtgaataaacaggcattgggtaccttggtgtccttgttaatggtgatcttctcgccctcgaagagcaagaacgactcgaagctggaggggcgttcatgctcccgccgccgttgcgtccagaccccaagtgtccgccaccgccgc

SEQ ID NO: 3595 - DNA, 349 bp, Homo sapiens
ccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttacctgcccgggcggccaagggcgaattccagcacactgcggccgttactagtggatccgagctcggtaccaagcttggcgtaatcatggtcatagctgtttt

SEQ ID NO: 3596 - DNA, 345 bp, Homo sapiens; identical to SEQ ID NO: 298
  misc_feature (1)...(345): n = g, a, c or t

SEQ ID NO: 3597 - DNA, 305 bp, Homo sapiens
ccaggatggtctcgatctcttgacctcgtgatctgcccgcctcagtctcccaaagtgctgggattataggcgtgagccaccatgcccagcgtcagaacatttagtttttgatagtgaggtcggccagccttcaggacagaatggggcaaagggtttgagcatcattctgagactccaacatgacagccacaggcaccgaccttgagccggtccagtgcagtgcagtgcagcccataagccccttggcttccactagaccaggacacctccctctcacccagcctccccttgctctcaccctttgg

SEQ ID NO: 3598 - DNA, 532 bp, Homo sapiens
ctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgatgcccccggtgtgcgaggatcacagcgaggagaaaacttctggaaagtgtggcctctgcagcaacatgatgcccctgagtactgtgaaa

SEQ ID NO: 3599 - DNA, 272 bp, Homo sapiens
ccagcagaatctgtgatcttgaggtggctgcgcaggccgccagcgcccccagactggtcggagatctcgtacgcgccagtcactagcaggtccttgtgaatctcctcacggaggcacttgcgagagttaatgggcagatggaaggagatggcaaggaccaatctggggccgagcaggaacaaaagcagcaacgctaacggaaaagggccgcgccgggctggtgggccagacaaaccagacatggtgctggagactcgttcgccaccgaaggc

SEQ ID NO: 3600 - DNA, 508 bp, Homo sapiens
  misc_feature (1)...(508): n = g, a, c or t
ccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgctgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcgggaacatcttggcctcgaacccccgggtgacccgcttncatatcaactgggacaacaacatggacaggctggaggccatanagacccaggacccctcctggg

SEQ ID NO: 3601 - DNA, 342 bp, Homo sapiens
atttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgctttttt

SEQ ID NO: 3602 - DNA, 272 bp, Homo sapiens
ctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcag

SEQ ID NO: 3603 - DNA, 545 bp, Homo sapiens
  misc_feature (1)...(545): n = g, a, c or t
aaaatgttttccacatcaactacttangaagaagttacagcaatatgatcttccactgctcaggaagacagagtgaacttggatatgatgaatattaaaaacaaacatacagagcacctgggtctggacttgtgggctaaagaaatgcttcctgaatttgtccgaggtgatgtgttgagcaaccgtgccacagttcaccagcagtgacactctagttcttcagtatattcctgttgtgaacctatttctttgaatttaatcatctgggatgattgctgcagtgtgagtctttagcattttgaaaatcccacagaagagattaagaaggttcctcttcccagaagacactcatataaagcatgcttctatagggttaactgttcagaaattgtaaggtgcatggtcatcaccaggtaagcagctctacaggggcccatggcccatactcatccttgcgtgcccaggggagccagcgtgcatatgaacagtanggaagtggcataaccacgcanaagggctcaggacaacttggcatttttgttgtg

SEQ ID NO: 3604 - DNA, 277 bp, Homo sapiens
ctggacttgcacttgtttgcctgactgctgtccccctaccacagtaccagtctcgtgggctggtaaaggcccctggcaagagctcgttcacgatgtttgtggatctagggatctaccagcctggaggcagtgggaacagcatccccatcacaggtgaggacaggaggacagacctgctgtgaggccagggtccaggggcagcctggaggggagcacagtggtcttgagacgcagcctcacaaagcatagccacaggacctctcccttgggccctagc

SEQ ID NO: 3605 - DNA, 287 bp, Homo sapiens
aaagtagtcttccgtggttgggaagcctcacctcccaagaccagagtcagttggagctggttgttgttggaagggagtgggttggggaactggggtgggggcagggagatccccccgctctgctggcggtcctaggtggagaagaactgcacttcacagagtctggggtttggtgggaaggggatgaggcaggagcagcaagctggggagatgggacccacctcagtccccagcttcattttcttctaatgtttccccactggtggcattctctgcagtcttggagg

SEQ ID NO: 3606 - DNA, 396 bp, Homo sapiens
ccattgggagctcttccacattggctcctgtgtcctttgaccttcctccatcttcttctctttttattttttagcactgccttaatttcggcgctgaggtgggtactgcagagaaaagcaaacactccagaacccatgcactggatccaggagtgggtggtagaaagggatgtggagggaggggtctgagctctaatactaaagacagagacttaggagactgtgaaggggtgtttatggaaagtcagggaattttacctccccgaggagaggaatcctgtgtcatccacctttgtgtcccctcccctgggctcacaacagtgaaccatggggtgaacaaggaccattccactgcctctcccaggttctccaactctgtggcttactatggcctgg

SEQ ID NO: 3607 - DNA, 182 bp, Homo sapiens; identical to SEQ ID NO: 299
  misc_feature (1)...(182): n = g, a, c or t

SEQ ID NO: 3608 - DNA, 140 bp, Homo sapiens
cttacggcctgccccgaggccacaacccgacccaggccacgccatccgatccagaccctttctcgcagactcggtccccagaaccacactctgcttcactgactgtcctgcccccatcccgggccgcaccagcagcatgg

SEQ ID NO: 3609 - DNA, 425 bp, Homo sapiens
ccatgtcggagctgaagcttaccagctctctaaagcatttgctagggaatcatgcagagggtccaaaatattttttagaaaagcattcatctgtcccgggatagaagtagaggaagctggtaggcaggcgctagaccctaaagaaggactgctgagccagttcttaagcctgtggtcctgtcggtgaggaaagtgagagcagtccagagcaggtgaaaagagcagagctcattcctgcagtggctcttttgcctaaagcagcattcctcaaacttctcactcgaagcattaagttacggtgagatgctaacacacgctttagacttaagtcaaaatttactgtgaagccacagcaaaccatggcttcacagatgaattagttgctacacaaataagttcgatacataagtacagtaattgctttt

SEQ ID NO: 3610 - DNA, 195 bp, Homo sapiens
aaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacc

SEQ ID NO: 3611 - DNA, 350 bp, Homo sapiens
cctgtctcagtcagacctctttgctcaatctcatttacacaatgcacaacaatggaggggatcattggagaagtctgggacacaaagtctgccagcattccctctccaatcttgacaggtgttcctatcagggtaggaatgcagggaaggggacagcggtcccgacattctggatgagagaccacacgacagtctcgacacttcagagataatttgccaaattttatccgctttccacatggaacacaggattcaggtttaataaccgtcttagaaacaaagtcatgcaggcgcatccctccattactctgtggcgtgcccacactgtctgtctcagttcttggctccag

SEQ ID NO: 3612 - DNA, 391 bp, Homo sapiens; identical to SEQ ID NO: 45
  misc_feature (1)...(391): n = g, a, c or t

SEQ ID NO: 3613 - DNA, 311 bp, Homo sapiens
aaaaaaatgaaacaaacacaaggcattgctgcagtgactgggacatgctgatgacccagagtgactatgagaaggaacggtgacaagtgtttggatttaatggtctcaccaaggaatgttgggttagaaaagtaaaataactcaacaccaaacatgaaaaagtatgcctggcatccccaaactttatgccattatttttaggttcataatatgaacaactaagtgataaaacctttagattccatattgtgctcagaagattgcgtttcttctgcagatctctagtaaaaaaagatctcttccatattcag

SEQ ID NO: 3614 - DNA, 222 bp, Homo sapiens
aaaggctcacctgattaggtcatgctcacccacaaaaatctcctttttgtaacgccaaatgtggtcaacacacaatccaatcacagtagtgattattccatcatatttgcaggttctacccacagtcaaagcaaatgagttttagaaggcatgtacaacaggaggtaataggtattcttaggggccatcctcaaattttatttgccatattcacccctctgg

SEQ ID NO: 3615 - DNA, 346 bp, Homo sapiens
ccaggttctttacatgtgcttgttttgttcacagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggagg

SEQ ID NO: 3616 - DNA, 469 bp, Homo sapiens
  misc_feature (1)...(469): n = g, a, c or t
ccacggaagtgggaaagtgaaggcaagaagtgtgtcctgaataaagcttggctggttttcagacaaaaggtcttctgggtaataaatgttgtctggagcagccctcaggagaagaggtaagagcctgtatgggatggtgtcgctgccaacatccttccctgtgatcccacttactcttccctggctgatgagatacttggggttgtgattcatgatgattgaatttccttttgaggatttgtctttgggcagatgaaggaggctcagagaaaagcccctccctgcatgtgctggcccaagtgacctcattttgaagtcaagtggcaaaccagcggcatattttagggtgccatttgctgaatgctttcagcatccctaatccngtcaattgttcccatttgtttcctgaatagcaaacacttccttgaaattcttctcaaactcagcctccagtcttaaatccatttgg

SEQ ID NO: 3617 - DNA, 535 bp, Homo sapiens
  misc_feature (1)...(535): n = g, a, c or t
ccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccactacgtggaggaagattattctgaatactgctgagccctggtgccttggcagagagacgagaaactccagctctgagcccgcgtgggn

SEQ ID NO: 3618 - DNA, 256 bp, Homo sapiens
ccatgcccagggccacagccgagggcacaagcgtgtagtagcgctcccagtagttggtggagacaaagagggcgtagatgcccacagcgaggaacatcatccacttcgttccaaaaaacctgatgagcacaggtgtgtagagcagggcggcgatgggagtcacgttgatgcccatcagcattttgctgtcgatgtcgggcagccccatgttgccatacttcacctcgcggtaggtctcgtcgtagtgcaggatcag

SEQ ID NO: 3619 - DNA, 235 bp, Homo sapiens; identical to SEQ ID NO: 3257

SEQ ID NO: 3620 - DNA, 324 bp, Homo sapiens
aaaataaaactttatgaaagaaaaaacttatatgttacagagaagctaaagcacctgtaatgctaccagaaagttatcatttatgatatatttcatgcacagccctaatttctcggtgtaatatttctgatactttaagtgatcgtttattttaattaccataatttctaatgcactgttttatccttagctttgtttgttattatgttttggaatgaaatttggtcagataatatgattacggtgagttctgtaacagctactggtaatatttttgtaaatcacgtgaaagcattggagcaactgtcttggaaaatgctcttt

SEQ ID NO: 3621 - DNA, 363 bp, Homo sapiens
  misc_feature (1)...(363): n = g, a, c or t
cctagattntcatcaaaaatggttctagcaagttcttacaaggaataactaaataatatgtaggttctaaagaataatgtaataattaggtcaattagatttatctattttccccccttggtagtaccttttaattccgtattttggaaaaatttctcacttccaaggncgtgaaacttaatgatcttccaaagggctgaaattcaacatattcttttataaaaaanaactttcttcanccttcctgagaaaaccangatntacaatttttaacaattttatntgattttagaatatccacttacnggccagaccccatgggtcacatcttgtnatcccaaccttttggangcttgaagtggg

SEQ ID NO: 3622 - DNA, 478 bp, Homo sapiens; identical to SEQ ID NO: 46
  misc_feature (1)...(478): n = g, a, c or t

SEQ ID NO: 3623 - DNA, 188 bp, Homo sapiens
  misc_feature (1)...(188): n = g, a, c or t
cctctttcacatcaatatccattccccagctntggaaggggtgggcatcanggctggtgaatgctacacaattaaagccaagaagatttaccatagcacttaatgaacatactagccatttgtggagtctccactttgtggaggcccttcaantactaaaaggatctcagcanggntaaatgacttgt

SEQ ID NO: 3624 - DNA, 533 bp, Homo sapiens
  misc_feature (1)...(533): n = g, a, c or t
attgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcngctgcggcgagcggtatcagctcactcaaaggcggtaatacggttatccacagaatcaggggataacgcaggaaagaacatgtgagcaaaaggccagcaaaaggccaggaaccgtaaaaagccgcgttgctggcgtttttccataggctccgcccccctgacgagcatcacaaaaatcgacgctcaagtcagaggtggcgaaacccgacaggactataaagataccaggcgtttccccctgggaagctccctctgcgctcttctgtttcgaccctgcgcttaccggatccng

SEQ ID NO: 3625 - DNA, 534 bp, Homo sapiens
  misc_feature (1)...(534): n = g, a, c or t
cctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccacccccatgatccatctgtgtatttctgaacagtcagcgattccaggtttacctcggccgcgacccnctaanggcga

SEQ ID NO: 3626 - DNA, 329 bp, Homo sapiens
ccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcag

SEQ ID NO: 3627 - DNA, 440 bp, Homo sapiens; identical to SEQ ID NO: 300

SEQ ID NO: 3628 - DNA, 244 bp, Homo sapiens; identical to SEQ ID NO: 47
  misc_feature (1)...(244): n = g, a, c or t

SEQ ID NO: 3629 - DNA, 343 bp, Homo sapiens; identical to SEQ ID NO: 48
  misc_feature (1)...(343): n = g, a, c or t

SEQ ID NO: 3630 - DNA, 537 bp, Homo sapiens
aaagagaaacttaaatcctgttgtattctttcaacacaagcaatgatacttctcagagtctgctcaaaagctcagctctgtggactccgtgacaaaatgtacgcgtccactgccgaccctcttggtttctgaaaccaacctttcttcctgctctcctctttaagagcaaaccccaacatgtataaggtcacagcaagtggtagccaggaaaagctgtgggacccctcatttgagtcacatccatatggcatggagaaagaaaacctctctgccagaaggaactgaactctggaagtcctaaggaaggtcaccatgctcagcagataggaaagcattgccaagggctgtccctcaagagcttagttttcttagggagaccagaaagacatcagatcctgactgccctgttttgctcaagttctgaaatgagtggcatgatgaagagctggtggagctgagggaaagagtcaaccatgtggggtggggtagtgaggaaggtgtatgaggaaacaaactgggccctgacgaaacagcggg

SEQ ID NO: 3631 - DNA, 137 bp, Homo sapiens
ccagtactttcttaatctctttaggggcagctaaaggaaattctgaatatgtgactcttagatccaaccaccatctctcaagaagaaatactactaccaccatttctgccctcaaaactcactaccgtgactatggg

SEQ ID NO: 3632 - DNA, 335 bp, Homo sapiens
caccatcttccccttattgctgtggacttcagggctctgctgctctgtcctccacagaacttgtcaatcagcttcctaccagctaagatctggtgctgtctgatatatcctccctgcggcttgtcactcatgctgtctaatggcgtgaggtgcattgagttgtattctgatgtctttgtccttttgaagccaccgagtaaggtcacacaactttgaaacgagcagggtaccatctgaggatgctggacattccttttaacaattacctaggggagaggcagtcctcagacaggactcaggtgggtgggcctcaaagaggaagggaaagggggcag

SEQ ID NO: 3633 - DNA, 175 bp, Homo sapiens
ctgaaggagcatttgcggaaaggtgacagcctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctgg

SEQ ID NO: 3634 - DNA, 441 bp, Homo sapiens
aaaattgggacaagagtaaaactagaccagatgcgacttggctgaccaccaccaaatgtgactttgtgggacgataagtgaagagaaataaatggttctctttgaaggcacactacataaaatatttttgtgggaccacctcgaaatttccatcagacacaccaacacagtgaaatacagtacttgagaattcatgcaccaggtcagaaggttgtaaagtcaacatcgagttttaacaaacccttctgtatatgccctgataaacaagtgaacttaagagcttctagctagtaaataaataagtcagtcctgtggcaaatattacaagtttgaatcacttactagaagaatacttaattccgaaactcggttgggctgtttttatttttttatcatgtggagttgccaaacattaaaccagaagttgcatggaagtttttt

SEQ ID NO: 3635 - DNA, 326 bp, Homo sapiens
cctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccag

SEQ ID NO: 3636 - DNA, 446 bp, Homo sapiens
  misc_feature (1)...(446): n = g, a, c or t
cctggagcagcttctcagggcagccctggcccactaaggcccagtaatgagggcagaggggtgcagagccatacctggctacacccacaggtggacacagggagcaagctacttcgctgttctctgggctcattcccccagcacaggagggcctccatgcacactcattccacaggccccactggccctgtcacactcacacggcacgcacttggcgctgcctgctgtctgccttccacctgggggtacaagaggtcacccaagggggcaggcgtgcagggcctcttggatcttctggcggcaataggagtacttctgcaggatctggcggaggtgctcctcctcctcccgctgcaggatacgtaggaagttatgtagttcaggcatgctgaaggcgtcccactgcaangggcaaaaggggagtgtacaggctgcagaagggatgg

SEQ ID NO: 3637 - DNA, 373 bp, Homo sapiens; identical to SEQ ID NO: 49
  misc_feature (1)...(373): n = g, a, c or t

SEQ ID NO: 3638 - DNA, 308 bp, Homo sapiens
ctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctcttt

SEQ ID NO: 3639 - DNA, 533 bp, Homo sapiens
  misc_feature (1)...(533): n = g, a, c or t
aaaaaatttaatgaataaacactggggtctacagtagtatttgaaggagatctcacaaacaggtttggtttttgaaggttagaactggtggtctagagaattcatttcattccagagaaataaagagaggaatttcttgggttccttcaggaatgcatctagctttgcctcatctttgtttgaactatggatacggcagaagaaaacatgaggatttcacagatttaaggtgcaaaaagtcactgggttctctaagaagtctgggattcttctgctggaaaaataagtttgttgagaaaaaatgagttggaggaggctgttattgaagtgaagcagaattgtttttactaatctgcttattacccactctgtagtgtggaaacaaattattcatgcacaaggtcctcttactgttcctcctaaatgtctcccaaatcccttctctcccttcaatgtccaggccaccagcatgactttttgctgtgtgtagcacctccgcccaggacctaaagatgcaaatctagtcgtagctn

SEQ ID NO: 3640 - DNA, 285 bp, Homo sapiens
ccaagacccaaacacaccacagggatggcacaggatgttggggcagggagatgagcaggtggggctcaggaagaggagaggcaaaggaataagaaaggaaaaggaggaaaaagagaaaaaggcaagatggggcaggggcaagggagagatggggaggtataggagacagacagaaaaaggaaagagaaagcaaagaaaaagagaaagaactacaaggcaaaaaagcatctagaaaaatgagggagaaaagggagaaagacaccctgacacagccctttctttcag

SEQ ID NO: 3641 - DNA, 418 bp, Homo sapiens
  misc_feature (1)...(418): n = g, a, c or t
ctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttacctcn

SEQ ID NO: 3642 - DNA, 371 bp, Homo sapiens
aaaaaagccacacttgaacaggatgaccagaatcacgatcaacaccagaagtccaccaacgctgcctttaatgatgataggcaaagaatggtacttctcatctttcaggaagacgacagtgatcttagttctgtggttctctgcattcagtccctcatatagagatttgttgaaagatatttcaccaaggatctgcagttcagttacatcttttagtaactcctcagagtgatcccaggagatctctgcagccacggtgacattttctttatctgaagcgatgacacagctcactgaatgccattcttccacatgctgaaccgaactgtacgcacaagcgcgctcctgactccaggtgcacaccgtggagg

SEQ ID NO: 3643 - DNA, 345 bp, Homo sapiens
cctggtacctagtaggttcatgatacgtatttattgaatgaatgaggcacaagataatgatgcgaaaaaaatccccaccaagaggggaacaaaaagacctaaccagataatccccaattcatgtcatggcttgaggatggaccattttattctgttaggctagagcaaatctttttcccgaaacaccagggctgacaaggcggcgtgaccagggctggaggatgccgccgtctgtgcaggcttccccctgccctgggtgcatgccccctgcggggctggggagaaggtgacacagaccttgcccttcccacaggcatgccggggagactcacgcttcacgttcag

SEQ ID NO: 3644 - DNA, 289 bp, Homo sapiens
ctgcttggacttcaaagccctccgcctagccatctcagccaggctcaggttccttctcccacccatcaggccaagcaggacttgtcaaacatacacattcaagttcctagcacacagtaggtgctaagtgggaattgattataaacttgaattcttccatcaacaaatatccacctctcctgtccagcttgcctcagatcttcaggttctctcttctctgaggcagctaagcttctacatccttcatgaagtttcctttacttctcgacagaagacagttccctttagg

SEQ ID NO: 3645 - DNA, 538 bp, Homo sapiens
  misc_feature (1)...(538): n = g, a, c or t
cctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaaagacagccacatttgctatttccatcctgcaaanttggagattgagttcaangana

SEQ ID NO: 3646 - DNA, 283 bp, Homo sapiens
ccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaagg

SEQ ID NO: 3647 - DNA, 390 bp, Homo sapiens
cctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaagg

SEQ ID NO: 3648 - DNA, 199 bp, Homo sapiens
ccaggctccatgaggtgagggtctcgccttggactccggatagggggtgctcgaccccgcgcccaggcccctccgccttcagccagcgcatcttctgtcggtactgctggacagcatcttgcacacaggcgtccatcatggcctcagtgaggaccccgtccttggaggcatatgccgtggcctgccaggacacggccag

SEQ ID NO: 3649 - DNA, 202 bp, Homo sapiens
  misc_feature (1)...(202): n = g, a, c or t
ctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaaatctacattttcttttccctttttttttttttnnaaaaaaaattttccc

SEQ ID NO: 3650 - DNA, 290 bp, Homo sapiens
  misc_feature (1)...(290): n = g, a, c or t
ccagagggatccccttgaggagctcgctggtgacacatttgtcgtcctccccctcctcctccacctggtcggcccaactgggcttcgaatcaaagtctccagtaggcatcgcaaaaagtattctccacgcagcccaacttgaagatgatgaggatgatgatgtcgataccaagaagcagaagaccgacgaggatgactagacagcaaaaaaggaaaagttaaactaaaaaaaaaaaggccgccgtgacctattcaccctccacttcccgtttnaaaatntaaacgtggtc

SEQ ID NO: 3651 - DNA, 519 bp, Homo sapiens
  misc_feature (1)...(519): n = g, a, c or t
ccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgcttctgtgccttgcagtccccgtgtgccancgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcaagccagacctctgctccttgctgattgacgacgtgatctatcatgaggcggctgtaaggcaggcaggggccgaanccctctcccaagcagtggcacgttaccagcggcaggccggcggangttatgggcaggctcatngagatttaccaggaaaagctctacc

SEQ ID NO: 3652 - DNA, 207 bp, Homo sapiens
cctaagcctcagtgtgggccaaggctcaaaggtgctggcacaggcttcccagggagaacagaaactcagcagtgaaagccgcagaggggaagaagcaggctgatgtcaacagcgtggggctctgtccctcaccccaaagagagggagtgtgccagatcccaggccaccaagcggggccagctccagcctgggcgatcgtcccagcag

SEQ ID NO: 3653 - DNA, 478 bp, Homo sapiens
  misc_feature (1)...(478): n = g, a, c or t
aaacatgcgatgtccttcagtttacatttgcagattttggtgaaatagcatcttccagtgaagtccactgcgttggtaggagggatgtctgtagagaaaaggtctatttcagtatcagccagcaaaacagccttcattcccctagagctgacacttgtttacagaatttgcaacacaggatggacacgcacctgtccttgaaactacaaatgttggtagacatggcgtcgcaggaaggatgaggtgcgggattttgaaaaaggaaacaagagtaatgctcctactattttgattcccctaggctaaaattcaagtttgcgggacctagagcttttctaagtcctaatattgggaaggaaattangttttttttttttcttgttttccccgggggcggagtanaanaatatttattggattnggaacaggggagcggggcaaacttggnttttcnttttancttttggaaaaaggggag

SEQ ID NO: 3654 - DNA, 364 bp, Homo sapiens
aaataataacagaatttgtcttttttttcctgccacagcaccaaatgccaaagagccactcatctgtagagcttgctgtgctgctggcggaatctgcaaacctgtaccctctgcaagtcttgccattaactgaagacgaccagttgttcccaaatcaattccagtcctttccagttcatcactgtccaaaaatgaactagcactcgaagcatcagtacgttcagtaacatgaccaactttcattggtcttcctgctagttcaaatccattaagttgttccaaagcctttttggcacattctgagtcagaaaatgtaataaatccatatcccttggatcgaccagtttcactgtcccatcatcag

SEQ ID NO: 3655 - DNA, 220 bp, Homo sapiens
gactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccacccgctgtcagacgagaaggacctgacccagctcttcatgttcgcccggaatgccttcaccgtgctgg

SEQ ID NO: 3656 - DNA, 283 bp, Homo sapiens
ccagtgtatatgtttataactagaaagaaagaaaacagagcaccaatcgtggagggagtgacctctgctatattgatgctggcattcttggctcagtatgccagattgcttttaagataacctgaacctaagggctttccagcatcggaaaaccttggaaaagactaaagcttgtttataggcagagatggactaaaggacatgggtgtaagatttggggtggaggccctttgagaatgttcactgcttacattcctgttacagcttgtgtaacctgaagagg

SEQ ID NO: 3657 - DNA, 541 bp, Homo sapiens
  misc_feature (1)...(541): n = g, a, c or t
ctgaaaagcatgcttgatatagtagagcatgatctcctcaaacctcacttgccctctgtcacttatttgagattaggtggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagnttcttgatctgtttactcttgataaggatggcaaaagcagaaaaagctgacacctttacttctgggaaagcaagtattgaaatcaattttgaaacctgatgatctttggatcaagac

SEQ ID NO: 3658 - DNA, 248 bp, Homo sapiens
ctgttgtggactcttcttaaggagcttcaggctccacagtggtttgtgttcctctctgctcgtgtgtctgacatggagtgaccaagtcccacacactgagtcccctgtgtcccggggctgctggcgcctgggtccttggagaggctgtggggttgggagctagaggtcctcatgggtagagctcaggtccaccctctgagcctgtccaaacaccaggaaggtgcacagccccaggttgctgatgatgg

SEQ ID NO: 3659 - DNA, 165 bp, Homo sapiens
aaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtagg

SEQ ID NO: 3660 - DNA, 301 bp, Homo sapiens
ctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtgg

SEQ ID NO: 3661 - DNA, 256 bp, Homo sapiens
aaaatatacatgactaataaagtgaacattcagaggagccactgctcagcatgttccatgtcggccacttgtggacactgatctcatccaaagaggacagaagtttcaaacatctgagcagtttaagttaaaaataggatgaaggggaaataagagaacaggataagtgtcctcccaagacagcagtggctgatgcccacatggcgcaaacaggctgacttcaatgagtgttcacgggatgtgtgataaagcccag

SEQ ID NO: 3662 - DNA, 148 bp, Homo sapiens
aaatacttatgaaagctttcagacaaaaataaactttcacgttaccatgatgaaactggggttgtttctgttcctccaactgaaagatgggacgctgagctcggggactcggcccccgtggtgcacctcgcaggcgctgtgcgtgtgg

SEQ ID NO: 3663 - DNA, 336 bp, Homo sapiens
ctgacggctatcctgggcacagtggggcgggctgtctcaggcataaagggatggctatcctgggcacagcggggcgggttgtcctggaggcgggctgcaccatcctcatgggggccctccagtggggctttcctgtctcctgagtgtacacaggccccagtgaaggagcccggtgtggagccccataccacagcatgtttcagtgtctgctatattgtgagcctaagccacccaccacagggcttgaccctgcgaccgtcctctcatttctagaacgggaaagcacagtgcttctccttgagggttaaaaggatgctgctgggtgtcagggactta

SEQ ID NO: 3664 - DNA, 361 bp, Homo sapiens
ccaccatgcctatttcttgacttgtgtcttcaggatcaaatgttttacatgtcaggaaagtcactatccgtcctttccagggcaaattatccgacccaccttgacagaacaacttcccacacatggtatcactgaggaaaaagccaaaatgtattgcaggattcaaattgcagttttacataaatgctctaggactatggatatttaactgatggtatttttccctgtagccgagactcttagttgtactttacactcattttcccttatttctcagtaataggatgcctgaacgttagcacaatatattattgctcaaataaacagtattacctagatccctgtacacctaatttttcca

SEQ ID NO: 3665 - DNA, 260 bp, Homo sapiens
ccactcctggaaacccactgatagatgagtttcccccattcttctggcctccgccacatgatcaggaagctggacttgctcttatccaaccactcgaggttccctttcttcctcagttcctctaatacaatctggatcgactccacaggaagctttcgctgtagcttgacgttgttgaagagcgggctctcctgagcttccatcaccgtcatgctggactgtttgtgcaggcggcagaaggacaggaccagcgagcacca

SEQ ID NO: 3666 - DNA, 338 bp, Homo sapiens
ctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagattcctttt

SEQ ID NO: 3667 - DNA, 296 bp, Homo sapiens
  misc_feature (1)...(296): n = g, a, c or t
ncaccctaggcccacttttccacatggcaacaggcgtggagctgggggctactgcccctactgtgtaggcggtgggctccccatagtctcctctgccctgctgccgtgtacctggctcccttcactcatccacatcaccggccctaggccagggtctgaaccacacacacagaatggctgcagtaagcaggaacgggaagagctttcacattcagaacaagaaggggttttttagttactcaaaagcaatctgagcatgttccagcacttcaaccttactctttcagagctttggg

SEQ ID NO: 3668 - DNA, 373 bp, Homo sapiens
ctggcttccagagcaccataataaatagtttcaaagatctgcttattcagtaactgggcttctgcactctcaaaagggtatctcatcaggataaaagcatctgccagaccttgtaccccaattccaatggggcgatggcgtttatttgataggcatgcctctggtgcaggatagtagtttatatcaataattttattcaagtttcggacaacgactttagtgacttcagccaacttcttaaagtcgtatgtgtgttctgatgtgacatacatattcagggccagggaagccaaattacaaacagcaacctcatctttgctggtgtactccactatttctgtgcacaggttgctgcatttgatggttcccaggt

SEQ ID NO: 3669 - DNA, 396 bp, Homo sapiens; identical to SEQ ID NO: 301
  misc_feature (1)...(396): n = g, a, c or t

SEQ ID NO: 3670 - DNA, 418 bp, Homo sapiens
  misc_feature (1)...(418): n = g, a, c or t
ccaccagcaagcacgacattaatccttggatctggcagcaacaccaaaaaagagcgtttgctcttcacaggcactccctaaaacgaatctgctcattcgcctggaactcactgagactgcttcacagcatgaccaagcatcgaccacctctcaccaccccaggcgtcccaggtccaacccagcgccctcttctctgcctcctgtctccctgctccttggcccaggacacctgcagccagctaccatgatcctattaacacccaagtcagagcacggcactcacctgctgacaaccctccaacagctcccatctgactctggatagaagccgaagtctcgccatgaccccccaactctgnggcctcactcctccaggtctctccacctggcctccctgccatatctgaagtattagang

SEQ ID NO: 3671 - DNA, 455 bp, Homo sapiens
  misc_feature (1)...(455): n = g, a, c or t
tggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggagatcacctgggttccaggccatccttgctgagcatctttgagcctgccttccngtgggagcagaaaaggccagaccctgctgagttagaggctgctgggatccactgtttccacacagcgggaagctgctgggaacaggtggcagagaagtgccatgtttgcccttgagccttgcacttctttcag

SEQ ID NO: 3672 - DNA, 402 bp, Homo sapiens
aaaaatgtatatatataaaataaagtgacagattcagagtcactgttcattgtgtgtttgggggctgcacaaagacacctagccaaagaagcaagtgaaagcctgcattctgctcaccatgccatacatcctggcatagggctgtatcctcccaaaggggattcctttgtctaattcataccaggccactgtattgactagagaaggccatggatgggtttctcactcttagaagggaaagaggaggaatggctacagcctccccaagccatagatgggactgcctcccactatccccagacacaaatggtaaattggaaaacctgtatccagacatttcttcagccacttcattggcaccaagcgtctctcaaaatgtcttctgttccttaacctaccagg

SEQ ID NO: 3673 - DNA, 375 bp, Homo sapiens; identical to SEQ ID NO: 50

SEQ ID NO: 3674 - DNA, 150 bp, Homo sapiens
aaataaaataattttatttcataaaaagaaataaactagaaagaacaatgcccttaaaaaaaatgtttgcttcactaaaaccatgttgtgaaggaaattcatcaaaggctgttaccttattcaacacgcgtagaaattgggttctgattt

SEQ ID NO: 3675 - DNA, 548 bp, Homo sapiens; identical to SEQ ID NO: 302
  misc_feature (1)...(548): n = g, a, c or t

SEQ ID NO: 3676 - DNA, 547 bp, Homo sapiens
  misc_feature (1)...(547): n = g, a, c or t
ccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaactgctgctatctgcgtgccacttn

SEQ ID NO: 3677 - DNA, 279 bp, Homo sapiens
ccacacccagatcatactgatatctacagcatagtcctggctacaggggagctcaactctaactcgtgaagcgggcctggtttagaaagtaacaatgaggtagtaactcatgatagtgctagctgttatcaaaaattaacaactttaggtatttttgttttgggtttttgcggtttaggtacatccaaaatttcttcatagtctgcactcattccctttgcccagcgaccaactgtgaccattcgctctgaattctgactttcagggcaatctttcttt

SEQ ID NO: 3678 - DNA, 232 bp, Homo sapiens; identical to SEQ ID NO: 303

SEQ ID NO: 3679 - DNA, 492 bp, Homo sapiens
  misc_feature (1)...(492): n = g, a, c or t
ctgtttgcttttctaggcaaaaagcaagcctgacctggccctggcacccccattatgtttgcagaggggtgaaaagggacttgacagatgtgggcggaggggagggagagcagtgcccttcctggacacctggaggaaccgcacaccccgaactctcgccctttgcattaggcgtggccttgccattgcacctgccaataaaatgtgggcagaaatgttaagacccagggcatgattccgcaggttccggctccctcgtggcatctgggacagcatgctggggacagcttccatcagagcacctcacaacacccacactggacataaaatgtgagcaagaagtaaatatctttttttttctgtttttgagatggagtctcggtggctcacccttggctcactggcaacttctgcctctgggttcaagcaattctcctgcctcagcctccccagtagcttggattacagganacctgcccggcgggcngtcaa

SEQ ID NO: 3680 - DNA, 373 bp, Homo sapiens
ctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccag

SEQ ID NO: 3681 - DNA, 345 bp, Homo sapiens
aaaattgaacaattttacttattcaaatgaatctgtgaatataaccaaatagttgaaatcccttctcaattaaattgcaaataataatatcacaaagtatcagttctcctttaacaaaagccattctcaagatattaaaggaagaataatcatatataccttacctatcccaagcagtccgccattctgtaatgttaatactcgtcttatattactcaccacaatttaatgacccaataaatgttaagtgttatttgtacttaaaaggacagtaaaatggcatttagttaaatatgataagattagccaagaaaaaggctgttgcaaaaaatgtacagtaatttt

SEQ ID NO: 3682 - DNA, 266 bp, Homo sapiens
ccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacacttcag

SEQ ID NO: 3683 - DNA, 158 bp, Homo sapiens
aaaaaaacttctacaaaactctagtatgggcttctgactttttccagggtgtagaatttgactcaaaagtaaaaataattttgttttagtatattctactttcattaatgtttttttgttctgaaagtgatattatattgtacatgtaaaattaattt

SEQ ID NO: 3684 - DNA, 412 bp, Homo sapiens
cctgtgagcttccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagcttt

SEQ ID NO: 3685 - DNA, 316 bp, Homo sapiens
ccaccttaggagtctgacctctcacttttccagcacgggtcagggaaccatggactttacctccaagcatgcggcctgctacttccagggtagtcagggcctccaccccgcactggcccagagtggcctcatcctccaggggcgcgcctgccaggagcacgacttgatcttccggggcaatgccctccagtgaggctacatgagccttgatctgggcgaccgtttcctggccggtcacctcgaaggtgtgtagctcctgggcgcggacaaagagctgcatattggcgactgaacggcggtcccagctaccgcgaag

SEQ ID NO: 3686 - DNA, 136 bp, Homo sapiens
  misc_feature (1)...(136): n = g, a, c or t
ctttccccaccaaaanaagatgcactgacattttgaaagaaaattagtttgacatcagatttttcaacagcaatgccttatgtcagaacaaaatggagttacatattcangccaagtgtggtggcncacaccttgt

SEQ ID NO: 3687 - DNA, 312 bp, Homo sapiens
aaaatatattttgtgcaaaataccttactatgctataaaccaccattaaaaaccagtgttttgatttggtacttaaatatttttggagtgaaaattatcactaaagtaacatgactccaacaaaagtatggtttcattataaaagagtactatattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaaagaacag

SEQ ID NO: 3688 - DNA, 290 bp, Homo sapiens
  misc_feature (1)...(290): n = g, a, c or t
ngttcgangtgccgtgtggacagccctgtcggggacagtgaggagactcagtgcctgtcctgggggacagctctgcctggaggctggggtctctttgaccttcctgagacatcctgatgcctccaccctacttctgtgtcccggcaggagtgagagcgcagagagccctgagacagcccctactggagcacctcctggggagcagccagatgtcatccccgcccagggcgacctgctgggngacctcctcaacctggacctcggccccccagtgagcggcccacccctgg

SEQ ID NO: 3689 - DNA, 418 bp, Homo sapiens
  misc_feature (1)...(418): n = g, a, c or t
ccaggcaagtggcagagccagacctgggtcttcacacactttcctcttcttgactgtactggcgcaggtgcttaagatttgggggaaggtgggtgggtatctggcctcttctttgggactcaaattgtgatatctctctgagaacccacaggctccctctttagggctgaggtgagaagttctgaaagtcaagcagacacatccaggcatttgggcaagaaacttcttccttccaaatcaaaggtgaaatgaaaacgattatgagcccacgggggatgaacagaggtgaatggtgggctagtctcgaggatggcctaattcanggtttcctaagtgtcagccattcatggaaccacccctgnggatttttgctacctctctggatctgtgcccacttttacngttatgttttttcttt

SEQ ID NO: 3690 - DNA, 184 bp, Homo sapiens
ctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcag

SEQ ID NO: 3691 - DNA, 382 bp, Homo sapiens
  misc_feature (1)...(382): n = g, a, c or t
ctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcaagtgggatgtctctctgtgagcacaaaggcttatcaaatgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattcttgttggntggtgtccaggtttgtggcacttgttccaagang

SEQ ID NO: 3692 - DNA, 408 bp, Homo sapiens
  misc_feature (1)...(408): n = g, a, c or t
ctggtggggctgccagggtacacgcccctgaggatgccattcttgatgcggatcaggcgtttcttccaggagttgatcccagacaggtagacgtgtttcagggcctcccgactgagccggaagtcgaccccgtctggggtcaccgtgaactggaagccacggcctggtgagcttccgccatcctgggggttggtcggcaccttccgcggtgggaattgcanggcgcggctgggtttctgtgcggtgaaggttgctcaaaggtctgggagcctggggggccccagagtctcgtgaggatggtggcattagagtcaaactcaggaacaggccggtctcctgaacctcagtttcacttgggggctcagcccaatcgccagggccttctgctcttgttcctccctccaaggt

SEQ ID NO: 3693 - DNA, 160 bp, Homo sapiens
aaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccacttt

SEQ ID NO: 3694 - DNA, 373 bp, Homo sapiens
  misc_feature (1)...(373): n = g, a, c or t
ctgtttggagaaattgccgacgtagtacttcttgaagtcccacatcatcaggattcgggcagggatgcacgactctgcatatgagtggcagcagtcacagaaatacttccctaggtattcgcagtaccggagccgcttcacaaacttaggctctactggagttccacagccggcacagaaaaaattctgggctgccaccacaaggtccctcttgagtggtggatgaatattaaatatgatttgaaatctaggaggagcccagtcttcagtccctctgatcctagacttaaatttaatttcctgtactacattcatactggattcaaagtcttttcggacacgctcttcatttacgactatngagccagacctc

SEQ ID NO: 3695 - DNA, 184 bp, Homo sapiens
aaaatgattacacttcaaataaaggtactaaaatcacgccccccaaatttgtaagcgcttttgttgttattgggtactcactgtgaatagaagtaaatgtacttgacctgtatgagaataaacattttatcaagtacagcaaaaaaaacggaattgattgtgaaagccatggggatgggacttt

SEQ ID NO: 3696 - DNA, 347 bp, Homo sapiens; identical to SEQ ID NO: 51
  misc_feature (1)...(347): n = g, a, c or t

SEQ ID NO: 3697 - DNA, 143 bp, Homo sapiens
  misc_feature (1)...(143): n = g, a, c or t
ctgctantctgcaacctanttttccctctcacctttaactgacgttttgtcctcaataattacacaaggacctagagtacctataggacaaaaagtatanaataaaaatatgcctttagtcatttggtttttcttaaaaaggt

SEQ ID NO: 3698 - DNA, 311 bp, Homo sapiens
  misc_feature (1)...(311): n = g, a, c or t
ctgctgctgccgttgaccatcctgaactctgggggagaggaggagtcagcctggcttgcagacggccgacccagaacatggctgtctgtggtcatttccttccttcacacccagtgggatgggcacagagcccaaccttggtcttaccaantcccccaccctccttntgcatcagcatccaggctcacacagctctccagaagaatttgatcttagctgcagccttggggtacatcactctacacccagtctcttccctgcgcttctttcaaccaacagaagcaaacatcaaaagcacccacacctactgg

SEQ ID NO: 3699 - DNA, 219 bp, Homo sapiens
  misc_feature (1)...(219): n = g, a, c or t
ccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttcttgttgatctangatgattattttgtaaaagactttctagtgtacaagacaccattgtgtccaactgtatatag

SEQ ID NO: 3700 - DNA, 168 bp, Homo sapiens
aaagaaacaccaccaaaaggggattagcttagtccatcccttcctcagtcatctgcttcccaccttcctccaaatgttatcccagaacattctggaggcagggagaaggggaggcagctaatcagagtctgagagcacgatgatctctttctggatcgcattgtgtgg

SEQ ID NO: 3701 - DNA, 313 bp, Homo sapiens
  misc_feature (1)...(313): n = g, a, c or t
gatgtgatggtgtccaccttccacaagtactcgggcaaagagggtgacaagttcaagctcaacaagtcagagctaaaggagctgctgacccgggagctgcccagcttcttggggaaaaggacagatgaagctgctttccagaaagctgatgaacaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccan

SEQ ID NO: 3702 - DNA, 385 bp, Homo sapiens
  misc_feature (1)...(385): n = g, a, c or t
aaaatacattcaaataaaaagatataagttacttgcagtgaatgcacacatacaacagcagggagagctgagaacataattaaccaatactcttgtgttcagagaataaatagtctgaaaccgtgggactgaggcttgttccttaggggcttttctcaaagtatccttggtggacataaggttaccctcactcaatggaaggacacatcttctgctgccggggaggacacagcatgacagtttcatttatatgggatgttttccttccataaatgtctggaacacggtgtcacaggacaccatggngtacagtgcagccctcanattagaataaataagtcacatggntggactggaatgccacnnacncactattgacttgaaa

SEQ ID NO: 3703 - DNA, 141 bp, Homo sapiens
  misc_feature (1)...(141): n = g, a, c or t
ncgaggtaaaagatactttggattcaattaagaagagtttttaagaaaaaagaggaaggttctggcatggggagctctgcaacccactgctgggtgccagaagcgagctgtggagcggaagatgaagatggcaccatgtgt

SEQ ID NO: 3704 - DNA, 230 bp, Homo sapiens
  misc_feature (1)...(230): n = g, a, c or t
ccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcaagggtctgcgcacagtcaatcanggtanagggggtatttctgagtcaatctgaggctaaggacatgtcctttcccatgagg

SEQ ID NO: 3705 - DNA, 286 bp, Homo sapiens
  misc_feature (1)...(286): n = g, a, c or t
ctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatgggggctacgcctgcatgtaaacacgcctgcaaacgctgcctnccggtaaacacgcctgcaaacgctgcctgcccgtaaacacgcctgcaaacgctgcctgcccacacaggttcgcgtgcagctcaaggaaagg

SEQ ID NO: 3706 - DNA, 239 bp, Homo sapiens
  misc_feature (1)...(239): n = g, a, c or t
ctggnacacggcagggtcagggttctggatatcaggtaaaacagtcaattgtgtcccagatccaaaggtcagttgccttgcagaaccagaagactccatgtcacccacgaggcagtagtacacagcagtgtcgctcagggaaacccggggcaggctcagagtgctggactttctgtcggcagggataaacagggaggccacttcgtttgtaactnttgtcttgnatccttgaataataa

SEQ ID NO: 3707 - DNA, 208 bp, Homo sapiens
  misc_feature (1)...(208): n = g, a, c or t
aantttgaacatgtactgtgacacttttgacacttttctgaagatttatcccgtttttctagcctttaaggtaatgctgaaggaatacatatactttaatatcaccttttttagaaacttaaaattgaatcaaaataatcagttttaaggaagctttttctcctccttccttttttgtagaggaaagaacacttgataaaaattagat

SEQ ID NO: 3708 - DNA, 354 bp, Homo sapiens
gttggatgcactttatgaaatagcaatggcatggaacttagtaaaaccagttaccattagcagagcatggaagaagattctccctatggtagaggagaaagagagcctggactttgatgttgaagatatttctgtggctactgtggctgccattttacaacacaccaaaggattggaaaatgtgactactgagaaccttgaaaaatggcttgaagtagacagtactgaaccaggctatgaaggtgtaaactgatagcgaaatcatcagaagagcccaaggcccgggcagatgaatccagtgaaaatgaggaggaggaaatagaactaattccagacaaacatattaatctgcaa

SEQ ID NO: 3709 - DNA, 242 bp, Homo sapiens
ctgagacccctgccctgtgagcccttctatccccacaagttgtcaggacaatcccttgtggttagggggaggggcggggagagagctctatttctcagccagtgccgagctaccctccctcctgggctgtgatttcatttgtgcaatgggggtgtgcaggagtcactagcttctcggggcctgtcccgcacatacacgcacttatgcgacatccagacatttgctacattttccaagggctt

SEQ ID NO: 3710 - DNA, 444 bp, Homo sapiens
  misc_feature (1)...(444): n = g, a, c or t
ctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaacacaccaagaagaagtgctacacggaggctgccatgtgcctggtgcacgccgctgcgttagtggctgagtatctgagcatgctggaggaccacagctacctgcccgtgggcagtgtcagcttccanaatatttcttccaatgtgctggaggagtcttgnggtcttntgaggacaccctgtccaccttgccccggggcgg

SEQ ID NO: 3711 - DNA, 227 bp, Homo sapiens
  misc_feature (1)...(227): n = g, a, c or t
ccaagggttgggagtgtcccaaagttcaagtcctgggtttctgggtctttggggttggggtcgcagtccccaagttcagaatcaggagtcgtggggtcaaggtgataacatccagattcctagatgactggggtcaaggctggggtcaagggtcccaggttcctggagtcaaggtcattaggcttgaaggtcactgaggctggcagtcatgangaccttggtcacta

SEQ ID NO: 3712 - DNA, 167 bp, Homo sapiens
ccaggctcaggccctggggtgaaaggagacaggtgctgccaagacctggagaaggacaaaagaagacagaatcaagggtgaaggaaaggaccaggcagtggcgaggggtggtgctgctggagcaggtctaagtgggaagcctagtggtcagggatggcccccagagg

SEQ ID NO: 3713 - DNA, 236 bp, Homo sapiens
ctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcag

SEQ ID NO: 3714 - DNA, 323 bp, Homo sapiens
ctggctgataagaagggcctccatgttgtggaaatccgggaggaatgtggccctctgcccattgtggttgcgtccccccgggggcccttgaggaaggatccagagccagaagatgaggttccagacgtcaaactgactgggaagatgtgaagactgcacagggaatgaagcgctctgtgtggtctaatttgaagagagccgccacgtaacctctctggccttgtgcaccagttcctgtctgcctgcacctaggagagactcagcccctcacagcttgggatgttaccttgccttttgtttgttttgagggaagtttaatcttt

SEQ ID NO: 3715 - DNA, 251 bp, Homo sapiens
  misc_feature (1)...(251): n = g, a, c or t
cctggaaggtgtgcaggagtttggtagaggagtgatctaggtgaggggaatggaaggtgcanagaccanagctgagagggcctgaggcactttccagagcgtggggaggggcctccaccaaggcgagaagggctgcaggtccagatcaccagcgnttgtagacagtanngtggcgcttggagtttacctgagggccagtggagctccngggacctntccggacgnggacctgtggtgactgggaaggacct

SEQ ID NO: 3716 - DNA, 199 bp, Homo sapiens
  misc_feature (1)...(199): n = g, a, c or t
ccagagggaaggcccaagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcancttcgggggtgacatt

SEQ ID NO: 3717 - DNA, 176 bp, Homo sapiens
  misc_feature (1)...(176): n = g, a, c or t
cttnggtaatggaaatctcgcgagggttaatcttctcttgagaatggcagtcaagaaatgagatggttcacttgactactgagcagttacaccaaggagagcgtgaaggagatgattgagccagagaagaaacgggttgtgatggcaatggtgtgggggaaatgaacttgagcttt

SEQ ID NO: 3718 - DNA, 187 bp, Homo sapiens
  misc_feature (1)...(187): n = g, a, c or t
aaggtgtgcaggagtttggtagaggagtgatctaggtgaggggaatggaaggtgcagagaccagagctgagagggcctgaggcactttccanagcgtggggaggggcctccaccaaggcgagaagggctgcaggtccanatcaccagcgtttgtagacangtagtgtggcgcttggagtttacctga

SEQ ID NO: 3719 - DNA, 181 bp, Homo sapiens
aaaagcctgagggaacctggaggggggctcccactctctaccttctttcctccgagtttgtgactccgagatggacaaagtgtgtgctgtttttggaggctcccgagcattggcagagctgtggcccaattaatggcccggaaaggctaccgactgggcggtcattgccacaagcctgtaa

SEQ ID NO: 3720 - DNA, 236 bp, Homo sapiens
  misc_feature (1)...(236): n = g, a, c or t
aaatttaacagtgtcctcttgaaaaaccttaatcacagttaagtgatggcatgggcaatgaattttaatcatatttaggaataaaatactagatattagtgtataacaattagatatatgttaattgagcactacaaagcctgaaagcttaacaaagtggggctataactagtaattttttggtaaaaatatagtgatctttttctacngggnattattattangggacaaattat

SEQ ID NO: 3721 - DNA, 333 bp, Homo sapiens
  misc_feature (1)...(333): n = g, a, c or t
ncgaggtcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccag

SEQ ID NO: 3722 - DNA, 168 bp, Homo sapiens
aggtcctcctgcagtgttccgcacagcaaaccgcacgctatggctgacagccgggatcccgccagcgaccagatgcagcactggaaggagcagcgggccgcgcagaaagctgatgtcctgaccactggagctggaacccaagtaggagacaaacttaatgttattaca

SEQ ID NO: 3723 - DNA, 377 bp, Homo sapiens
  misc_feature (1)...(377): n = g, a, c or t
cgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcancctacaa

SEQ ID NO: 3724 - DNA, 125 bp, Homo sapiens
  misc_feature (1)...(125): n = g, a, c or t
ngaggtaaatnaacacattccaggcaatgtaaaacagtnaaaagacaaactcaaatccctgagaatggctgggaagggaaaatggtggtaaaaattccaaatgagtgaaacttacaaagggcagt

SEQ ID NO: 3725 - DNA, 190 bp, Homo sapiens
  misc_feature (1)...(190): n = g, a, c or t
cctgggacctggcctgcacccagtctgtggcccagggaggcatggcaccctagcagcaaagcctgggcaaaggctgagccataccagacacagtagcccaggctacacagggcagagctgcgagtgctacctagccctggggccaaggcggggcaccacaatgctgaangagggcactgcccacagccag

SEQ ID NO: 3726 - DNA, 243 bp, Homo sapiens
  misc_feature (1)...(243): n = g, a, c or t
aaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccantgcaagagaactgcattcagaattagacaacctcagtgacnagtatctctcctgcctnc

SEQ ID NO: 3727 - DNA, 321 bp, Homo sapiens
  misc_feature (1)...(321): n = g, a, c or t
cctgcttgatccataggctcacatttgatcccaactggcggctgcttcttggcattaactttggattcccaaccagtaaatcttagcaagatctgagtttctccaggtatgatattattttgtttgaccatccttatcttcaagggctgtgggatctggcagctcttcatttggcccacaccgtgtgaggttgctcttggtgcaccgaatggggaagtttctacatcagtacctcggagagtccactggaagccctggacagtgggaattggtggcacccccancatggaggccaanaacacacagactgaanctccagga

SEQ ID NO: 3728 - DNA, 116 bp, Homo sapiens
  misc_feature (1)...(116): n = g, a, c or t
ncaggtctgttgatgaactcatgaaaaaaattatccttgaattcaaagaaaaatgtaaagacaagaagaatcctttaggaaactgtggagatataaatttagtacgactgggtcca

SEQ ID NO: 3729 - DNA, 151 bp, Homo sapiens
  misc_feature (1)...(151): n = g, a, c or t
cctctcctgtgggttccagaccctgttccagcaacaattgctgggacacctgggccgactgctccacctcgccaggccctggccctctccatctcagccctgacagccaccnagtgataaacacancaggcttnctaaacaatgtgacnna

SEQ ID NO: 3730 - DNA, 174 bp, Homo sapiens
ctgagcaggacctctgaaaccctggaccagtggtctcacatggtgctacgcctgcatgtaaacacgcctgcaaacgctgcctgccaataaacacgcctgcaaacgctgcctgcccgtaaacacgcctgcaaacgctgcctgcccacacaggttcacgtgcagctcaaggaaagg

SEQ ID NO: 3731 - DNA, 228 bp, Homo sapiens
  misc_feature (1)...(228): n = g, a, c or t
ccaaagtcccacggctgccctcggtgtgcactcaggctctggaacatcatggctcatcacgtttaacctcctgtntccatctgggtgatgaaaacctanggggagttaacgcnccgctgcagctcattgncaaagccagcttcaggcagagaacgaaggagggagcgacttcngggctgggtgagctggattctgttcctgctctgccaccaccgtaagcggtcccag

SEQ ID NO: 3732 - DNA, 241 bp, Homo sapiens
  misc_feature (1)...(241): n = g, a, c or t
ctcggaagcgcggcancaggcatcgtggggaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgagg

SEQ ID NO: 3733 - DNA, 269 bp, Homo sapiens
  misc_feature (1)...(269): n = g, a, c or t
aaatactttnattttcatttcacaaaaaaagcaacagtgtttgcagctacacatgcctttcagtcagtgttggtcatatgcaaaacaagttatcacaaatataaagaaaaataagccttttccctttacaagtgaaacaacacaatttgcatatacaatattatatacacatattttcaaaatgtttcacaaaagacagattatgatacaaatttagaattccacccacaagctcanactcaaggaattgaagatctctataggtgttt

SEQ ID NO: 3734 - DNA, 375 bp, Homo sapiens
ctggtacacggcagggtcagggttctggatatcaggtaaaacagtcaattgtgtcccagatccaaaggtcagttgccttgcagaaccagaagactccatgtcacccacgaggcagtagtacacagcagtgtcgcccagggaaacccggggcaggctcagagtgctggactttctgtcggcagggataaacagggaggccacttcgtttgtaacttttgtcttgtatccttgaataataaatcgtggtccttggctgggaaactgttggtaccacgtgatataatcatttgtagcaatgttgttgtggctacaggttatgttcacttcttgtctttcatatgagtccatggagatgggctgggtggtcttagcgag

SEQ ID NO: 3735 - DNA, 273 bp, Homo sapiens
aaataacatcacccttccatgtatagtaaactgttcatatttctacaggtactaagagtacactggaattacgtgttacatataaatggagaggtggagggaagggggaaaacttgcactaagtcgcctaagagataaactgataatgttagtaagacagctttgtattaaaaactttttatactacaagttactgcagaatcatctactgtaagttttatctccccaccagaaaactgaaatgttgatttacaatattaatgtaaaatattt

SEQ ID NO: 3736 - DNA, 579 bp, Homo sapiens
  misc_feature (1)...(579): n = g, a, c or t
aaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccaccaaaaatccctgctgtatgcaaatagccctgattaaccctctcccttctgctgtttcccatattacanacttggagactgtcctcattcccatatgtaatagacatccaaga

SEQ ID NO: 3737 - DNA, 158 bp, Homo sapiens
ccttctagcatggcatcaattccgatataggttcctgtgcgcccaacaccagcactgcagtgcaccacaatgggaccactgaagaaattgctgaaggcattcactctccttctcagtttgaggagcaagtgaggatcctcaggcaccccgtggtctgg

SEQ ID NO: 3738 - DNA, 310 bp, Homo sapiens
aaaaatattaacagttattcatttaatatttttccacactttgaaaccacctttgcaaaaattacaatggagaaaactgtatcagtgaacaagatctgatctaactgactccatcttgcttttaacctccaagctgtccttgttcattcctgggtggataccaaactaactttgggaggaacttagttgatagtttcactttgaaagaaagactgtaacaaaaaccctcttcctgactgggactacactgcctttgcaggactaacaaattagctacaaaattaaaaattatggtttagaagctgtgcag

SEQ ID NO: 3739 - DNA, 325 bp, Homo sapiens
  misc_feature (1)...(325): n = g, a, c or t
cctcagccntccggccaagaaaacagaaaatatggggacagaacagtcattcgtgcacatcccagatctcagagagcagcggtgggagctttttgtcctgcagacgcagtgcaaacacttgctctgagtggacgctgctcagggtccggaggctcaccagtttcattagcatccgtgggaacatcantcggtcatggggatggnggatggagacgtaggcatgcagggcttccacatatgtgtgctgcaggctctctacctggagctggtcctgcacgttgggcgcggtctataggtcaccaacanagttgaggancaggtctgg

SEQ ID NO: 3740 - DNA, 420 bp, Homo sapiens
ccatttccccccgcagctttctgccagcactcccaacagtctttccacagaaccgagcactgctcggtgaatgaggactggacgctccagggcacccgcctgccccttatactggaggtcaaatctcaggggcagttggaagtcaagctgaattgtcccacactgatgtggccggcccagggcatcgtggaggtgcacgtcaatcttaggtccatagaaggcaccatctccagagttgaggtcccagggttctccaaattccttcagggcctgtttaaggacctgttcggcctggtcccaaaggcaagggtcccccaggaagccagatggccgggtggacagtgccaggcggaaggagaagccaagaacggcatagacggaacggaggaaatcaagacagctttggatctctgcttccag

SEQ ID NO: 3741 - DNA, 225 bp, Homo sapiens
ccatctctctcaaagcaatgaagaaggagatgaagattggggcctattacacaagataaacagtgtcagcatgctttaccagagagaacattttcatcaccccactactgaaagccatgtataatccaccaccacctgttttttgggggacctgggacacatgaaacacagagaggaaatttcatgggtactggatgaaacaaggaaggaaatgtttttgctcac

SEQ ID NO: 3742 - DNA, 315 bp, Homo sapiens; identical to SEQ ID NO: 3124

SEQ ID NO: 3743 - DNA, 304 bp, Homo sapiens
ccaggccaaggggagctcgctggctgcccatggtgcccggaagaatgggggtggcagtggcaagagtgcaggcaaacgactgctgaagagggctgccaagaacagtgtcgacctggacgactacgaggaagagcaggactacctggatgcctgcttcaaggactcagactacgtttacccctcactggagtcagatgaagacagccccatctttaagtcccggtcgaagaaaaggaaaggctcagacgacgctccctacagcccaacagcaagggtcggcccatcggtgccaagacaggacagg

SEQ ID NO: 3744 - DNA, 273 bp, Homo sapiens
ctgcatctcctgccctgctgtcattacagggatgggcaggctggcatgggggcacccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttatttt

SEQ ID NO: 3745 - DNA, 313 bp, Homo sapiens
ctgcgtcgtgacattgaggacttaaggaccaccatgtcaggcagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggcgaattccagcacactggcggccgttactagtggatccgagctcggtaccaagcttggcgtaatcatggtcatagctgtttcctgtga

SEQ ID NO: 3746 - DNA, 557 bp, Homo sapiens
  misc_feature (1)...(557): n = g, a, c or t
tagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccacaaaaggccaggaaccgtaaaaaggccgcgttgctggcgtttttccatagctccgccccccctgacgaagcatcacaaaaatcgacgctcaagtcaaaaggtgggcgaaaaccccacaggactatnaaagataccaaggcgtttcccccttggaagcttcctcgtgcgctcttcttgtt

SEQ ID NO: 3747 - DNA, 301 bp, Homo sapiens
ccacatcaggaggttgcaggttaaccagaactcaccgacacagcaggagagcagcttggaacctgcaacctagccaaaacctagtgccttggattgggggagaaaacatgcagccattcctctctctctgctggctagaggggattctggcttttcctcccagagccacccctttccctcctcctaaagttgatggtggttctttaaggaaagggagaagtgcacagtgtgatagggcaggaagagaaggaaacggaggagaggaggggactttcccataagcaggcagaagaaaaggcag

SEQ ID NO: 3748 - DNA, 262 bp, Homo sapiens
ctgcctgggccccaccctcctgactcctgctgatggttaagggccgggagcagatgctgccaaggccacatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataagg

SEQ ID NO: 3749 - DNA, 271 bp, Homo sapiens
aaatatttgttcttttaattttgccatatccaaaaacaagtttgtagagtgtccttctagatgcctttttattctttcccaaattttgatcttattaagaacatctaatagtttccacaaatccttatgttaagcttctagagcaggccatatcatttgaggttgaggtgccactataccgccacggttccagataataggaacttttgccatacttcttatcatttctaccatctgaccgttttgttcagatcatctgaacatagtgtgg

SEQ ID NO: 3750 - DNA, 186 bp, Homo sapiens
  misc_feature (1)...(186): n = g, a, c or t
ctccagcagacccctgnatacntaaaggngcaaaccaacaanatggtgatgctgtcctgcnaggctaaaatntccctcantaacatgcgcatctactggctgagacagcgccangcaccgagcagtgacagtcaccacgagttcctgnccctctgggattccgcaaaagggactattcactgagaa

SEQ ID NO: 3751 - DNA, 283 bp, Homo sapiens
aaaattaaacctaaagaataggaggaccccagcaggcagaggaagggcctgcaggaagatgtaaataattaacataaagaacttttcctttaatagaggagctgaaagaagatcagggaggctacatagagagtgtcagaagggtaatgctagctgaggctggaggtgggccagaccatccagggccatggaaactggatttctttctgagtgcattgggaaacctgcagggttttaagcaggaaactgaaggatccaatttatattaaaaacattactctgg

SEQ ID NO: 3752 - DNA, 362 bp, Homo sapiens
  misc_feature (1)...(362): n = g, a, c or t
ccattttgngtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccag

SEQ ID NO: 3753 - DNA, 240 bp, Homo sapiens
  misc_feature (1)...(240): n = g, a, c or t
ttgtgctgccgttcgtgttttgtggggaggcgcagtgtctgtaggccgtgtggcttgcagagtgtctttcggcccaggtaaacgccgctgtgaaggactccaggaaagctgctcccatcacaatccccctgcctgacagccacaggtaagaacacagaatgcacccacaagatggaactgaaagcaaattaatttataaaaaaaaaaaagaanaaagaaagaaaaaaagagaaantttac

SEQ ID NO: 3754 - DNA, 303 bp, Homo sapiens
  misc_feature (1)...(303): n = g, a, c or t
aaaggtatccgggagattggcagtttgtaatacaagaattatgtgcccccnagaaggtttctggcctcagtgtctctatctgtctaatgggcagcagatcagacaaggtctgtcggctctgacaggttcaaggccatctcctctaaatgactcactgtctctggagaaatatgtgagcattttcacaggggaaaagaggggtgcattccacagcccctgccccgaggaggtctgagaaggtgaaggaaggccagatgcagagagacaggggatgacaaatgacagctcanatttctcccatgg

SEQ ID NO: 3755 - DNA, 441 bp, Homo sapiens
ctgctccaaagacacccagtatctcaaggattctctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgagctgcacctggctctcggctgaggattgtcaccccaagtcttccag

SEQ ID NO: 3756 - DNA, 311 bp, Homo sapiens
cctccacgaagaatatttttggccgatactcttcacagcggatgaaggattggcaggagattatggctctgtatgagaaggacaacacctacttaggtaaagtggcccggcctgggagccctggtatccatggggaagcccactctcagagttctgagataccaggcttataggaggcacagtctgtgagtgggaagagactggagtgtagatgttgcccatttgtaggtggtaaaatcaattgtttttgatggaattgattttccctgagtggagtgctgggggaaggaggaggtccaggccggtagtgg

SEQ ID NO: 3757 - DNA, 290 bp, Homo sapiens
ctgcctgcgcccccgggcttcgcagccttgcttgttttctctggacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacattt

SEQ ID NO: 3758 - DNA, 490 bp, Homo sapiens
  misc_feature (1)...(490): n = g, a, c or t
attgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcccgcccccctgacgagcatcacaaaaatcgacgctcaagtcaaaagggggcgaaaacccgacaggactattaaagataccaggcgttnccccctggaa

SEQ ID NO: 3759 - DNA, 319 bp, Homo sapiens
ccaaaacctgcagtaggggttgcactactgatactcatgccagccatctgctgattcatctgtgagaggctccactggggctgctgagcttgcggcaggccaaacttactctggggtgcacccatttgtcccaccattcctccttgggggccaacaacgttctgaggaagtggcatcacaccagtttgtgcatttcccataaacccattgggcatgggcatgcccaccatcatgcttggactctgtcccatcacatttcctataaggccaggagctgcaggcacaggcacgcccatcgatggaaagccctgaaatgcag

SEQ ID NO: 3760 - DNA, 291 bp, Homo sapiens
ctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagccaactagccctttcagcgtcatgtgaccagcgcgccccattcagcttggctggtgtcgtttcacatgacccaggctgg

SEQ ID NO: 3761 - DNA, 269 bp, Homo sapiens; identical to SEQ ID NO: 2613

SEQ ID NO: 3762 - DNA, 319 bp, Homo sapiens
  misc_feature (1)...(319): n = g, a, c or t
gtccatgtgactgaactttagacagtgagatataagcagatatcttctgtggcagtgttaggaaactattaaagacagtaagaacattgccctttgccttctttttcctttcttcatttttctgcctggaatgcaagtgtgatggctaacaccctancagccattttagattatgaagatgagagtcactccccangaagggtggacctgaaagctggattctagatgtggaatgacaataccaccctggaccacctacctgtangctgtgtgtgtgtgtgtgngattgacanagagagaaganagatagagagattcc

SEQ ID NO: 3763 - DNA, 198 bp, Homo sapiens
ctgcaaccctgtctacagtaacatctggggatctagatttattcactgagcaaactacaaaatcagaagaagtggcaaagaaacaactttccaaagactccatcttatctctgtatggcacaagaaccattcaacagcaaagtactcctggtgtatttatgggacccacaaatataccatttacctcacaagcaccag

SEQ ID NO: 3764 - DNA, 428 bp, Homo sapiens
cctgggcaccttcaggaaggccacctcctatcaggagcccttttcgtacatgggggagctcttttccaactcttgttacccctatgacagaatcctagtgcctagcattgaatgagctatgtggaatatcaggttaccagggagaaggtagcttggagtcaggagatcaagaaattctcatacctttcatctcttcccagttttccttgtagacagctagccaagcccaacgtccagagcttaccattatcaaaccaaggcacacacatgcacgcgctcagcttagaagacctctatccagcacagatgtccacaaagatacacccttttgttgggagttaatgtccatgttctttcttgttctcattacggtcccaccccctcctccagatcgggcagggctccaagagaaaaggaaagtagaacag

SEQ ID NO: 3765 - DNA, 265 bp, Homo sapiens
ctgtgaaacagaaggcactttgtgctaaaattcagagggtctctcaagagagaacgccacagcagagagacccaatccgcctaagttgcaggcgaccctttagggtggggaggagtatcccccaggaaggcatctgcaaaggaaaaaattgtaatcatgattccaaggcaaaatggctaaagttgggagagaagaaataccaagagagaagacaaaacatggctgtgccaaggactgaggagtgagctttacaaggacttatcag

SEQ ID NO: 3766 - DNA, 216 bp, Homo sapiens
ccaggctcaggccctggggtgaaaggagacaggtgctgccaagaccatacatcagtcatctggcagcagctcgagaagcatgtcctccacgccgtcaatcttgatgtggtacactaagcgccagaaactggagtctgaggatcggtatcgtccatcagggtagagctgccacatgataggcagcaggcttgggcctatctgggtgggggtcatagg

SEQ ID NO: 3767 - DNA, 334 bp, Homo sapiens
ctgaagcaacttgggattaattgcttgattagcttcacgaagcacagagataaggtcgctcacttgctttatgttattaggtgtaaagaaagtgtatgctgtgcctgttttggtactgcgagcagttcttccaattcgatgaatataatcctctgaggagttagggtagtcataattgatgacaaatttcacatcttccacatctgtaaggtgttgcagtgtggcaaaatagcaatgtacggagttttgcacaccacaacagccagaccaaaaataaaaagttagacaattgtattcccaagaaggtacgggctgcaaaaaatacagttaaaat

SEQ ID NO: 3768 - DNA, 235 bp, Homo sapiens
cctaccataacaacatctttacacacagtcaggtaggtctggataatttgctgataaatgaccctatgaagcttcaggtagtcttcttcttgatcttgaataaaagataaaattttgctttctaaccaaaagccagtgtcttccaacatggacaaatacacctttccttctgagcagaacttgtgctgaagatggatgctcaggcgacagtggagaccaaaggctcgcggggcag

SEQ ID NO: 3769 - DNA, 221 bp, Homo sapiens
aaagtggcccagggtcaagctctgagccttcagcatcctccggtatggaatttcttccccacagaaaaagtaagtgacaaccaactcactggcctggagcgcgtggacacctgtcagtttctttggctctttgtgatcttctggagccaggcttggattggagaagggtgtggctcccgtctgaacagtggccgaatgattcctgtccctctgctgactgg

SEQ ID NO: 3770 - DNA, 445 bp, Homo sapiens
aaaaagccaaatacatttctgacaaatggaatgtctgataattatgtgactgaatctcacatttactaattctgaaactagttaataccaaatagttcttaaaagacaaaggaagagaggtgatttctctgtggaaaggttgggcctaagggtcaaggatggttctaagtcatcagactacagagttttaatctaaacatttttcttcattttttactatgttagaaagagcaccctgagatattaaactactacccaaagcatctttttcaaaaagtgaaaaaaggaaaagggaggcactccatcatggattcgcactaaaacaaatatcttctatatatttgaagttgaatgctcttaactaccaactgaatggcacgttcacatatgaagacttcttgtgattcctgcaagacagtgggagtgtgaatgacccctgctgtgg

SEQ ID NO: 3771 - DNA, 203 bp, Homo sapiens
ccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctatttttttt

SEQ ID NO: 3772 - DNA, 246 bp, Homo sapiens
cctggaaggtgtgcaggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaag

SEQ ID NO: 3773 - DNA, 394 bp, Homo sapiens
ctggctcccagcctcgtctacctctgcagagcaaagggccaagatgagaacggtatagccacatgtgtgcgcgcatgtacatgcacacagacacactcatgcattcacgcactcacacacaccaagatctgacggttgtagctggataggggagattctgggaagatgaacagaatcctgaggatgtcaggatgaagaagccataggagcatgatcttacaacttcaaattgatgtccatgagtaaggaggaactgaaggataaaggcaagactactggggtttcagcaaaggtaaagatggctgggtggtgagatgagtggagagagtacctgtgtcatagccctgagggagtccagagatgaaactatgggccccagactttactgcagcag

SEQ ID NO: 3774 - DNA, 183 bp, Homo sapiens
aaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcag

SEQ ID NO: 3775 - DNA, 219 bp, Homo sapiens
ctgcaggacatgtagagaaaccaaaccgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacagg

SEQ ID NO: 3776 - DNA, 357 bp, Homo sapiens
ctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccagagggccaggaactcgtggtgactgtcactgctcggtgcctggcgctgtctcagccagtagatgcgcatgttactgagggagattttagcctcgcaggacagcatcaccatcttgttggtttgcacctttatgtatgcaggggtctgctggaggactgagttgccatggagaactgtcag

SEQ ID NO: 3777 - DNA, 349 bp, Homo sapiens
aaacttgttaaaataccttgttgctagtgctcagaacatctaggtacagtctttatttttaagacagtatctatcctaggcaaatgagagcttgtttttatgtatttaagagtttcctcttgtcatttcaatgtcaaattgatttgactcaatttcatgatttcatctcgctcaaggccatcaaccggtcagagccagagcccttcaaaggctgtatgtgagtatatgagggaaaactttccacataattttacatcatttctatctcatagcagttttagttttctcatagctatctcatagcagttttagttttctcaaattctatgctgtttttgtactactgcag

SEQ ID NO: 3778 - DNA, 370 bp, Homo sapiens
  misc_feature (1)...(370): n = g, a, c or t
ctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacaatctcan

SEQ ID NO: 3779 - DNA, 370 bp, Homo sapiens
aaaatactatttctttggaaatcgaaattcaagaaaattggaataataataattaaaaaaaacctctttgggtaaattttacctgcgttcattggttttaacatgctgccactttttctctttctctctccctctctctttctgcaccattttcaggtaggtggcatatattgtctcctttcaccctttaacacatcccaagaacaggacattatcttctgtaaccgcaatatgcttaccaagttgagaacattttctgcccagcagtccatgttccgggtccatcagttctttgttagtcagtttccgtctgaggcagcgatggcaaggggtcaaggtggacagcagccagtggtagacttgtggattt

SEQ ID NO: 3780 - DNA, 240 bp, Homo sapiens
aaaaaacaaataggtggaaattgggagtttgtaatcagagatagtcaaacactaacgaggtacaatttgaaagtaacattattcagcttctcaaatcaacctattattttttttaccaacttactgtgtttcccaaggtcttaacctcattctagattgttaactacagctaggtttaccagggttcaaggagttgaatgtgaaatactagaggcttatcttgaaggcaaaactttaagg

SEQ ID NO: 3781 - DNA, 320 bp, Homo sapiens
  misc_feature (1)...(320): n = g, a, c or t
ctganaccacaaacaggtactttgagggagatagggtgggataggagttttatgccaaacaggttggctaaacagacatattcaacaggtcacagggggaactatgaatattcatgaaagggggtcatatgtgtgcttgataagcaaacatatgtgttacatacatcccatgttcaccttcgagtggagaattaacattaaaatgcagtaaaattaggttctgtatgttgaaaggtgaaacacaggacacgaagacactttgtacacagcctcggtgaaccagccagaaccagcccatggttgaatactttgtagcctag

SEQ ID NO: 3782 - DNA, 285 bp, Homo sapiens
  misc_feature (1)...(285): n = g, a, c or t
ccatngggnangcccaagagacgtctctgaagccaccgttcctgattattcagaggcagggtccacagtgagtgactcggtggggctggaggaacccanggtgacccananggggctctggagcgggtccctaacatctgaaaaagtcctcccagggaactcggagctggaacttccangcagcttcgggggtgacattngtatccggccagnctagctgggaaaggagaccttgtgtcctggcaacagggagagncaggactgggatggacctcngncgcnact

SEQ ID NO: 3783 - DNA, 441 bp, Homo sapiens
ccagagatggcccttcaagcaacagctcattccacagcagcgaagaggaagggactgaccttgaaggagacatgctggactgcagtgggtctcggcctctccttatggagtctgaagaagaagatgagagctgcagaccccccccggggaagctgggaggagccgttccattcgctccaccagaagtctctcctgagcaagcaaagacagtgcaaggtggaagaaagaaccagtttcaagccttcacacagccagccactgatgggctcagtgagccagatgtttttgccatagctcccttcaggagctcaagggttccaaatgatgacatggacattttctccaaagccccatttgtctccaagagcagtatggctccttcccagccagaggagtcagacgtgtttttgagagctcctttcactaagaagaaaagcatgg

SEQ ID NO: 3784 - DNA, 380 bp, Homo sapiens
  misc_feature (1)...(380): n = g, a, c or t
ctganntcaaacaccttgcacaccagctcctctccgctgtgcagatgcacggcacgaaaaacgtggtctccctccagaggttccaacaataagtatttcccgatacaagaaacgcaatgcgacaagttcggagtctcgggcgggctcggggagccgaggttcgggctgaaactctggctgggctccgcggaccttatagacgacaactcttcgaaatcctgggttttgttccgcgatctcccatatctcgctattgtgatgggggtagacctgtgtatgttcatgagtgtgaggatcgcacacgacaaacaaaaaaaaacccgctggagagatgagtcgctggcgagtgcggttgcaggcgcctcggtgccactgatttt

SEQ ID NO: 3785 - DNA, 274 bp, Homo sapiens
ctgctcattgaggagtgttgaacttcaacctgagggggccgacagtgccctccaagacagagacgactgaacttttggggtggagactagaggcaggagctgagggactgattccagtggttggaaaactgaggcagccacctaaggtggaggtgggggaatagtgtttcccaggaagctcattgagttgtgtgcgggtggctgtgcattggggacacataccccttagtactgtagcatgaaacaaaggcttaggggccaacaaggcttccag

SEQ ID NO: 3786 - DNA, 351 bp, Homo sapiens
aaatgtgtttggtaactattggaaaattttctcttcttaattatgttctgtgtattgtattgatcctgaattgtatagttaatagtgacttttcaagatggggcatgctcaagatcgaacagataataaaagatatgcacatagaatactaattgtagcttttttttcttctggaacatttcagttcttcaccctctagcttcttccaaatatcagtattcccacttgcatagaagtgcagaattgaagagttgggtgttacataaataggctaagtgtttggatgacttgttcaaggtgacaaaattttaattccagttttctgactcctagtacaccacacacaccttt

SEQ ID NO: 3787 - DNA, 169 bp, Homo sapiens
aaaaacacaggttgccaaggcaggctgcctagttcctatcatggccctgccacttggcagttctatgccctccacttctctgtgcctcagttccctcaggaagaactgagtattcactctttccgtgcgctgagcacagtggagggcatgagggcactgagaggagcag

SEQ ID NO: 3788 - DNA, 237 bp, Homo sapiens
cctgaccatggagaccccggcttggtcccacctaatctctgcagaccacaggttggtgacgggtctctgggatgaggctggagctgggagcacctcaggctcaaaggaacttagcatttggctccaggaatggatagcccagggtgggcggcagcgtttccattttcaacacacccaacctcagcacaagactcccagatctgcaacggggatggtgacagtctcagtcgactgtgg

SEQ ID NO: 3789 - DNA, 446 bp, Homo sapiens
ccattattcagttccaaagctgcttccacgttttcaggtatctttacagcaatacccttctgctctggtaccaatcttctgtattggtctgttcttatactgctgtaaagacatacctgtgactgggtaatttataaagataagaggttgaatcagctcctgttctgtgggctgttcagacttctgcttttggggtggcctcaggaaacttacaatcatggtcaaagttgaagaggaagaaggtacatcatcacatgacctgagaaggggagacagagagagagaaggaggaggtggtacacaatttcaaacaaccagatcttgttaaaaactctatcatgagaacagcaagggggaaatccaatcccgtgattcaattacctcccacgaagaccctcctccaattctgagaatgaaaacttgacatgatatttgggtgggataac

SEQ ID NO: 3790 - DNA, 376 bp, Homo sapiens
cctgaaggacccagggccctctggctggatgcgtttgcctatcaggacccagaattacttacagacctgtttagggctaggcttggcctctttcttgagctcatctggaggggtgtggcaacactcattcttcatccttattctccccggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgttt

SEQ ID NO: 3791 - DNA, 298 bp, Homo sapiens
aaagctcgtaaattatctcaggaattttccatttaatattttcaggctgtggctgaccgtgagtaacaaacccaggaaagcgaaactgcagaacagtggatgggagaaagggtgaattactgtatattcatgagggatattagtccatagtttcttttttcccttttaacaaatttttgggttttgtatatagtttgtctggttttggtatcagggtaatactagcttcataaaatgaattggaaagcgtttcttctgttttcctaaaaagattatatggaattagcattcattcttt

SEQ ID NO: 3792 - DNA, 117 bp, Homo sapiens
  misc_feature (1)...(117): n = g, a, c or t
aggtgcaaaccaacaagatggtgatgctgtcctgcgaggctaaaatctccctcagtaacatgcgcatctactggctgagacagcgccangcaccgagcagtgacagtcaccactagt

SEQ ID NO: 3793 - DNA, 322 bp, Homo sapiens
ctggatcatacggttgcagtccgtctaagaaataattactaatgaaactggcagagctttgactgttttagctttgcaagaaacccaaatgaggaatgctatctatcagaaaagactggccttagactacttgctagtagctgaaggagtttgtggaaaatttaacttaaccaactgctgcctacaaataaatgatcaaggacaggtggttaaaaacatagtcagggacatgacaaaggttgcacatgtgcctgtagaggtttggcacgagtttaatcctgagtctttatttgaaaaatggtttccagctataggaggattt

SEQ ID NO: 3794 - DNA, 390 bp, Homo sapiens
  misc_feature (1)...(390): n = g, a, c or t
ctgcngcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaangagtgcgggaaccgctgctgtgcctttagcaacagcaagaaaaccagtaangcntagaaggaaagtcaagtgcaggagttggtggagctnatatanaaaatggtgcattgcaacnaaggggcttactttttctnatgacatatacaangacacacacgaaa

SEQ ID NO: 3795 - DNA, 323 bp, Homo sapiens
  misc_feature (1)...(323): n = g, a, c or t
ncgaggtggacnnctccatcctgcagttcctgccatgagcctcgggctcctgtgctgtggggccttttctctcctgtgggcaggtccagtgaatgctggtgtcactcanaccccaaaattccgggtcctgaanacaggacagagcatgacactgctgtgtgcccangatatgaaccatgaatacatgtactggtatcnacaanacccangcatggggctgangctgattcattactcanttggtgagggtacaactgccaaanganaggtccctgatggctacaatgtctccanattaaaaaaacanaatttcctgctngggt

SEQ ID NO: 3796 - DNA, 219 bp, Homo sapiens
  misc_feature (1)...(219): n = g, a, c or t
ctgacaagaggcacanncacagagctatgaggacagtcttatttaggcaaaccattcttatactcatgcgtaccagaaaaatgtctttgtctcttctgtgacactgctagatgctggggatataacacacatcgctgtccctaccctcacattaggggtagctgtaattatattctggtcaagaactgtgatgctaaatttcaattcttactagctttt

SEQ ID NO: 3797 - DNA, 240 bp, Homo sapiens
ctgggtgtgtgccgcgtagtgaaaatcctcttgtcagggggtatccggggagcttcgtaacccgaatggatgcgctctgcaatcagcaggcagcacggctgtgcaggggccccatctgagacccggatcttggtcacatacggggttaggcggaatggctggtaccgaggccctggatcccggtcaggacctcctctgatacggcagaagacggacttctcctgggtaaagtccctgagg

SEQ ID NO: 3798 - DNA, 333 bp, Homo sapiens
aaaaattcagatttccagttcgtatacatataagcagagcaaaaatttcattaatctaataatggaattttcaatttgctggctaacaaataaattgatctaatttttagaaactacaagaacaaatgtgcatgaatttaaccgtgttcaccaggaatcaagaggatgaatgttactaggtacaaagggtcttctgtgtgtgtgacaagaatctaggcaacaccattattcataggttaaggatgctatttgctccgtatctgaaaaaaagaagatataaattcaatgtctagaatgtagccatgacagggaaaatattagagccactatttt

SEQ ID NO: 3799 - DNA, 134 bp, Homo sapiens
tccgccagtgagtccttggtttttaataatgagaagtcctttcccccaaggtgtgagcattgcagcgcagtgtgtgtgtgtggttagagccagcttagtccttcactttgtcgaccgaagtgggagctcaacag

SEQ ID NO: 3800 - DNA, 184 bp, Homo sapiens
cctggaggcccagggtggacgtggtcctcagccagaccaagggcctcctctagtggaggggcttcctgggctctctctgcactgcccctcagggtgctttctggggtccagtcaatggatcttacacacccatgaacactgagcccttggggagacgtgtccaggcttcagtttcccctcccag

SEQ ID NO: 3801 - DNA, 163 bp, Homo sapiens
cctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcag

SEQ ID NO: 3802 - DNA, 171 bp, Homo sapiens
gcttgaggctagcccagtgaagaaaaaccagagactcatgtttccaggggtcagtctgtcaggcaggaaggacccaggatttgaacccagcttcagtgtgcaggctccgaggctgcccaggacgggaaagtccaaggaaggggcctggtggtgctccacttgcagttcttt

SEQ ID NO: 3803 - DNA, 344 bp, Homo sapiens
aaattatatatattatatatgtaacatgatcagcaagtctggaaacataacgaagttttatagtattgatttattcctatcactctgagatatggtgacattacatgatatgttcaacgtgttgttcctcattagcaatgtgttatgcataatggggaccaacatgggacattaatacaacatttctatcagtgcctgcacatgcttctgtgatacgttgcctccaatgatttttgtctctaattttcagaatataaacctgctccattagcattttctggaagaagcaatcaaatgggttaatctgtgaaagtaaatgttatctatatttcccaacattatgg

SEQ ID NO: 3804 - DNA, 208 bp, Homo sapiens
aaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaattt

SEQ ID NO: 3805 - DNA, 410 bp, Homo sapiens
ctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtggagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcagg

SEQ ID NO: 3806 - DNA, 420 bp, Homo sapiens
aaaccttccagaaagcatgaatccaaaaggaaatgtccaacaggtgatatgaaccagatattttatggcctttcctgtttcagtctcaaactttctaaacatcaatggggaaaaaaaattctctagagtttttcagttttattcttctagagcacaattttccggcctgttactgagtacggtcttctaacaggtacacaattaactcataagtagacaacacaatggcagtatttgggatctgccggataagctgggcaaacagtcctctataaaaggcaaggtggccttcttcccggaacaccaggcgcgccgtctggacaaaagacttgtacttggtgccctcttcccggagcctcgtccttatgacttcgtgtggataagcaatgcaggaggcacagcccttagaaagagcagcag

SEQ ID NO: 3807 - DNA, 227 bp, Homo sapiens
tgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccagg

SEQ ID NO: 3808 - DNA, 269 bp, Homo sapiens
ctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcag

SEQ ID NO: 3809 - DNA, 259 bp, Homo sapiens
ccttcaaggtgatctgccatcttaccggtttgttctctggcttgtctacgacgagtcctcctggcctcccgctctgcaatgcgacgttttgcatgctcctgatacagtgcccgatcgcgtccaaaggagtcaagatttggtgccatcagagctttgtcttcaagatggactgacttgaatggcttgaaaactccgaagattcatctttaatatcatcttgtcgtctttggacaaggcgggaagctcgctgtttgtacag

SEQ ID NO: 3810 - DNA, 402 bp, Homo sapiens
caaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcgcggggtacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctgg

SEQ ID NO: 3811 - DNA, 210 bp, Homo sapiens
ctgaataggcacccaaaagtccgtgactaaatttcgtttgtctttttgatagcaaattatgttaagagacagtgatggctagggctcaacaattttgtattcccatgtttgtgtgagacagggtttgttttcccttgaacttggttagaattgtgctactgtgaacgctgatcctgcatatggaagtcccacttcggtgacatttcctgg

SEQ ID NO: 3812 - DNA, 201 bp, Homo sapiens
ctgttttccagcaaagatcagcctctgctggtcaggagggatgccttccttatcttggatctttgccttgacattctcgatggtgtcactgggctcaacctcgagggtgatggtcttaccagtcagagtcttcacgaagatctgcattgtcaagtgacgatcacagcgatccacaaacaagaaccgcgacccaaatcccgg

SEQ ID NO: 3813 - DNA, 234 bp, Homo sapiens
gtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttcca

SEQ ID NO: 3814 - DNA, 300 bp, Homo sapiens
gtgcagcaagtagctgctgaatattgtagagcatgtcgcttgaagtctacttgtatctacggtggtgctcctaggggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttgg

SEQ ID NO: 3815 - DNA, 462 bp, Homo sapiens
ctggcttctggtgtctctcatcacaccactgcggacgctgtctgtagagcagccttggtgtgggtgactctgaagctggagtgatgggaccccagctatccttgttttttaccgccttgtctggcactgtgaccacgcttcagggctgcttctgggggtcttggtccctggatgtgccatttccttgcccttctgaccctcacacttcttccaaagtcttgagcagagttgggggccaatggtagcattgctgtcatctctgggaggagagtgagtatacaagtcagtgacagttcagccaggctcccttgggtttgggaagaggcactgcccttctgtgctgtggatcctgcttgtctgctctggagtccccccacccttgccaggagcttcacaaaccagagacgggctgtcagcaagagctcagacaggatgtggtacaagtgcaggtgcacgagttta

SEQ ID NO: 3816 - DNA, 469 bp, Homo sapiens
ccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcatgtttttgcaacccggttcgttgatacctgggccagggatgaggacactgtgctcaagcatcttagggcctctatgaagaaactaacaagaaagcagggggacctgcaacccccagccaaacccgacaagggtcgtcggcatccag

SEQ ID NO: 3817 - DNA, 290 bp, Homo sapiens
aaatgtcaaggcagagaaatacattgatcatgttaaggtcatgtgatgtggtggcgcagtaatgacttcctgaggaaacagagaaattggatgttttgtgatttagctatgtgcactaaacttattttccatgttttgagagcacattaaacattcacgtacaacgtgggactaggttggcttgtacccagaacgtccaacccaatgccaccctttgaatcgctgtgaacactgttctgttgctgttcagagaaaacaagcaaggctgcgaagcccgggggtgcaggcag

SEQ ID NO: 3818 - DNA, 280 bp, Homo sapiens
aaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaattt

SEQ ID NO: 3819 - DNA, 465 bp, Homo sapiens
ccaggaaaagactgaccattggtctccaaagatgctggatagcattgccagatcacatctaaacaactccgactgcagtttcacacaggtggtggtccaaaatttgtaaaaaagtgaaagtgatgtgtgaagatagggctgagatgagaggaaatggattcaagcctcattggaaaagctgagttagtttgttactttaatttgagcatagacaatggggtcaaagtctgcagaatggttctcagccaagtgattgctcttttcttctgagagtttgaaagttgtgctggcataggtaagtgattcccctgggatggatgaaagcttggctggaggatctgagtgaggatctggggcctggggcttggagtgatattttctgtagctctttatgatgaggaagataaaggctatcagcagcagtgtcagtagaaccccagcacaaaaggcaaggattaaatgttt

SEQ ID NO: 3820 - DNA, 318 bp, Homo sapiens
ctgcatgcctctctgcctcctctgtctgcccaccagcctcctgcagtgtgctactctgctctgtgactgctcctcatgcagctcgcagccatgtttcctctctgcttcttgatttgcttcagctccttctagtgccttgaaactgaagctggcctgtagttgggatcaaagatggagggagaggggagattgtactatggatagtgtagggcaagaagtgaattcttacactggaatgataaaaggaacctgcttcctgagtttcttaaaattgtgtctggaactcagatttgcactgcctagtatagtagctgctgg

SEQ ID NO: 3821 - DNA, 294 bp, Homo sapiens
ccaggaagtagtcacagcgagacacagcctgcacctctgcaatgttaagcaggtaactctgctcctctaccacttgactattggacttctcaacttcagccaaagagcctgtgaagaacttccgagagcgagccagctcatcctggaccctgcgctcctcatgcccatactcctggagaactgctttataccttgcctgaaggtccttggagacaccttccaaggctgccttccgccgctgcagctcccccataagttcccgcagacgagttaacttctctccaaagtcccgac

SEQ ID NO: 3822 - DNA, 211 bp, Homo sapiens
ctgctttgctttctctttgcccaaatctgaagccaaaacaagaaagtgggcatccaggactgcttctcttgctcgggacacttcattaaacagagtgttagcctcttcaaggacctctgttaatttgtcaccggcattcagtatgtcctcacggttttgttggacggagttgatgagcgcccggtactgatggcggatctggcggcacagg

SEQ ID NO: 3823 - DNA, 208 bp, Homo sapiens
ctgggaagtctggcaaagatccagtggcccacatatccctgcttgtcttgtcccctctcaggaggatgtgttggctttcaaagctgatgtccaagtggaagagccactgcagagtggagaagcaccgaaccaaacccaacacggcatccagggacaaaccgttctcactgaggttcaaggactgcagagctcccagccctgggagcag

SEQ ID NO: 3824 - DNA, 283 bp, Homo sapiens
aaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgttt

SEQ ID NO: 3825 - DNA, 351 bp, Homo sapiens
cctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtgg

SEQ ID NO: 3826 - DNA, 460 bp, Homo sapiens
  misc_feature (1)...(460): n = g, a, c or t
aaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggnttgccctcnagtgtgcactgtn

SEQ ID NO: 3827 - DNA, 415 bp, Homo sapiens
ccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgcttatttggc

SEQ ID NO: 3828 - DNA, 337 bp, Homo sapiens
cttcacggaggttactgtgtgagacgaaagacagttcactgttcatcactggaaatactgtacgtgctactgaaaaacaaggattttattgaggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactgg

SEQ ID NO: 3829 - DNA, 153 bp, Homo sapiens
cctgaggtcacctggctaggaattcatagggcaggatttaatccgggtgcctgagtccagaaccttgactctgaagccctgttttgagctaaatgcagcagcagcataaacagcccgttttgtgcctcaaaaggtgaacagtgggaggcacag

SEQ ID NO: 3830 - DNA, 473 bp, Homo sapiens
  misc_feature (1)...(473): n = g, a, c or t
ccgacgtctgtgggttctggagcaactgccctcctaaggtctgtccttagcagggaccttcccctgactcatgaatgctggaatcaaggaccccaacaccataatcatcaaggtgatacatctgtccttcattgtcatgtgcttcacaacagagtaagtgctggcacacagggtcccaggctgggatggcccatgtgtggatggtgcttccagtaacgaggtggggcacacttctacctggggcttgaaactcccagtgggacaagaaaacccagaccccactcctcaccccttccctacctgagctcttcctcctacacatcacaacagccaccacagctcctaggacagctaggacagccaggacagccaggccagcaacgatgcccacgatggggatggtgggctgggaagatggctctgggaaaggaggggaaggtgaggggccctgacccccaacctcagccctgacn

SEQ ID NO: 3831 - DNA, 227 bp, Homo sapiens
ggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaaa

SEQ ID NO: 3832 - DNA, 265 bp, Homo sapiens
ctgaaacgcatgacctcgtgggtcctgaactgacctctggtcacaacacccagggcctggttctcccattgggtaaatcttcagaggaacggatggagaggaacgcagtggcttgctttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccag

SEQ ID NO: 3833 - DNA, 329 bp, Homo sapiens
  misc_feature (1)...(329): n = g, a, c or t
ccaatacggctatgggtgtaggcagctttcagaggaaattagtggtctgggcttgcctccagctccccaggggcagccccagtagctacactgtccagacagcacaagaccangcttggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaagg

SEQ ID NO: 3834 - DNA, 194 bp, Homo sapiens
ccagcttatgaggcagatggtctcagttacaacttcgctgctttcccaaactcctgcagccctcctgagtccgacttccgttgatagcaaggcactgggtggcagcaacctttttttctagtagttttttcccagcagttttccatttctccacagtatccttttcatttagaggagcttaataaatgcttttt

SEQ ID NO: 3835 - DNA, 159 bp, Homo sapiens
cctgtgcagtcttaggctatctgtgctttcatttttcttcacacggtggcaggtctacactgcccagccccaggggtgggccttcctcacctcttccctcttgattttcagtctcagcttttccagtcccctcccccaaaccagcaatagcagaagcag

SEQ ID NO: 3836 - DNA, 328 bp, Homo sapiens
aaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcag

SEQ ID NO: 3837 - DNA, 212 bp, Homo sapiens
gggaggatggcctaagcctgagaaattgagactacagtgagctgtgactgcaccacttgcacttcagcctgggtgtcagagtgagaccctgtctcaaaaagaaaaaaagaaacagttacttcttgtcttatacaagtcattccagcaaacagaaaaagtgtgaaagctgtcaacctctttaggctgaagaatcctgattcccaaatctgtgg

SEQ ID NO: 3838 - DNA, 356 bp, Homo sapiens
ttttttaagaaagacatctggattgtagggtggactcgataacctggtcattatttttttgaagccaaaatatccatttatactatgtacctggtgaccagtgtctctcattttaactgaggggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgctttt

SEQ ID NO: 3839 - DNA, 272 bp, Homo sapiens
ccacagaaaaatgggcagttaacattccttttactttagttttgagggagggggaatggagagagggagagaggacacagggaaacttacagcaaccattttcgctgtttatatttttcttgaggaagaaaacaaacgcacaaatcctggtgttaggaatagtttaagcatatatcttcagtattattcttccaggaccaaagtaagtcctgatgcaggaaatgagtgagtttcacagcttttggagcccttactccatccaggaagcccag

SEQ ID NO: 3840 - DNA, 205 bp, Homo sapiens
ctgtggtggtgccttttggagaagagcagagatacacatgccatgtacagcatgaggggctgccgaagcccctcaccctgagatgggagccgtcttcccagtccaccgtccccatcgtggggcattgttgctggcctggctgtcctagcagttgtggtcatcggagctgtggtcgctgctgtgatgtgtaggaggaagagctcag

SEQ ID NO: 3841 - DNA, 168 bp, Homo sapiens
ctgccatgtggcagcagcaggagctactagaatattctcagcacaggaatgaggcttccttggtttccatgtctgtaagggttactgatcacttaccttcttctctttcagacttgaaatctgtagacatttctttattgatatggcaaattgcttgcagatattttt

SEQ ID NO: 3842 - DNA, 251 bp, Homo sapiens
aaagaagacagcgtctgctttgaacaggccctttctgagattagcctcaccttaatactctttgctctgcaataggccaatcaatatccacatctatatccacactatgttcagctcgcatttcgtagtatgccatttttccaccctgcaagtaacccatctctatcaaatgtcttttagcaaaataaaatgagccattttcatataattctccatcccagtcttgtcgacgaggccgtttagctggattt

SEQ ID NO: 3843 - DNA, 409 bp, Homo sapiens
  misc_feature (1)...(409): n = g, a, c or t
aaaatggtttgaaatgtagggaggttttgtctgtttgtgtgaagaatattttgcttcctttgggaagttctggggtttagaaacctttcttctgcctgggcgggtgaggaggttggcctctggccttggacctgcctctggatgttgactgggggaacggagttcagcccgcctgtggtctgcggatgccggattctaggctgtgaattctccacccactgatttgggtggatgtaagtgagtctccctgtcccctctttctctcctcatgtgtgaacataaaggtactcatgcatcacaggactttcctgtaggtgctgatgtctatacaagcactttgctgttataaaggactgctganctgttgaagtcagtaactctttctgtcttcctgtatgtaaaataaaat

SEQ ID NO: 3844 - DNA, 232 bp, Homo sapiens
tgagagttcctgtgctgtgtggaattcaacactaatctgctgtaagtatggagctgggtatgtggaacatttgcagggaagtttgtttctccgcttgtttttccaggggtattcgagatgacattgaagaggaagatgaccaagtgagttcctatgcagtatttctatcttttatttttatccacaaagtctatactggggacaagctagagcttgccttcactcaaaatgg

SEQ ID NO: 3845 - DNA, 103 bp, Homo sapiens
taaaaaaatgaaagctagacaatagctgcaattttttgttaacaaagcaaatcacttcaacgtgaataggagtaatctcatctctgcacctccatggacctca

SEQ ID NO: 3846 - DNA, 190 bp, Homo sapiens
  misc_feature (1)...(190): n = g, a, c or t
aaaggtatccgggagattggcagtttgtaatacaagaattatgtgcccccnagaaggnttctggcctcagtgtctctatctgtctaatgggcagcagatcagacaagggnctgtcngctnttgacagggttcaanggcatctcctntaaatgactcactgtctctggagaaatatgtgancattttcaca

SEQ ID NO: 3847 - DNA, 287 bp, Homo sapiens
ctgccgttgacagaaggaaagattgtccattcggggggtgcccgaacgtcgccccttctccggcccagaacctttttgtaagttacaccctcacgttctgctccttccacttctgcaaactttccagggttgggtaggcaaaaaggcggcttcgctgaggactgtttactgctttaggtttttttggaattcaaaactgttaactgctgacatgaatggtgtgctatgacctagttatacaagacaaagatggattccaagtcataaggaaaaatccagatcttttt

SEQ ID NO: 3848 - DNA, 244 bp, Homo sapiens
ccttggtgaccatcagtttcagatgcaactcttacagcggagtcttggaatcatgcaaacagtgaagggatttttttatgtttcattacttcttgacattctgaaagagataactggaaagttccttgattcagaaaacagattcagatgaagaagttgcaatgctgttggacacagtccagaaagtatttcagaaaatgttggaatgtattgcacggagcttcaggaagcagccggaagaagg

SEQ ID NO: 3849 - DNA, 232 bp, Homo sapiens
ccgatatggctgagatcgagaaattcgataagtcgaaactgaagaagacagagacgcaagagaaaaatccactgccttccaaagaaacgattgaacaggagaagcaagcaggcgaaatcgtaatgaggcgtgcgccgccaatatgcactgtacattccacaagcattgccttcttattttacttcttttagctgtttaactttgtaagatgcaaagaggttggatcaagttt

SEQ ID NO: 3850 - DNA, 330 bp, Homo sapiens
  misc_feature (1)...(330): n = g, a, c or t
aaaaaaaagatccaagatgggcattatattcattgtatgtttacaaattcttacattttagttattcttcagcaaaaaatccagatggatgtttttttcagaaagtgttgaatgggtttacaaagtttttttgtaaggaacaatattgcaaattactaaaattgtatttttataggctgtttgctcttttgtggatattgtgcctgtcaggattcttgaagttttttttttatagtganataatggagttggtcttagccgctgcaggagcccttcttttctgnggattcatcatctatgacacncactcactgatgcataaactgtcac

SEQ ID NO: 3851 - DNA, 175 bp, Homo sapiens
ctggaaatgcagaaatcacccgtcttctgcttctctcatgctagtagctgtagactggagctgttcctatttggctatgttggaaccctcccagtcccagtaaaatttttcatttggaaaacagaagatgggaaaaaaacacagaagtcactgatccattgcaatagtggaattc

SEQ ID NO: 3852 - DNA, 353 bp, Homo sapiens
ctggcacgtgctcagactcggcatgagaacaaaaccggaacagtgctttcccacgtgcccctgcctcccaccctggccctgaacagtaagtccagaggcagagacgtggggcaagtggaaaaagaatctctgcaatagctagcctcagcacaggaagaaacacttccacccatccacaaaatctgggctgaagttctagatgcatatggcctacctttgggtatgaaccttctaataccttgtgatctgtctcagtggcgtctggcagaaaagctccacgaaaggggcaaagggacagaagagcaggcagtggcagtttccaggtaacagtgctgccacccaggtgaccatgg

SEQ ID NO: 3853 - DNA, 401 bp, Homo sapiens
  misc_feature (1)...(401): n = g, a, c or t
aaggaattggacagaancttcttcanaagatgggctacgtccctggacggggcctcgggaagaatgcacagggtatcattaacccaattgaagccaagcaganaaagggaaaangtgctgtgggggcttatggatccgagcgcaccactcagtccatgcaagacttccctgtggttgactcagaggaagaagctgaanaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagt

SEQ ID NO: 3854 - DNA, 341 bp, Homo sapiens
  misc_feature (1)...(341): n = g, a, c or t
cctgggccccggtcacgtcgccaaccatcttcctgtccctagacttcacggagtaggcgaatgctatgaagcccagacagcaccagttcaagaagagggtgttgaacagggaccagacgacatggtcgggcacggaggtctcgctgtggatgttgatcacggtggaccttggaaggatggtgctggggggtgcccccancacagccacctcatgttcctccttgtgcatcttctggctttggggaaggaagtgttgagtgaaggtttgagaagtgtggttttctgcgtggagcgaanggccgctgtggtgtccggatgctgggacggtgctcanttgagac

SEQ ID NO: 3855 - DNA, 218 bp, Homo sapiens
ccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtgg

SEQ ID NO: 3856 - DNA, 417 bp, Homo sapiens
ctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccct

SEQ ID NO: 3857 - DNA, 186 bp, Homo sapiens
  misc_feature (1)...(186): n = g, a, c or t
ctgaggcgctgtcctgggcagcctggttctgtgtgtgtggcctcaaggggccagagtgaggccggcttcctcctgggctcagtgcccctggatgggaggtgggcatgaacaggagaggcttccgagaatcagagtgtgctcagccaggaaaggcggaggccacctattcangaaacggggctgcag

SEQ ID NO: 3858 - DNA, 194 bp, Homo sapiens
ctgagggtgagtcctggagctccctgtgtcaactcaagcaagccacttagcaattctgggcctcagtttccccatctggaaaagggaggtcctcagggtgttgccatcaaaagatggttgtaatgtttcaatatagttccgcatattacacattcagcacagacccgggcatcggagcagtcccgaggcaccag

SEQ ID NO: 3859 - DNA, 306 bp, Homo sapiens
ctgcaggtcttgcacagacaaaaacaaaaaacaaaacccagaaaacaaaacaaaaaaccacaaaagaaagtttactacacaaaaccagtttctgataaagattctcctccccctcattactccacagtgaggatgataaggcgaggaatcccgccccaagagtcagaaaacattccaaacaccaaattctcatgcagaatggggctttagataggagctgggtattactgggagtgagatggtaaacctggttagcttgtctagggcgcaagaatcagtgacagttcaaacactggaatgttgcag

SEQ ID NO: 3860 - DNA, 168 bp, Homo sapiens
aaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacga

SEQ ID NO: 3861 - DNA, 333 bp, Homo sapiens
taattgagtattcagtaaacactgtgctcatctgctttttcctggcctccctccatttcctcctccctctccctctgcccttgcacatctgctttccttgtagcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatgg

SEQ ID NO: 3862 - DNA, 311 bp, Homo sapiens
  misc_feature (1)...(311): n = g, a, c or t
aaagcttctgggngtgcctttcaaattttgaacaagctgccttgtctaaacatcaatttctactactctgtagccttaaaatgngctctatttanatccacaggacccttctactggtgatatgaaaaacagaatacagaaattaagagaatcactttttactcaacaattaggggaagtaagtcaaagccctcctcttgcgacagcanatttcctgcgggccacctgttcancgccttgataggggatagggtgatcaaggcactcncnaaaacagttnattcaggtatggaatgtcagaattcctttgg

SEQ ID NO: 3863 - DNA, 194 bp, Homo sapiens
  misc_feature (1)...(194): n = g, a, c or t
ncagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctgg

SEQ ID NO: 3864 - DNA, 417 bp, Homo sapiens
  misc_feature (1)...(417): n = g, a, c or t
cncggcagccgncaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatgggcatagcttggagcccagagactagacttgattcattgcctccagtaatcaaattttgtacttgag

SEQ ID NO: 3865 - DNA, 269 bp, Homo sapiens
tggtattgctgtgccagaggggaggggatgaggggctctgcgaggaaggagaggagggtcccatcctcagatacagcagtgtgcggtgagaagaccccagtaccgcgtattgtagagattgaggtggggagagaggaagtcagggagaggcgcctgtggccccaggggcaactgaccacgaatccccttcccacccaagccttgtcctgacggtgtgcgtctcccagacccaggccaatgccagggccatccacaggctccggaagcag

SEQ ID NO: 3866 - DNA, 328 bp, Homo sapiens
  misc_feature (1)...(328): n = g, a, c or t
ccaagcccaggntanaaaggtgggcagactaatggtgggaatagcctgagaagggaaggccattcattcatttattgagcacctatcattcaactattcacccattcagcatttattgagtgcctactatgtgccaggcactgggcgaggctctggggacgcatgcatgaacaagattacaccctggcttctttcaagccctggatcgaggctcatcagtttttgaaactccgtctagaagcctgcaggagaggtgggaaggctggacgtgctgtccccacccagtcagcggattggggttaagagtgagtaagtgatcactgctcag

SEQ ID NO: 3867 - DNA, 485 bp, Homo sapiens
  misc_feature (1)...(485): n = g, a, c or t
ctgctttctcntccgcaaaaactacgctgcttctctttgtcctcttcttggacctccgcagcttgacctcaggcagggtgctccccggggagatcggttcctcctgctccactctcggcgtcttgggtgatgctaattccaggtcaaagctctctgaggtaggcttgctgggggtgctgcagtcagaattcatggaagccagagagatgatggacatctgtctgtatgagcgcagcatagacctgggacggcccactctcctgtcgtcaaagtcaggcatctctcggacaccgtactccttctccaccttcattttcaggttcttgaaacattcctccatccggtcatggaagggtcgcaagttatctgacacccttttctcatggatcttaatcccagctcccaagaaggggatctgccatgcaatcaggtccttgaggtgggtcagcttgtcctggtcctcagggtggcccctgacatactct

SEQ ID NO: 3868 - DNA, 312 bp, Homo sapiens
  misc_feature (1)...(312): n = g, a, c or t
ctgcagaggttngtccagtggctaaaagaggcagaagaggagtcatctgaagatgactgaagtcacactgcctgctcctttgggtgtgattgagtgccctcctggctcctgggctgggacaagtgaggaactagctgtagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgccaagggaggagctaagcaggcccggcag

SEQ ID NO: 3869 - DNA, 278 bp, Homo sapiens
  misc_feature (1)...(278): n = g, a, c or t
tgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttantgtgagggtgggtagaataagaactgacacacctgcccgggcgggcgctaagggcgaattccaacacactggnggnccgtactagtggatccagcncggtccnagcttggcgtaatcatgg

SEQ ID NO: 3870 - DNA, 269 bp, Homo sapiens
cttcgaaccatggaccaggcccccaagtccctgatggcctcagaggaggagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttgg

SEQ ID NO: 3871 - DNA, 453 bp, Homo sapiens
agattgaacacaggtgacctggtatagatacacactgtactgtgggccagaaccatggactacattttaagccatgttgtgggcccttcctgcctacagaaaaggacacttgagtggagtcacacttgggttgcctaatttattaccttaactagaaacattctaagtatgggagcctgttctggaggatagcttctaaaccaaatctaaaactatctttgcacacaagtgttgtgaagaggtaagcaggggatcagagctccatcttctgtgaccacttctccagggactgccacctatagggctcaggttggtaccaacagccctgcatagtagagtcactgtcaatcatcttcccacttgtaagcaggaagacaaaaagtctcatgaaatagaaacgaaaacactgaacatggccttcatcgtcctaatgccacaagtttcctgggatgg

SEQ ID NO: 3872 - DNA, 436 bp, Homo sapiens
  misc_feature (1)...(436): n = g, a, c or t
ctacctaccaagggtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgngcattgtgcttctttctttgggaatatttgaatcttgtctcaatgctcataacggatcagaaatacagattttgatagcaaagcgacgttagtcgtgagctcttgtgaggaaagcattggctttatcctctttanagttanactgttggggtgggtataaaagatggggtctgtaaaactttctttcttagaaatttat

SEQ ID NO: 3873 - DNA, 471 bp, Homo sapiens
  misc_feature (1)...(471): n = g, a, c or t
ccagttgctntaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttgg

SEQ ID NO: 3874 - DNA, 234 bp, Homo sapiens
caggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaagg

SEQ ID NO: 3875 - DNA, 247 bp, Homo sapiens
agtgggcctcctactccccagcacaggtgcaggaggaactctggaagcactgctctctgtcagtgatacagcttccaaggtgttcttgagtagcagacattgtccctcagaaggggtgaccccacgggcatgcgcaccctgttccagcgggggccttttttgtagatgggcttgacggagccaggagcccagcgcgtcaggtaccggttgagttggggtttgctcttcggaacaactccttcaggaa

SEQ ID NO: 3876 - DNA, 272 bp, Homo sapiens
aagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcag

SEQ ID NO: 3877 - DNA, 311 bp, Homo sapiens
  misc_feature (1)...(311): n = g, a, c or t
ccactaccgggntggacctcctccttcccccagcactccactcagggaaaatcaattccatcaaaaacaattgattttaccacctacaaatgggcaacatctacactccagtctcttcccactcacagactgtgcctcctataagcctggtatctcagaactctgagagtgggcttccccatggataccagggctcccaggccgggccactttacctaagtaggtgttgtccttctcatacagagctataatctcctgccaatccttcatccgctgtgaagagtatcggccaaaaatattcttcgtggagg

SEQ ID NO: 3878 - DNA, 175 bp, Homo sapiens
  misc_feature (1)...(175): n = g, a, c or t
ccctcccctgntcagaatctgataccaaagagacagggcccgggcccaggcagagagcgaccagcaggctcctcagccctctcttgccaaaaagcacaagatgttgaggtgagcagggcaggcccccggggaggggccagagttttctatgaatctatttttcttcagactgagg

SEQ ID NO: 3879 - DNA, 327 bp, Homo sapiens
gctactttattgcaacaactctagcaaattaatgcacaaatggcagaatggtatttttcaacttttatgagaaaagtaaaggcagttatagtagaagagagcatcatgagtcgactgtgctcagatagggctatttgcttttccccaactatgctccatacttttttcttttcatatgttttttttgagtcggggtcttgctctgctgcccaggttggagtgcagtgtcatgatcatagctcactgtaacctcgaccttctgagcttgagtgatcctcctgtctcagcctcccaagtagctgagactgcaggtgcatgccaacacag

SEQ ID NO: 3880 - DNA, 230 bp, Homo sapiens
acgtgtatgcaaatgagtgatggataaggatgagtcttggagttgcgggcagcctggagactcgtggacttaccgcctggaggcaggcccgggaaagctgctgtttactcatcgggcagccacgtgctctctggaggaagtgatagtttctgaaaccgctcagatgttttggggaaagttggagaagccgtggccttgcgagaggtggttacaccagaacctggacattg

SEQ ID NO: 3881 - DNA, 256 bp, Homo sapiens
caagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcagcttcgggggtgacatttgtatccggccagccgagcggggaaaggagaccttgtgtcctggcaacagggagagccgggactgggatgg

SEQ ID NO: 3882 - DNA, 315 bp, Homo sapiens
aaaaccacctccacctctaaccttgggtaaaactgggcttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtgg

SEQ ID NO: 3883 - DNA, 261 bp, Homo sapiens
ctggtaaaggtgactgtacagatgcgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgttt

SEQ ID NO: 3884 - DNA, 295 bp, Homo sapiens
  misc_feature (1)...(295): n = g, a, c or t
ggtgcctaccaacaagatggtgatgctgtcctgcgaggctaaaatctccctcantaacatgcgcatctactggctgagacagcgccangcaccgagcagngacagtcaccacgagttcctggccctctgggattccgcaaaagggactatccacggcgaagaggtggaacangacaanatagctgtgtttcgggatgcaanccggttcattntcaatctcacaagcgtnaacccngaagacagtggcatctacttctgcatnacctcaagganccccnagctgaccttcggggaa

SEQ ID NO: 3885 - DNA, 297 bp, Homo sapiens
  misc_feature (1)...(297): n = g, a, c or t
aactaaatacantgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcag

SEQ ID NO: 3886 - DNA, 147 bp, Homo sapiens
  misc_feature (1)...(147): n = g, a, c or t
ctaagtttgctgggggccttcatttctcangaccaaaggtggaaggaggtgtgaaaggaggtcagattggactccaggctcctgggctgagtgtgnctgggcctcaaggtcacttggaaagnggatctggaaaacccacattcccta

SEQ ID NO: 3887 - DNA, 184 bp, Homo sapiens
  misc_feature (1)...(184): n = g, a, c or t
tgagaacaccttggatgcctttctcttgcaatgtcctccatgtccatgtaaaatccagtccttccaggccctgcctggctctaaacctcatccccttcgagggccatctgctgtggacagtngagctgtgnaaccttcagatttcccacacattacagcaaatgcaaatacacatagaaatcag

SEQ ID NO: 3888 - DNA, 286 bp, Homo sapiens
  misc_feature (1)...(286): n = g, a, c or t
atgggccaccaccagtgngacancaggacatcctaatatatggatcttgatttttaagtttcagtatctgaacttcgtaaattagtaacttttagctgggaaagtatagcatgaaaccagaggttctcagaatgactgtaagatagcttacattncctctttttgcctttatctccccaactaaaatacaatggggaagaagtctgcctatgatctttgaatgagctttttaaggaagaaatattatatattgtttgttaaagtttattgaaataaagaatcattt

SEQ ID NO: 3889 - DNA, 234 bp, Homo sapiens
  misc_feature (1)...(234): n = g, a, c or t
aaagatgtggaanatggggtacaattaaaaccatgagagttgtgcanggaacagccgtagggcctgtttgcaccttcagatattgcctgctcccaaaaattcagacccccagatgcagggcaagacaataagaaagggtgagtgcaagcaaggagagcctcctgctaagaggctgaggtcccctctggttccaaggatgggatgtcagccttgaccttccggggtctgcagtgg

SEQ ID NO: 3890 - DNA, 218 bp, Homo sapiens
aaatgaaagccctttagtctgtactgaatcctttaatcatctccctccatctttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagttt

SEQ ID NO: 3891 - DNA, 438 bp, Homo sapiens
ccaactaaatcatggcctgtctgcttacccattcaatgtgctgggaaggggccaatgatttcttaaactgtttcctagagcaggggctctaaaaccctgggtagcagaggactgtggtccaaaccaagccaaaagaaacaggctggggtagggaagcatggtgactgcctggcagaaaaggcaaactctgggccccatagggaaaagtgcattctttgcacctcagagatattgcagaaccagtgttaacactatgagactttgttaggaggggaaaaaataaaaccctggaagaatctttcacctgaactcaacttgactggagttcagtccaccagtctcaggggaagggggaagcacctagctccacagcagcactgagtctggccctcccgccccatctccccagcccctctcagcaactaggccaggcttcag

SEQ ID NO: 3892 - DNA, 576 bp, Homo sapiens
  misc_feature (1)...(576): n = g, a, c or t
tcaaaaatacctattactttagattaacatacttttcctaagagcttagcatttgctaaattgtttcctctaaaattctgctcatctggaccagtgacagttgaatctcagtccttccactgtcagagagtactgagagagcacaccatatctgctctgctcaggaactgaaaagtttatccagtaataagattatggactgccagtctggcaatgcaatatgaatccatgttgagcttgacagatgttagtctctgcaccagtagtagctaagaaatctgattggttagcagccaatgagcaatttctcacatactgccacaataaactaaccacagaaatggaaaaattttttttcctacattaaaatgaaaatatctcataagcacattatctcaagtttttcctgagagggctactcaaagagatacatatatatatatatagcaagttcgatctgaattacataatcagcgagactcaaagtacaatcatcacagaagattgngaattataagcagcattatatcaaattaaaacttgtactagcaaagaatttccttatatatcaagctc

SEQ ID NO: 3893 - DNA, 187 bp, Homo sapiens
aaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagtcttt

SEQ ID NO: 3894 - DNA, 310 bp, Homo sapiens
cctcggccgagcccgccggccagcctgagaagccaggctggctgctggtgaatgtgaacgctccgggtaaggctcggtggctgctgcggtcccagacccttcaccggcccttgggacccagggctaggcgtaacctgttggtgctgtcccccaaaacgcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctgg

SEQ ID NO: 3895 - DNA, 331 bp, Homo sapiens
ccacggtggggcagggtaccaccaagatccttcagtctgagctcagcgagtgtcccatctccacacttactgtgcacccggatcacggcctccagagagcggatggcattgaggttgggtttctgtttccagccttcttctgaaaggggatccacctatagaaaacagtacatcagccaccagtctctcagggacccacaggcccagctcactcccaccccaggggccccagccttctagccacaagcacactctacctaggccaggagatgctgcctggacctaacttggaacagaggctttcgcttcgcctaccttgtttcaggcttgg

SEQ ID NO: 3896 - DNA, 387 bp, Homo sapiens
ctgtggttctccaccacagagagaagaaaagggagggagatggagtgcgcaggtctgagaaggctttcattctggagcatctgcaggagcctgcaccatggcccagtagcacccctttttctccgtgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgtaactggctgtttgcatccagggcactggtggcatcatccaggataagtacacacggtttccggatcaatgctcgggccaacgccactgcctgtcgctgaccccctgacag

SEQ ID NO: 3897 - DNA, 452 bp, Homo sapiens
aaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagcttttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaagg

SEQ ID NO: 3898 - DNA, 318 bp, Homo sapiens
  misc_feature (1)...(318): n = g, a, c or t
ctgccctctgtaaatnagaggtggggaaagcacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcag

SEQ ID NO: 3899 - DNA, 128 bp, Homo sapiens
  misc_feature (1)...(128): n = g, a, c or t
ctggttactttgtnaccattagaatggtaaaaatttaattaatgtaattaaattattgggagaaagcttaaaactttcgacaatactgctttgttaataacttgttacaaattaaattttatgttttt

SEQ ID NO: 3900 - DNA, 289 bp, Homo sapiens
  misc_feature (1)...(289): n = g, a, c or t
ccatgtccccagaattgaagccagagaatcgctcanatatccctgagggccggncgttatcaaaagagatgattaggacaggggcctggcctggcttctggtaataccagtgtacattgttactcccaatattgtttcccccacaggtaatcttggccgtctttcctggggccactgacactgagggngnntgagtcaacacataggaggtcacagagtctgtgcagtgagagaggaggccgaggaggagaacggtccaggccatggctgaggcaccaccagtgctgct

SEQ ID NO: 3901 - DNA, 452 bp, Homo sapiens
ctgggctgtgcctcggtctctatgcgcctcggtctctgtgcgcctcggtcccgcctcaagcaccgggtggcgtctccgctgtagtgttctgagttcaagttgcctcggaagtcccagttggggatacgctctcgcgcaccaggtacgcctggtgtttctttgtggtttttcggattctttttggggagtgcggggagtcacagttagaaggcggccgggtgttgctggaggaaagtgctgaggtccagagcgtagtccgagggctccgaagtcagattaaagggctcgaggacggcggacacaggggtgggcgccagggatgcggcgttaggggcgtcctctggaggcaggggcgccggcacaccctcttcagccatcaggatctggcagaagacgatggtgagcagcagaaagagaagccttttggctgggttcggttcctcgactggcag

SEQ ID NO: 3902 - DNA, 203 bp, Homo sapiens
ctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgttttttttaattattatttt

SEQ ID NO: 3903 - DNA, 633 bp, Homo sapiens
  misc_feature (1)...(633): n = g, a, c or t
aaaatgttttaatgtatatgtgttatgggtcataggtactcattagtatgcttcataatttattcacgttagatatactctttatagatatcaaatattacatattataatttcttaaaatctgctgtggtggaaataaatgaacacatgaagtctccctgaaagaaaatcagtgtttcttgggaagaaccaagattccctgacagaagctaccctatgtagaggacaaagtaggtcttcaataaatattagttggtttactgcttctcccaaggatacatctggagggtctgcattcctttctcattggtgccgcctgaccacagaactagctttttccgtgacatctaacctaaaccccgcagtcctaagtcctgacacgtatgacaagatgctgccacctggtggatacagaatagatttaatgaaatggctaggaagtctttcactctagttggtggaactggcaatagggtgagagggaagcaggaatgagaagacaaaaattaagaaacaggaaaaggaaggagctccatctctaatatggaggtaggaaaaaaangggactatcatctaaatgagactgaagagtccctagaggagaatggcttccctctccttncttctgagact

SEQ ID NO: 3904 - DNA, 294 bp, Homo sapiens
cctatgaggagtatgttttatctgttgggaatttagatgagcgggtatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacag

SEQ ID NO: 3905 - DNA, 225 bp, Homo sapiens
ctgccctccggtgggccggatctctagattcacattagacacagggactctctgtacacgtatctgagatctcaggctcctttttttgatgctgtgagtcactgtctccacctcacaccagtaagaccctgagtcttcagtccacatggcagggatctggagtctgggggacctgctccagcccaatccgagggtctggctatctctgaagagggagaattgcag

SEQ ID NO: 3906 - DNA, 268 bp, Homo sapiens
aaagatatatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgcgctctaatctctctggttttccaagg

SEQ ID NO: 3907 - DNA, 219 bp, Homo sapiens
aaagcctaaaaatgccataggaggtcaccagtccttatgttgtactctgaattcctaggatttcaccttggaggtcacagcagtgctatgtagaaagaagaatgtactagggggagattattcttagaaaaggacagtactttggttggagtagaatcagtccacaccattcataacacaaacaccaggctctgtgggctgtgaggtggggagcagagg

SEQ ID NO: 3908 - DNA, 268 bp, Homo sapiens
ctgcctatcaaaacagtacaacttttctaggaaatgcaattggcaaagacacttacgatgctgagaagtacacaaggtgaaactgctccagtttttctcatagcagggtcagcaggaaagcaagtggtgcccctggtcccatctcacacaggtgagactgcaccgagaggtaacgtggccctcacagcccaccacgcctggccttcgcccaattctgaaacttcgtaggatagagctggaaagtgccacatggtgaagcgagatccag

SEQ ID NO: 3909 - DNA, 373 bp, Homo sapiens; identical to SEQ ID NO: 142

SEQ ID NO: 3910 - DNA, 285 bp, Homo sapiens
aaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaacttttt

SEQ ID NO: 3911 - DNA, 192 bp, Homo sapiens
ctgtggccccacgaggcaggacttcaataactcgcggcttgtcaatgatccgggccgttcggtttcccttttccacaatgccaacgatccacgcttggtgaccctctccgtacttggaggatttgatttcagaacaaaagcgagccgcctgttctcttggcagacaaatcagtaatcccccagaggtttcag

SEQ ID NO: 3912 - DNA, 308 bp, Homo sapiens
attctctcctgacggaagagtttttcaagttgagtatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtgg

SEQ ID NO: 3913 - DNA, 535 bp, Homo sapiens
aaagagaaacttaaatcctgttgtattctttcaacacaagcagtgatacctctcagagtctgctcaaaagctcagctctgtggactccgtgacaaaatgtacgcgtccactgccgaccctcttggtttctgaaaccaacctttcttcctgctctcctctttaagagcaaaccccaacatgtataaggtcacagcaagtggtagccaggaaaagctgtgggacccctcatttgagtcacatccatatggcatggagaaagaaaacctctctgccagaaggaactgaactctggaagtcctaaggaaggtcaccatgctcagcagataggaaagcattgccaagggctgtccctcaagagcttagttttcttagggagaccagaaagacatcagatcctgactgccctgttttgctcaagttctgaaatgagtggcatgatgaagagctggtggagctgagggaaagagtcaaccatgtggggtggggtagtgaggaaggtgtatgaggaaacaaactgggccctgacgaaacaggc

SEQ ID NO: 3914 - DNA, 575 bp, Homo sapiens
gagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgct

SEQ ID NO: 3915 - DNA, 221 bp, Homo sapiens
aaaacattagatggtgctgaaaagccttctccctccctggatgaagcagtcaaacagacagctactctgcgcatacactccacgcattagcatgcgcgtggggctcagagcaacaggtgggagtttcagaagcattctggtttctccccactcctcacccctgcagcgcggttgcgtaaggtggcttgtaacaagacaactgcatttataaatttaatttt

SEQ ID NO: 3916 - DNA, 230 bp, Homo sapiens
aaatactgagctgggaggcagggaaggaagtagtggggctggcttaagggtatagccgcctcaggggagtcacccagcagcagtcacctggtaggtccagagagtgagatgggatcaggaactggcatagacctcagtcattggtcctcaagctgaggggtggaactgtagctgggcagggcccgggcctcccgaggtgcccatgtcccactgacccaaggacaagatgg

SEQ ID NO: 3917 - DNA, 373 bp, Homo sapiens
aaacacaacagaaatccattaatgtacgctgcagatttttttaagtagccttgaaaatcagcttcagtagttggagcagtgctgagctagaagtacttgtcatgttctctgttctctcaatgaattctgtcaaaacgctcagtgcagaaaattcagcgtttcagagatcttcagctaatcttaaaacaacaatcataagaaggcccagtcgatgacactcagggttctacagctctcccacatctgtgaactcgggtttggggatgttggttaagtttgtggctggtcctctggtttgttgggagttgagcagccgcagagtcacacacatgcaaacacgcactcttcggaaggcagccactgtctacatcag

SEQ ID NO: 3918 - DNA, 624 bp, Homo sapiens
  misc_feature (1)...(624): n = g, a, c or t
ctgtggtcaagtacacggatatgcatgtacaaggatatttattggtgttgcatataatgataaattattgagagttttctaaatgtacattttcctccttctggtagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtaaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgnactggttgcagctttgatgagcttcctcacaggccaattattccagaagtctgnggatgccgctcccacacagcaagaggactcatggacgtctntagaacata

SEQ ID NO: 3919 - DNA, 537 bp, Homo sapiens
cctcaggagggtgttggcaaggctggggcggggcctccaggctcttcccacaaaaggtgtggcgaggccagcaagtgtgggagagaggtgggaaggaggcagaaaggccatgcagagccagcgcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctg

SEQ ID NO: 3920 - DNA, 412 bp, Homo sapiens
ccttacctgggaggccagacccatcctctccttaagccacaccctaactcatctctacatgctgggtggtgacaagcaaggacaccccaatctgcttggctccttggctggcagcagcacccacacatccctgcccaccacctgctcaggctccagatcccaaggaggaggtggaaggtgcctgccctccattatcaggcatgcaacatttattagaagccgcacagtctctcttgaccagtgttccgcatctgagccacaggatgcagaaaatgacttgagtgattctcgtcaattcttccaaggatggtatgtaactagtctcattctagaaagaagttaactcattatacacagtggatggcttaagggattagggcttcattctctcccagaccctggtagtaaaagg

SEQ ID NO: 3921 - DNA, 247 bp, Homo sapiens
  misc_feature (1)...(247): n = g, a, c or t
ctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttanatgccgagtgggcgaatgccagaccaatgatacccanagctacctgccgccaacttgttgaggtgtgtgtttgactgtgag

SEQ ID NO: 3922 - DNA, 229 bp, Homo sapiens
  misc_feature (1)...(229): n = g, a, c or t
ggaaaanggatggcaaattccctgtctttctggatccaaatcttacgattgctaggggcctggcagttctaaaaactgacttcgtggtcaagtagctttggagtcactgactgtctccagacgtccatttttgcacatgagaaatgaggatataatactacagaagaggcatcttacccaaccaatgcaccttacttctctgtgaaacacaggggatgctgggcgcagg

SEQ ID NO: 3923 - DNA, 543 bp, Homo sapiens
cctggcagcactggagggcaggcagggaaagtagggtgggtaacccagcctggcaaatgcacggcagctagaaaacctcttcaggttctggggtggctgggccatgagaggggaggccaggcagggctgtcaaggtaaccggggtcagatcatggagttgcctgccaggctccacaggagtgggggacagaagcagagcaacccagctaccagccgggccctgagctccctcagggtgaccagggaggagctgtgactggctggggaggcagggctggggccgaggttccccaggacgacaggagggagccaaggcactctaagaggtggaagaagaggaccagaagctggtgagtgcatcactggagcccataggagggctcctgactgtcctcaaaagcctcagacctcagtgtccactttctccatccaagaaatggggctgtgatctctgcttatgacagcacaagcttgcacagaagtggaggcgggaaataagcacaagtgtgccttcccagcccggcctgggtccaggcagaacag

SEQ ID NO: 3924 - DNA, 181 bp, Homo sapiens
  misc_feature (1)...(181): n = g, a, c or t
aaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcancaaatggcattagcag

SEQ ID NO: 3925 - DNA, 482 bp, Homo sapiens
ccacaagatatgttctagagacgtccatgagtcctcttgctgtgtgggagcggcatccacagacttctggaataattggcctgtgaggaagctcatcaaagctgcaaacagtacaatgaatgcaatagagagccagagggccttattagcctttctgatggaggacttgagatttgttgcccaggaagctattgtgtcataaactgaagagacatcccactttgatggattatttttcttttcagaaagacttggcttccttgtcctttctactgtttcttctccagatggctctgagtcatctttagttctgtaaataaatgttgtttttaatatttgaaactagggataatatgctataattattcataaaatattgctgaatcttactgtaactcaagaggctcacaaatatttgttctgttttagggaaagttgataaatatctaactctaaaaatcaaatcaccagatttataattt

SEQ ID NO: 3926 - DNA, 168 bp, Homo sapiens
tttgaaattttctggcaggatcagtgtgtcaatctcctccaagatcttcataaactgctctattgtggcttttactctcctatcaagtttgcagagagcttcagcttgcaaatccttgggcagaaaaccctgctggattccagtaagctctttattcaactcttccag

SEQ ID NO: 3927 - DNA, 196 bp, Homo sapiens
aaaaattatgagttaatgctgcctgtgtctatggggttctgtcttctttgatagccatctattcatctggatcatgggaccctctctaatccctccaccaatcaaataagctattgctattggtttggagttgagatatcagtctcggaaacttctgaaaaatgctaataattacccaaggattatgtcaaatttt

SEQ ID NO: 3928 - DNA, 528 bp, Homo sapiens
ccagcacgctacaggggcttcctatgcgcttgggatacacaggggctggaggcttcccaggagtttgtcttgaacatctggaggtttgaatttgtcccactgaccttttctttcagcaagttcccctgaaatttgggctgctgcttgggtgaatatcccaggatgggggttccattctaggagtggactggcaggctgagcctcccatggagctgatccagccaggatacagagaaggggaggcaaaggctgagacagaaccagcttgagagcggaggcgcaactcttgtctcctggtggccttgagcatttcacaatagggggataaaggataggagcagaaaagtggggctgacttcagaaatggggtcctctagagctcacgggagggtgttagattggagtgggagcttagtggaggtgagccttagaggcaaaagtctccagaccaatccagggcccctcttctatccgggggcccctcttctatccagggcccctcttctgtctgggagcccctcttctatc

SEQ ID NO: 3929 - DNA, 520 bp, Homo sapiens
  misc_feature (1)...(520): n = g, a, c or t
ctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgngatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcg

SEQ ID NO: 3930 - DNA, 519 bp, Homo sapiens
  misc_feature (1)...(519): n = g, a, c or t
ccaacacccacttctctggntgtataanacagggacctaaaaagggaaaggatgggaggaggatcatcctgcagnngatcatgtagggcttnatgctntaaatggttntgcatttccggagatgaaacangtctcttnaccacanaactactgcagatcatagccctatggtctggctggttttgtcaatctggcagttcagggncagtgcaaaggacatncccaacacctcaatcacacatacacagatggngatgattccgatatacaggaaattggaatgaaaccacantcttgctttcgnatancaaccctccacttttcgatctgaggggcaagatgctggtgggccactggnccaatcactcntgccatttataccacaacactgcagaaatgactggntggagtcccacgctgccttggtgctattgnctgagtggtaacggtggatgctgncggncanacccttanccacatactcattcancttntgntcatatacaaagagcaggatgg

SEQ ID NO: 3931 - DNA, 411 bp, Homo sapiens
ccaagtcgggaaggagccgtatatatgcatatgggattcctataatgtccagactgtgtctcttcttaaagatgtccatacacatggagttgcctgcctggcttttgactcagatggacagcgtttagcctctgtggggttggatgccaaaaacacagtctgcatttgggactggaggaagggaaaacttctggcgtcagccaccggccattctgacaggatttttgatatttcctgggatccatatcagccaaacagagtggttagctgtggagtaaaacacataaagttttggacactgtgtggaaatgccctgactgcaaaaagagggatatttggcaaaacaggggatcttcagaccatcctttgccttgcatgtgccaaagaagacatcacctactctggtgcttt

SEQ ID NO: 3932 - DNA, 532 bp, Homo sapiens
  misc_feature (1)...(532): n = g, a, c or t
ctgggcgtangtcacatcctggggggcttcagatgcagcagcctcagtgtccatctgcctgtcctcttccgcctgtctgtcctttgtgtccaggaattccccagacagtggggaaggaggagaggccatttctctcctangtctggagtgtttcacctcggcatacgtcactgcctgggggtcttcatcgtgtgggctctgctggagagagacagtggtgggggtgtccctgaatcctcctgaccccctggagtcaattttcctnactgttccccgggtgatccgattacatccctttcccgatggactctcanggacgccctaaggccgnggagggtctggccgctccctcgctgtggttctggcctctgctcctcactctgacgttgcccatttggctgcagcctcacgggccttcctgcaagagctcgctgctgcctgggggcctttgcanggttgtttcctctgcctgcaggggctcgtccatcagaggatcgtgtgccccactctgtccaggcttctcanatgacag

SEQ ID NO: 3933 - DNA, 390 bp, Homo sapiens
ctgaagtacaaaatttgattactggaggcaatgaatcaagtctagtctctgggctccaagctatgccatcaaccctgactccatggtgaaatgttcgaagtgttttatactgaatgccttcaacgtctgcttcttcttcctgaaacgtacacgtgccaatgaccacataattattgccaccatatgcaattaggtttcctgaatccccattctcaaagggattaaattctaccacatgcacataatcttcacaatccacagtgtaggcagcatttcttgaggcatcttgcttcatcttgtatgtcaaaattcaagcagttgtgaaaattaaatagccttctactggacaaggtcacgaaacgcagagcgccaggaaccgaccagaggcag

SEQ ID NO: 3934 - DNA, 550 bp, Homo sapiens
cctggcagcctggctggacagtcaatgtggagggcagtggtgagggccgggctggggcaggggcaggaggagagaagggaggccaccatggacagaagaggtccgcggccacaatggagctggagagaggggctggagggattgagggcgaaactcggagctaggtgggcagactcctggggcttcgtggcttcagtatgagctgcttcctgtccctctacctctcactgtcttctctctctctgcgggtctttgtctctatttatctctgtctttgagtctctatctctctccctctcctgggtgtctctgcatttggttctgggtctcttcccaggggagctgttccggtggaatgtttcggacctaggtggcctgggctgtggcctgaagaacaggtcctcagagggccccagctccccttccgggaagctcgtgagccccaagctgtatgtgtgggccaaagaccgccctgagatctgggagggagagcctccgtatgtcccaccgagggacagcctgaaccagagcctcagccaggacctcacca

SEQ ID NO: 3935 - DNA, 387 bp, Homo sapiens
atttttagtagagacggtgtttcaccatattggtcaggctagtctcgaactcctgacctctggtgactcacctgcctcagcctcccaaagtgctgggattacagacatgagccaccatgcccagcttacctcttcatggtttcattaatcagcaaagaacacctaatcctgacatccagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactagg

SEQ ID NO: 3936 - DNA, 270 bp, Homo sapiens
cctgcctagcttctgcatagcccggggctgggcggtccccgggagtgctgccacctcccctacactttcatcctgaggcaggatttgctagacgtcggcttgcctctcttccccagcaggagggcaggagtcactaagtgctgcagaaaagatccgcgctggagattgcccgtcccccccatgcctttccccagaaacagttgagagaatgggtagctggtgggaccagaccggtttcccagaggacaggaaggccaataaaaatatcag

SEQ ID NO: 3937 - DNA, 601 bp, Homo sapiens
  misc_feature (1)...(601): n = g, a, c or t
aaaaaggtctctctctttttcacaagctagaaagtatccttcgtatgatgaagattcaaattgcatcttattatcatgtcctgggacacttctctgaaagaatatgatgtcactttttgtatccttgatgttatcaggaggattcatttccttaaaggaaataattttgttctcacaggagagagttgaaattttctcacacttcacagagatagttacagccatacctctaggctggctatctttatacatacttataataaatatggtccggggtgcattatctctacagtcagaatcagtcatatcttcaaatagaggccgatttccttggtcaatgaagagaacttggtcattcaaatttcttatgactgataatttagattcaagcttgccaaagtaatcggattccaggttttcatcatcttcagctataaagtaaagcgtattgtcaataaatttcattgccacaaagttgatgcaattgtcttctactggttcagcagccatctttattcctgcgacaaatagtttgttgcgagaggaagcgatctggaaggnctgaggttcctttcctcttcccgaagctgtgtagactgca

SEQ ID NO: 3938 - DNA, 323 bp, Homo sapiens
gtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatgg

SEQ ID NO: 3939 - DNA, 222 bp, Homo sapiens
  misc_feature (1)...(222): n = g, a, c or t
atgaatnaagagtttcctatggngaagttaacnttctaccattgcacataaattncgacgctctggccctnangtgcccctgaagcgaanttctggaagacggctgtgtgtgtacccccagcccatttctctaaagcacgtctgcacaattccaagtntgcttttctttttatgatgaggaangaaacaataacagtnatcattcagtagatatttgaattg

SEQ ID NO: 3940 - DNA, 430 bp, Homo sapiens
ccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcagcggaaccccccaatggggggcaacgtggtcatcttcgacacggtcatcaccaaccaggaagaaccgtaccagaaccactccggccgattcgtctgcattgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcag

SEQ ID NO: 3941 - DNA, 172 bp, Homo sapiens
ccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataagg

SEQ ID NO: 3942 - DNA, 516 bp, Homo sapiens
  misc_feature (1)...(516): n = g, a, c or t
aaatgacnaaactggaattatttcaacccggaaatnattgtttcaaatttccatggttaaaggtttgctcaagcaaatcttaaaacacaggtatgtatttcagaagatcaaccaaattcgagtttgcatcccattttgggtacattgtaaatagaaatttcaaaatcttcctcaaaaatatctgcatttgttttccagattcttgcaacccaaaacaaaacttcacagaaactctgcacaagagttggcagacagctaaaccttctccaaattgagttatggacaataaggtcttgattatagcagaattggaaggtctatttacaaacctgcacacagtgctgtgtaaattgggtgctggggcacattgattggcagggaaaggccagggaggcagttgaatccctggcatttttcaaagcttttttcctaggntcattattcctagaattttgaagcttattaagacattccctatcctatgtcatactctagagcactctagtnagaatcctg

SEQ ID NO: 3943 - DNA, 118 bp, Homo sapiens
  misc_feature (1)...(118): n = g, a, c or t
ctngatgcctcatgaatcaacggnggagcacacacacgtnnatatcaatgagatggagtctcctcttgccacccggaaccgcacatcagtggatttcaaagacactgactacaagcgg

SEQ ID NO: 3944 - DNA, 219 bp, Homo sapiens
  misc_feature (1)...(219): n = g, a, c or t
tttgtgccnnaactggacctgcnggttggtaccaanggctgntgccanccagccggagtacaggtcatctccaaatttgctgaacttggcaaagctctggaaaacagccccggcctgggatgngagtgtgatgctgctgttccagggttcttggctaacgtggtggcccttgaccacattctccaagtcggggaattcctgggcaaagatcccttccag

SEQ ID NO: 3945 - DNA, 504 bp, Homo sapiens
ctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcag

SEQ ID NO: 3946 - DNA, 393 bp, Homo sapiens
ccttctacaccacggaccgggtcatgactgtgtcctttcataagtatggagagtacttcccaggaactggggacctacgggatatcggggctggcaaaggcaagtattatgctgttgactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacag

SEQ ID NO: 3947 - DNA, 452 bp, Homo sapiens
  misc_feature (1)...(452): n = g, a, c or t
ctgggctgtgcctcggtctctatgcgcctcggtctctgtgcgcctcggtcccgcctcaagcaccgggtggcgtctccgctgtagtgttctgagttcaagttgcctcggaagtcccagttggggatacgctctcgcgcaccaggtacgcctggtgtttctttgtggtttttcggattctttttggggagtgcggggagtcacagttagaaggcggccgggtgttgctggaggaaagtgctgaggtccagagcgtantccgagggctccgaagtcagattaaagggctcgaggacggcggacacaggggtgggcgccagggatgcggcgttaggggcgtcctctggaggcaggggcgccggcacaccctcttcagccatcaggatctggcagaagacgatggtgagcagcagaaagagaagccttttggctgggttcggttcctcgactggcag

SEQ ID NO: 3948 - DNA, 506 bp, Homo sapiens
  misc_feature (1)...(506): n = g, a, c or t
ctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgtcagctccccgagcaaagttcagagcagtgagaactacagaaggcgaggaggagacaganagcagggtccccggca

SEQ ID NO: 3949 - DNA, 177 bp, Homo sapiens
ccacatataacattattttgagaaaggaaagaaagtgcatgccccaaaagggatgccttccttcaccttgcaggtagctggaactttgatagtggcagaaaccacaatggagtagggttcacagaaatggcctgtgaaacagaccctattcctagagagacagaggaaaaacctcag

SEQ ID NO: 3950 - DNA, 361 bp, Homo sapiens
  misc_feature (1)...(361): n = g, a, c or t
cgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctctgtgtgtgtgtgtgtgtgtgtgtgtgtgtgtgtgtgtgtgtgtgtgtccctatgtntatgtatcnggtgaggggtgggag

SEQ ID NO: 3951 - DNA, 446 bp, Homo sapiens
  misc_feature (1)...(446): n = g, a, c or t
aaacaaacaaacanacaaacaaannaaggntgggggagggagggaaagagannagctctncactnncctttgttgnantctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttatgatagaagtccaaccgtttttt

SEQ ID NO: 3952 - DNA, 393 bp, Homo sapiens
ctggcagatggaagcctggttctctttggcagcaacatgcatcacgttgtacctgcacccttcctgcacgatagtggggttgtctcctgagcctatcagataccgggggttgctccagataaggtcagaaaaggtgtcctcctctcccttctccacagctttccgaagcttggcggtgaggtcctgcgtgcggggatttttgtaactgttcgctcgctctttgttgactgtttctgattccgacaagcacaaaccatctttcaacctgtcattgctaaagagtggagctgttttcacaggagacagtggtaaggacgttttgcttggagaagggaaataatcacaaattcctctagcaaatttctcagcgtcttctctggtagaaaaagcttt

SEQ ID NO: 3953 - DNA, 621 bp, Homo sapiens
ctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcact

SEQ ID NO: 3954 - DNA, 295 bp, Homo sapiens
cctctgagcagaacgaggtaaatcttcactgttagctacaaagagcactgcatgaaagtgtgtgcaagatgactccatgaggttttctttttaagtttatgtatatttacagaaaagtgaaatgtgttggaagaataaacaccccttcttgtggacacttttagagaggagaatttgggctgggaaaaaaggagatcctttttatttttttgctgttctctactgtttgtcttttctgtagttaatattaatattaattgtattaatattctgactttaatattagaaacttttt

SEQ ID NO: 3955 - DNA, 295 bp, Homo sapiens
  misc_feature (1)...(295): n = g, a, c or t
cctctgagcagaacgaggtaaatcttcactgttagctacaaagagcactgcatgaaagtgtgtgcaagatgactccatgaggttttctttttaagtttatgtatatttacagaaaagtgaaatgtgttggaagaataaacaccccttcttgtggacacttttanagaggagaatttgggctgggaaaaaaggagatcctttntatttttttgctgttctctactgtttgtcttttctgtagttaatattaatattaattgtattaatattctgactttaatattagaaacttttt

SEQ ID NO: 3956 - DNA, 319 bp, Homo sapiens
ctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgatttttt

SEQ ID NO: 3957 - DNA, 515 bp, Homo sapiens
ccatccctgagcttgaatagcagtgggttcagtgaaattctgtcttgcaataacatccatgacatttgcagggaaattggcttcataaaaatttagaactggcttcgggcagttgtgacctctaactgtaatttccttgcttcttctgtatgtttccacctcttgtgctgtgcgcctagccaaatcagggtgctcttgataaaaattcttctcaaatttaggcagctcatcaagattccacttctttttaactaatttctccccagggtttccaaacttctttccagataagggccctgccctacttcctccaaatcgaggtgcaccaaaccctcggtcccggccgcggtctcggtcactcgaataacccgacatggcgtcaatggttgcggttggcggggaacgaagtatatagaaaagcgtgcgacaagtcgctggaaatggcctcgatgacggcgaagccttgcgggggcggcagcggaggaaggacaccgatgacaccagccgaagctgca

SEQ ID NO: 3958 - DNA, 499 bp, Homo sapiens
ctgctcccggttcacgagggaggagtggtggtagcgatcccgagtggcgaagtctgcattctcctgggtgagctgagtcgtctccatgtcaaccttagccagggacggcgccaagatgatctgctcctgaggggaccgcaagctcctgcaggaggggagcaagagagacctcatccaccggaaaaagctgaagttggaggctgatccaaggtgaagccctggactggcccggccaatgtagaaatacacgatggcagcaacacccatgttaaccagggtatacacccactgtatcacaaacatgatgagaagggacccaacagcccccaacagggggacccaggggttgcacatgtgggtatagaaagaagtggatcttctccagacatcttgttcttggagcctggacttcaggaagaaatctaaaaaatagccaaagatttggctgccaaattgctatcaactctctactgttttttaggaaaatatacctatgagc

SEQ ID NO: 3959 - DNA, 349 bp, Homo sapiens
  misc_feature (1)...(349): n = g, a, c or t
aaaagactattttactaaatttggagaggtcnttgactgtncaataaaaatggatcccancactggacggncaanagggtttgggtttatcctgttcaaagatgcagccagtgtggagaaggtcctagaccagaaggagcacaggctggatggncgtgtnattgaccctaaaaaggncatggctatgaanaangacccggtgaagaaaatcttcgttgggggtntgaatcctgaagccactgaggaaaagatcagggagtactttggcgagtttggggagatngaggccattgaattgccaatggatccaaagtngaacaaaagacgangntttgtgttnatcaccttt

SEQ ID NO: 3960 - DNA, 582 bp, Homo sapiens
  misc_feature (1)...(582): n = g, a, c or t
aaactaccatggggagaaatgaccacacctatcaaaaaagcagtgtcaaactaatttacatttttatacagatcagatgtttatttagtattgttttcatatatgcattgagtatgtaaggacagagttagatgagcctctgaagacatctcatatactctgggctcccaccgtttcaggttcttttagtgtctcagaatttccagctaattcttcggtctgcatttcacatatttcaccagataaatggtttttctgttcttcttctaccattttctttcttagatctgcctctgaatatattgtcagtttcagtggtaaatcttcaacttttacaaaatcttcttcatcagacttttgacttatattaccagattctgcttcatagtcattcactaacactggagattcagtatcaggacttccagccagagagctttcaggagtttcctgagcagatttaacttctttgactctaggcactaagggttccatttcaggtaaacgtnacggcnaanggttangctgntgagttgaatcaacagtaggaggngactccttatgggcagcactatttacctg

SEQ ID NO: 3961 - DNA, 289 bp, Homo sapiens; identical to SEQ ID NO: 3644

SEQ ID NO: 3962 - DNA, 528 bp, Homo sapiens
aaaaatatatgattttgctccttttcttcccatgtgcatcaggcccactctacaaaggttgaatcctggcttgtctgagcccgtgtgatcccacggtcattccaatgtataagaaagtgggtactgggaacactctggaaacagtttagttgatccttctaaaggcacacaggagaaaggagtatccttttcctgcctttgggagttgttgtgaatgattaacaaacctaaagctgctgcatgggtcaccctaccatctcaggaaagctgacgtgctgtgtgtgatagagagatgagctacgaaattccaggatcactggtgatgacactggcctgctgagttgagcatccctggagatgcccagccttggatctatcggctatgtgagataatgggttaaagaaaaataaagccactagatgtaatttcctgttattagcagcagaacacatcttcactgaaatactcattccacacattttggttctaccttgtaattccacaccacgagtctcatataaaatgag

SEQ ID NO: 3963 - DNA, 295 bp, Homo sapiens
  misc_feature (1)...(295): n = g, a, c or t
cctctgancagaacgaggtaaatcttcactgttagctacaaagagcactgcatgaaagtgtgtgcaagatgactccatgaggttttctttttaagtttatgtatatttacagaaaagtgaaatgtgttggaagaataaacaccccttcttgtggacacttttagagaggagaatttgggctgggaaaaaaggagatcctttttatttttttgctgttctctactgtttgtcttttctgtagttaatattaatattaattgtattaatattctgactttaatattagaaacttttt

SEQ ID NO: 3964 - DNA, 341 bp, Homo sapiens
ccaccctcccacacgggatattctaagccgctgacaccatctaacttttctgaaagaaattaacaactcagccgatctttaccaggctaaaatcacagaactgggtcccctgaaagccaggctttcatgccacatccacagctactgctgtctagccaagtctataacatcttcttgcccttattaatacatatgttacataggtttacgtatgttaatccctaatgacttgacttaaccttgtcacagccaggcgcggtggttcatgccctacaatcccagcactttgggaggccaaaatgggtagatcacctgaggtcaggagttcaagaccagcctgg

SEQ ID NO: 3965 - DNA, 598 bp, Homo sapiens
  misc_feature (1)...(598): n = g, a, c or t
cacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcagggtgaggccgggattcgggggctgctgtccaatggaaatggcaggaaggtcgagcctacggccagaaggggggcttagcggaggcagagtcttggttccagacatccgcggagcaatctgagctgtccccaagtctccttctattaaatcctaccccgccctgccaagagcgctcttccttttaccaccttacccggatgatcttggaatctagttccttaaaacttctcactcccccagtaccattagtgtcttacaggatacgtgagttggtcagcaaatacatgtgctttccattgttacgggcgcggtggtgcaggggcaaatcgggactgggatttggtccttacccttaacgtggctctaagaccagaagggaacacctgacttctgttgacctcttcagttagctgcaggttaaagnctgagtgcttaccaagac

SEQ ID NO: 3966 - DNA, 344 bp, Homo sapiens
aaacatcatcttttcatagttttgatctgtttttataattcctgcattcaattcactggcaaaaactctatcattgaaagtgctggcaggaccacttcttaggctgtcccagttggcaaccatttctttcacccactctacccaggtgtacagacggagaatacctgcatctgccatggcttccacaaagttggcatcttctacagtgtcaccagcatcagccagagccaaacgcactccatctgctgaaaatttgtcaatagcttgggtcaaagtgaggaagttgcctgtggattttgacatcttctcagagttcaggaggagatgtccatttgctctcacag

SEQ ID NO: 3967 - DNA, 387 bp, Homo sapiens
  misc_feature (1)...(387): n = g, a, c or t
tatgtgcatantttcataaagcagacatttccatgaggaaaagaggatggtggtgaaaggggaggggtgaagggacatctccaagtcacagaggctgcaaaactcagcatgacttgtggacggagccacaggccacccagggcaacaacacccacataactcaccaagtggttaacggctctaaaccagggtcaacaggagaggggacaaaagtcactccttgattttgctgcagcttaaagataagttctacctcagcttatgctagcccttatggggcaaaaaagggaaagtcattctccccaagtccaggctgggccgtcaaacagggagtggggtgtcagccccagacctcaatgaggtccccagattccatgcccaggtcag

SEQ ID NO: 3968 - DNA, 458 bp, Homo sapiens
ctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcag

SEQ ID NO: 3969 - DNA, 433 bp, Homo sapiens
  misc_feature (1)...(433): n = g, a, c or t
gcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatnctgaatgtaaaccctgcagggtattttccctaattctccatggtgcttcaatagcatgttattatcataaaaatgaacagttttgtggaatagatgaccaaataaaatgctgggactgaggaagtaangaatgaaataaatggaaattggatttcancatcctccattaacgaagctagaattaatgccaaggcaaaaaggcgactaaggaaaaactcatcccgggactctggcagaggcgattcggtcagcgacagtgggagtgacgccctt

SEQ ID NO: 3970 - DNA, 275 bp, Homo sapiens
  misc_feature (1)...(275): n = g, a, c or t
aaactgagagaaattgtngatantttggntactttnggttnntgtattgtactcctttgtatgactcttctccaatttatctattatactatcggttgacaccagggttttatcaagtttggaatgtatgctactatgacattcttggcacctgtcctagaatanaatttttaggccccaggatatgctttttgtcaactttaagaaatgacaccaccaggccaagcacctgtaatnccagtactttgggaggccgaggcaggcggatcacctga

SEQ ID NO: 3971 - DNA, 222 bp, Homo sapiens
  misc_feature (1)...(222): n = g, a, c or t
aagccctttaagtaatgatataactagaaactacgtttcatctcaaaggaaaaaccacaggtgatatattctcatgcttnaggttaaaaacctctcttaaaaggctaggtttgcgaaagccttcctaaaattatgcttctgttgttactatcaatttgatattcagccagaaaaattaaaaataattattaatcccaaagcatactttcaaaatttctacta

SEQ ID NO: 3972 - DNA, 290 bp, Homo sapiens
cctgtaaagactttaagagaagaaacagcacctggactgtgagaaaaagagtctctgaagacatctgacctggacaggctgccatctcttatgattatttcctgtgtggctgtgaaggttaacgggataaagccctcactgtcagcagagagaagaatccagtgggaatcatgtagcatttcaatgagagaaaggccaaaagtctgctgaactgtactgagccttagtttaccatcacagagaagcaccgctcttttttcaacaacaggacctagataataaggtttctg

SEQ ID NO: 3973 - DNA, 321 bp, Homo sapiens
ccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccag

SEQ ID NO: 3974 - DNA, 554 bp, Homo sapiens
  misc_feature (1)...(554): n = g, a, c or t
aaatgtttacttccaagacatttacttgaaagttgaatgttttgatgttctgtcccatggggtccttattgtaatctagaccatcttgttctagatgggcacttaagccctgtttcttcatagtctgttatgctgtcatttggacctggatgcttcctgtttcttccagcaatttttgtttgtgttttttgttgttgaagagaggaacatttaaggagttagataaactggtaattttcagatgtgtagaaaattgcataggtggtgaaagccaatgccataggctctgaaattttactatttcctacatcaggaaatgtgtaccaaaagtgctaaaatgccaagaataattttgagtatctaaagatagataaatcttttcatctgagtggaaatggcattatgactttatattctcatggttttccttgtaccttgaaattgagcatcacttgaattggagccccagaagcaaggttaaagtgagttactactgagtttctggtgttcctaacttatcccttnnggtatatatgtagaagataacaaagcag

SEQ ID NO: 3975 - DNA, 442 bp, Homo sapiens
ccaacatagtgaaaccccatctctactaaaaatacaaaaattagccaggcatggtggcgggcgcctgttatcccagctacttgggaggctaaggcagggagaattgcttaaaccggggaggcgggggttgcaatgagctaagatcgtgccgctgcattccagcctggttgacagagtgagactccgtctcaaaaaaaagaaaaggtagcattaagcctggtatgttttattttcctgtttgttagaaacctagattcatttttaatcttcaccagcatcacatttgaaaatagtgaattgggcagcttggcatttgtgctgaattccttataaggcgttgtgtaggagggaagattacatgattacaccaccagacccctgggtctttgatattaggagagcttggcatgtaaggagttggggagttgggcttgtctcattt

SEQ ID NO: 3976 - DNA, 569 bp, Homo sapiens
  misc_feature (1)...(569): n = g, a, c or t
ccttccagactcagaccagaccctctggtggtaaatggacattttcctacatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtactacggtgcagggacttgcatgtcctaaagcactggctgaaggaagccaagaggatcactgctgctccttttttctagaggaaatgtttgtctacgtgctgactccatattttcctacttgnggcagcgactgcatccgacataaaggaaca

SEQ ID NO: 3977 - DNA, 411 bp, Homo sapiens
  misc_feature (1)...(411): n = g, a, c or t
ctctctgcctcttgctccctccccagttcccactctgcctcctaaacagcaatttctgccgtcctctcctgggctggtgttggaatcaccctctaaaccccttgcccctgctgatgaggatgagctgccgcctctgattcccccggaaccaatctctgggggagtgcctttccagtcggtcctcgtcaacatgcccacccctaaatctgctggaatccctgtcccaaccccctctgccaagcaacctgttacgaagaacaacaagggtacttgccttggtttgccgtgtgcatggtgtgtctgtcgtccacacccctcttgggcgctacccaccaatactaaccctgtgatgcgccgctttctccagtgaatctgcttgggcttgnatgtagaacatagaatgataatttt

SEQ ID NO: 3978 - DNA, 412 bp, Homo sapiens
  misc_feature (1)...(412): n = g, a, c or t
tgacattgataccanatctgaattntacaaacacattgtgctttntggagggtctactatgtatcctggcctgccntcacggttggaacgagaacttaaacagctttacttagaacgagttttgaagggtgatgtggaaaaactttctaaatttaagatccgcattgaanacccacccngcagaaancacatggtattcctgggtggtgcagttctagcggatatnatgaaagacaaagacaacttttggatgacccgacaagagtaccannaaaagggtgtccgtgtgctagagaaacttggngtgactgttcgataaactccaaagcttgttcccatcatacccgtaatgctttcttttttcctttattgccaatctttgaactcattcaactccaggacatggaagagg

SEQ ID NO: 3979 - DNA, 378 bp, Homo sapiens
cctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcaccaagtccctttttactgaggacactttcttcctggagctgattcagaggcagggggccactggctttggtcagggcaacatcagagctctgtggcagtccgtacaggagcaatctgccaggagccaggaagcctaaggatgcccagggctgggtgcagccag

SEQ ID NO: 3980 - DNA, 216 bp, Homo sapiens
ccaggctcaggccctggggtgaaaggagacaggtgctgccaagaccatacatcagtcatctggcagcagctcgagaagcatgtcctccacgccgtcaatcttgatgtggtacactaagcgccagaaactggagtctgaggatcggtatcgtccatcagggtagagctgtcacatgataggcagcaggcttgggcctatctgggtgggggtcatagg

SEQ ID NO: 3981 - DNA, 349 bp, Homo sapiens
ccaagtgtttgtgttacaggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacaggtggctacgtccgtgtctggaaggtgcccagcctggagaaggttctggagttcaaagcccacgaaggggagattgaagacctggctttagggcctgatggcaagttggtaaccgtgggccgggaccttaagg

SEQ ID NO: 3982 - DNA, 277 bp, Homo sapiens
ccaatgagttcaaaaagcacgtttgcagggcttcctgaatgccgtcgaggcatggcttcatgagggccatcgcgggcaccccgatgtctctgtgattccctggcaggctgcgtttctcaatactgagaccctagtttgctctgacttctaaatgagctctctcatccttcatcagaaggataaggaacctggcctgcactctttgggttaaacatgggtagagaccgtctcaggatgaggacctcttggggaaagtacaaacctctgctccctgtgg

SEQ ID NO: 3983 - DNA, 447 bp, Homo sapiens
  misc_feature (1)...(447): n = g, a, c or t
aaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatgaaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttanaaagaacatttt

SEQ ID NO: 3984 - DNA, 288 bp, Homo sapiens
ccagtcctggcgcagcacccccagccgcagcaggcactgcttcttggctgtcatcacaaagtagtgggtgtcgtccttgtagtacacaatgttctccagatcaatgcctgggggtacagggcaggggacagtagatatgtctcctgataatgcatcaccttccctaaacatcccaacatggcctgacctctgagctgggatcccagcttaggctgcggtgagtgctccacgcatagaaccccacgagtcctgatgacacaaacaaccatctgtcccaggcccaggagg

SEQ ID NO: 3985 - DNA, 504 bp, Homo sapiens
gtcacaccaagcccgttcacaccaagatcgtgaacatgcctgatcacgtctgaagggcacgtgaccctgttctgaagtggcctgcagctcccgtggccctcagcaaagccaatggacgtgtactctgcttcctccaggaagccctccccccgctcccccctctggtagacacgtcttgtggttggtgtccacaaggaagttcctgattagcctcggagctgcccgatggcctctccactcctggcacatggcctgctggctggcctggggcagaactacagagggccggagctggagatgtggtctctgggagtcactctgtacacgctggtctttgaggagaaccccttctgtgagctggaggagaccgtggaggctgtcatacacccgccatacctggtgtccaaagaactcatgagccttgtgtctgggctgctgcagccagtccctgagagacgcaccaccttggagaagctggtgacagacccgtgggtaacacagcct

SEQ ID NO: 3986 - DNA, 443 bp, Homo sapiens
atgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcag

SEQ ID NO: 3987 - DNA, 503 bp, Homo sapiens
ctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggc

SEQ ID NO: 3988 - DNA, 214 bp, Homo sapiens
ccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatgg

SEQ ID NO: 3989 - DNA, 387 bp, Homo sapiens
gcgcctgctccccggacgaaatccgcggaccgggctttaggttcgccggaatcccacgctcccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaatttt

SEQ ID NO: 3990 - DNA, 104 bp, Homo sapiens
  misc_feature (1)...(104): n = g, a, c or t
ccantgtccatncacagttgccnngatgtggnaggccancgtgtggaaatggatcctggtgagatccgaggctctgnttttactcctcccatgttctttcaaga

SEQ ID NO: 3991 - DNA, 315 bp, Homo sapiens
  misc_feature (1)...(315): n = g, a, c or t
aaagtaaatacagcttttagatataaatctttcaaaggttttctttgaagagctgtgaggtgactatttcagatttgatgaacagtaatttngtcagtaaacttntcaaaaaaccaatccaagaaagaattgttttctttttccctccatgtggtcggtttcattcttaaggaaggtctgatgcagtaagaagatgcntttnacaaacctttacacaagtttgtgaactgtcaactaaagacaccacctntgatgtggatggtttcattcaatccatgttcgaccagctttatatcttctanatcgtctttaatg

SEQ ID NO: 3992 - DNA, 509 bp, Homo sapiens
aaaccttaagaaccacataatactatataatgcttttctgtacaaatctcaagaaacactttcattcattaaaacatcatgaaaatccttaaatgtgttaaatggaaaaaaatgaaaccatgaacaaaaaagctatacatgtaggtgcatatttatctcctcctgagttgggagaaatctttctaagcatagaaacaatggtagcaaaagagaagaatagatttggctggattaacaataaaaaatttctgccagaaatatgaaaattcaatttagacaaaattcaatataaacaaaattaatatagacaaaggtggtaaacaggtggttctcagagaagataaatacatgattatttaacataaaaagaaatgttcaatgtttctagaagacaaataattacaaacctaaacaaattgtatatttgttagattggcataaattataataatccaacattgagttaggtggaatataaattggtaaaatatttctggaagacaatttgg

SEQ ID NO: 3993 - DNA, 228 bp, Homo sapiens
ctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcag

SEQ ID NO: 3994 - DNA, 215 bp, Homo sapiens
ccagaacttcctatactatgttgaataggagtggtgagagagggcatccttgtcttgtgccggtttccaaagagaatgcttccagcttttgcccattcagtatgatattggctatgggtttgccataaatacctcttattaatttgagatacattccattgatacctagtttattgagagtttttagcatgaagggtgttgaattttgtcaaagg

SEQ ID NO: 3995 - DNA, 396 bp, Homo sapiens
  misc_feature (1)...(396): n = g, a, c or t
aaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatanaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgnnggcctngtgtcacangtctcagttcttagg

SEQ ID NO: 3996 - DNA, 281 bp, Homo sapiens
ccaccataagtcctgatacaaccacggatgagctgtcaggagcaaggttgatttctttcattggtccggtcttctccttgggggtcacccgcactcgatatccagtgagctgaacattgggtggtgtccactgggcgctcaggcttgtgggtgtgacctgagtgaacttcaggtcagttggtgcaggaatagctgtggactgggttccaatcaggggctggctctccatatcatcgtgcaaggcaaccacactgactgtgtactcagaacccggtctgagg

SEQ ID NO: 3997 - DNA, 262 bp, Homo sapiens
ctgatgcggaaggagttcaccctggagttctcccgagaccggaaatccatgtccgtgtactgcacgcccacccgccctcaccctaccggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactag

SEQ ID NO: 3998 - DNA, 218 bp, Homo sapiens
ctgctctgatgctctgctccaggtcatggtaaatggctttgtagctaaatcagagagaaacgtggctcttttagaaggcaggggccagctaccctttgtcccagcccagtgccagccacagcaggtcccgtggtctctgccctctgtgagttggtttcacagacagagccagaacactcctcccttggctcaggtggaaggtcacgggccgccacgtg

SEQ ID NO: 3999 - DNA, 528 bp, Homo sapiens
aaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggtta

SEQ ID NO: 4000 - DNA, 182 bp, Homo sapiens
aaagtatattggaattcgtaactaaagtaataaataaatgcttgaaatatacccagtagaaacttatttttattatccaatccttttgataagaaatgcctctagtgttatgtacaaacttgatcttctttgaaatgtgttgtccactgcttttctgtttctgtcacagtagctataaacag

SEQ ID NO: 4001 - DNA, 311 bp, Homo sapiens
ctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaatgccttgtgtttgtttcattttttt

SEQ ID NO: 4002 - DNA, 505 bp, Homo sapiens
  misc_feature (1)...(505): n = g, a, c or t
ccagtatcgttttggtacttttgtacctctatctgactccatgcccctgcaagtgtaaaaccaagagacagaaaaatatgctacgccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgngttgttttgttctttgaaatacaaccaaattctcttaaaatgattggtaggaaatgaggtaaagta

SEQ ID NO: 4003 - DNA, 460 bp, Homo sapiens
cctctctttatctctttcaggatttccttcattctgccgtttgtaggaggcaccaggacgcacggactctatggaaaggtgggcagggaggaattaacagcagcacctctgtgcccaagaggaacaagagaggaactcagaagtaggagtgatgagaacaggggcttctgagcattttctggtggccctaaactctttcctaccctactttcaagttgggctgcctgagcaatcaccagtgaaggggaataaataatgggagaaaaaaatctccatttaaggcaagaagccaaggggaactgtcaggataagaccagtcaaggataacaagggcagaaaggaatgagaaaaggttcatagaaagacaagacattgaaagttgaagacaaagatcacatcttattcatcactgaaagtacctagtcgaattctctccatccataaagctgacactggaagg

SEQ ID NO: 4004 - DNA, 324 bp, Homo sapiens
  misc_feature (1)...(324): n = g, a, c or t
aaatcatgtntaataaatgnttgtatntaaatgcatatgtacagaancctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaatttttt

SEQ ID NO: 4005 - DNA, 508 bp, Homo sapiens
ctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatc

SEQ ID NO: 4006 - DNA, 397 bp, Homo sapiens
ccaccatcacagtccaggatgaagaggagtacagggtcctgtgagctgtttgaccactgttctaagaaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtaagatgttttctcaaatatatgctgtgcctgtacttatatacagtctttcaagagagatacaaacaaggcagaaacattt

SEQ ID NO: 4007 - DNA, 466 bp, Homo sapiens
ccacgttcctggccgaggacccgaaggttaccctgaccatcttcgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagct

SEQ ID NO: 4008 - DNA, 399 bp, Homo sapiens
ctggggactggtgcttgctgaaacccaggagctgaacagtgaggaggctgtccaccttgcttgactcactgggaccagcaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcag

SEQ ID NO: 4009 - DNA, 325 bp, Homo sapiens
tgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 4010 - DNA, 494 bp, Homo sapiens
aaaggctacgttcagtttcctataggtgatattgttaggatctactagcaaatgatttggtaacctgacatctttgtattcatgtccaaaaaaattcttttataagaacaaaaatggtactcttagcctcattcactggagtattactaaaaagcatgatattcttactctattttgggtacattatgacagagaggttattattaccaactgtcagtagaactgaggcttcttgagtaaaggggattgaggtaaacctttggaagctggtgaatacatttcaagacacaacatggcacctgtgtctagctctatggtacaacatggtactatgacacatataatgggttgccagatggggaaggcagcttctctgcaactgagctgagatctcaaaatagacaatgtcaagatggaatgagaagggaaaaacagcatgtgtagacaggtagtgacaaaaggctaattaaggactgaaagaaaccagtggacct

SEQ ID NO: 4011 - DNA, 481 bp, Homo sapiens
ctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctcta

SEQ ID NO: 4012 - DNA, 445 bp, Homo sapiens
  misc_feature (1)...(445): n = g, a, c or t
aaatgaagaacttttccttgaattttttgttgtcttcgttggttcttggcttgctttttggcttgtttctttgcttttttctgtaagtgcttacttgttccagaaggaatatcacttctctcttttatgtaactgncgttatctttttcttcctcactatcttgatcttcatcctccactgtctttttcagatttttatcatttacacttttcttaccactctgatcatctaaaactgggagggacaaatcaaggaaagattcatgaaccaaggagacagttctgcattgatcacacatgatcatactagttagttcaccaccaaagatgcggtcaacaaaacttggcattgattttttcttctcataattnggtgttcttctgctctcatcccatccaataagtagcgaagcagctcctggctgtcttgctgctgatagccttt

SEQ ID NO: 4013 - DNA, 539 bp, Homo sapiens
ccaggtacagcagcatggcctccatgacctggtgcttcttcaccaccaggtggctgtccgtgcccagcccgtgcaggatgggcagcaccttctccgcaaagtgcagggggcgctctgcctcctccctctcgttgacctcaaagcaggtccaatagtccttctccctgatgcccacgttccggcgatccaggatctccagggtgagctcctcagcagtcatggatgctgggaccttgatatgctgctcagtctctgccttcttctcttccagatacactgtgcagatgaagtcaccggcatgctgggtcccactggcagtgccagccacgcgcatcttcacaatggcagtgatctcctcccgctgcttcctgagctcttcctcatccacactaaacaccaccacatagtggttaatgaggtcttccaccacacggccagccttgtagtcctgcccatctgtctggaagagcgtgggcccaaacacaattgccaagttgtgcacgttcatctggttcgtgtctgagaagcactgaacacag

SEQ ID NO: 4014 - DNA, 528 bp, Homo sapiens
  misc_feature (1)...(528): n = g, a, c or t
cctgggctggcgccctgtgtacagaaatctctggacaccgaatggtttcagacgccgagcaatggcctggcctatgcgccccagcccgatgatgccgacagtgctctgcgtgagtccatagccacacagccagaggggcttccacgaggtccagccaccattcttcacttcctcgatggcctccggcaaccggcggcaggtggtaagtagcggggagactgcgagttcggcggtggtatctgtcaggacatctggggtgtagccaactcggatcccacgcttcttgatttcatccaaagccaagtggtcgatgcccacagacatggtgctgatgactttgagattggcccctgcagcatccaggatcctcttgtccacgtggtcggagaggaggcagagcaggccgtgggcccccgccacacctcgctctagctccttggcagggatgggctcatccgagtcccactgntccacctcacagcctcggcgggtatcctgcgggtgacgaacaccttcatgagtcgcacc

SEQ ID NO: 4015 - DNA, 486 bp, Homo sapiens
  misc_feature (1)...(486): n = g, a, c or t
ccagtgggatggttaggctcaagtttgacaaaggcacctgccacagtaggcttgaataaagtgggtgagtcttagacctatcgaaaagcatactaacagggtgctgatagatgggccacataacaccccggaagatcagcagggccttgtgtaggctgctgcagcatttttttttttttttcttttttgagatggagtctcactctgtcgcccaggctggggtgcagtggcgccatctcggctcaccgcaagctccgcttcccaggctggggtgcagtggtgcgatcttggctcactgcaagctccgcctcctgggttcacgccattctcctgcctcagcctcccgagtagctgggactacaggcgccaccaccttgcccaactaattttttgtattttttagtagagacgaggtttcaccgtgttagccaggatggtctcgatcttctgacctcgtgatccgcctgcctcanactcccaaagtgc

SEQ ID NO: 4016 - DNA, 492 bp, Homo sapiens
aaaatctcccactttttaatgggacatgtccaggtaggaaaggacagattttatgtactgaaaatcttgaaactataaagtatgcattttgtctgactttattacattagataatttaggccactcctacctatttgcaattatattttttctgaaaaggatttcaatttaggtagccatttaagataacctttccaaatgctctgagaactagacattaatagttactggcctcagatatcagaacacaaatgcttagttacactggtaattactacctatgaggaagaaagtgtagtggaatctgacaattaatgagaatcaacttgcagggtctaaatgaataaacaaagaccaaaaataaggtgaaacatttccttcaagtatatattaaaaaactacacgaaaaaaattctacctgaaataaataatatttatacttttgtgccagtcttgaataattagaggaaaaaatgaagtaaacaaagaaac

SEQ ID NO: 4017 - DNA, 270 bp, Homo sapiens; identical to SEQ ID NO: 3318

SEQ ID NO: 4018 - DNA, 504 bp, Homo sapiens
aaaatattttgaacacttcttgttggattatatcagaggtgtgactacattttaacaaaagtggactttttaagataagtctggtcaaagaagtgcagaaacagtaagtcaatatgatagaaatagtaggtcaaaatatgatgtgttagttcaattaatgtatgaactcctgccaccatcaaaagacaaatattaaaaagctacatctttagtctagttctgtattttaccagaggcacatttagaagaaaaacaaaagggtcacccaaatactaaattgttttcaaccattacagtaaatagagccaaacctagaaatttcaaaaacaatccattttatattccagaaatctcctttatccatgtgctaatcatccagaacacaattttctaaaaatagtaagacaacagtttcacattaatcataacttttttaattaacaagtagtgaatcgggcactttaagatattgtttactacatactgaaataaacagatctgttt

SEQ ID NO: 4019 - DNA, 233 bp, Homo sapiens
ccttgagattttgctgcctggactgtaaatctggccgaggctgagaagagcaaacaaaggagcaactgtgggaactgacagctcaaggactctggcatcagggtaggcccttggctgactttctcaggaggtgctgtcggggctggtcttcccgccggccaccacatacatcttaaaattacagagggtgtgagtgaccctaagatggttcagcaggcactggaggaaggagg

SEQ ID NO: 4020 - DNA, 403 bp, Homo sapiens
aaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactctttt

SEQ ID NO: 4021 - DNA, 357 bp, Homo sapiens
ctggggctgaggatggagtccaagactgagaaatggatggaacgaatacacctcaatgtctctgaagggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcag

SEQ ID NO: 4022 - DNA, 307 bp, Homo sapiens
aaagccacagtaagttacaaaaggcaaattcatagatgctctttgaaagtgaatgtaactactatacttggtattctacttcccccacgcccccagaagtttttgatgctatagacactgatatatagtttgaaactctcactataaaattactaggctaagtctatcaagacttgaaagtttgttttgctgaggtaggtgaaagggtaatctctgttctttccaggtgactgcatctgcacaggcttccctgggaggacttcatcaacagcacagttacacatcaaagtcctttagctctccccag

SEQ ID NO: 4023 - DNA, 175 bp, Homo sapiens
ctgcagtgtccctttttatatcatgctagtgttgagacatacttgactaacttgggaacagttcgatatattgacgaccgtcaacttaagaaaatcaacagcttttggccccagcgtccaagtgaacttttcatggagtgcagaatctcaaatggacaaaatactttgtcttttt

SEQ ID NO: 4024 - DNA, 307 bp, Homo sapiens
cacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttgg

SEQ ID NO: 4025 - DNA, 271 bp, Homo sapiens
aaaaataatattacattaagttttcctggtctaataaccaactttgagaagtacagtggaagggtatagaacttcctatatcttctatacttttaatgccaatttgatttttattgtgatgtgatatttaacagtatgctaaaaataaaattgactgaattgtatgattttgtccacaacattgaagtctctttttgctaaaatattacaaaatgaatccagtaaacactttccaatggcctaagttagagatgaattcaacttttttttt

SEQ ID NO: 4026 - DNA, 407 bp, Homo sapiens
ctgctcccggttcacgagggaggagtggtggtagcgatcccgagtggcgaagtctgcattctcctgggtgagctgagtcatctccatgtcaaccttagccagggacggcgccaagatgatctgctcctgaggggaccgcaagctcctgcaggaggggagcaagagagacctcatccaccggaaaaagctgaagttggaggctgatccaaggtgaagccctggactggcccggccaatgtagaaatacacgatggcagcaacacccatgttaaccagggtatacacccactgtatcacaaacatgatgagaagggacccaacagcccccaacagggagacccaggggttgcacatgtgggtatagaaagaagtggatcttctccagacatcttgttcttggagcctgg

SEQ ID NO: 4027 - DNA, 443 bp, Homo sapiens
tttctataaagaaaagaagtttaattggctcatgattctgcaggctgtacaggaagcatagcacccaaatcactgggctttggggatggtctcagggagctttttcaatcatggtggaaggcaaaggggaagcaggcacatcatatgacaaaagcaggagggagagagagagagtgtgtgtgtgtgttggagggaggtgccacacttttatatgaccagatttcatgagaactcactatcatgaagatagcaccaagccataagggatcagcctccatgatccaaacacctcccaccaggccccacccccagcaatggggattgcaattcaacatgacatttgggcagggacaagtatacaaactgtaccactggcctgatgaagacacagcccatggtgcctacaaattctcactacctagtaggcaattaatattggaaaa

SEQ ID NO: 4028 - DNA, 525 bp, Homo sapiens
aaatacaaaatagaatgttatatatcttgtagacagtcaaatatttgatgttttatgggacataatcatttgggaagtttttgttgtaaatgaagagttagtttgttgctattaatttgtttgacacataagttcattcctaaaagttagagatgttacataaagaagggttgaggactttatttcagaagtcatttaattttttctttattttctttcagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagccttt

SEQ ID NO: 4029 - DNA, 330 bp, Homo sapiens
ctgaactattgacaagttttccttaataaggcaaaatccccaactgtgatagatgcataacggtagccgctccacttaagcagtacagtttaacccgccaccattcgatgtcttaacatgttccaagaagaacaatgtcatcttggttttaaggtgatgcatcttgtttttttctgatagaaaaagaataatgtgctttttattctcctagagatttggtgtctgtgaatggttgtagctctgtgacatttaccatacatttctcagcttccacccatcaatttgctgagaaaaaaaggtatgctacaaatcgcagcaatagagcacttt

SEQ ID NO: 4030 - DNA, 493 bp, Homo sapiens
  misc_feature (1)...(493): n = g, a, c or t
ctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgngaacttgtcgtcactcttggatgtccggagatccacg

SEQ ID NO: 4031 - DNA, 240 bp, Homo sapiens
aaaagtattgtgttttatttctttatttcaccaccatttatatgtatgaactatgatcaaggcttgcctatgtcctgtggagcaaggccaagaaatatgctttatattggttatttgatcttcagcatcagattatcactattgcagaggtgggcaaaaccatgcaaaaagaagaggaagtatatttgcattaatggcattaaatgaagtacagttgaagctgcagagttttaccagtgg

SEQ ID NO: 4032 - DNA, 285 bp, Homo sapiens
ttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcag

SEQ ID NO: 4033 - DNA, 499 bp, Homo sapiens
aaacccatgagtttatgccctgggctccttagcccacaatagtgtaataaaagtgccccgggctggtttgtgcttatttctgccattgtccctcccacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatag

SEQ ID NO: 4034 - DNA, 615 bp, Homo sapiens
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctgggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccatttttt

SEQ ID NO: 4035 - DNA, 254 bp, Homo sapiens
aaagcgctgatcctgtttatttggcaggaaaacgagacaatccagcagcccaggagggacaggtggacttaatcctcctcctcgtcgtctccagccccagccccaccctggcccttcttggcattcttcctcttcacgcggcccgggcggccacccccgtagggagagcgcagagagaagtcgacgtgcttctgggaatccaggcggacaatgaaggacgggatgttcaccacctgcttgcggaccctgtccag

SEQ ID NO: 4036 - DNA, 360 bp, Homo sapiens
ctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggttt

SEQ ID NO: 4037 - DNA, 242 bp, Homo sapiens
ccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcagg

SEQ ID NO: 4038 - DNA, 373 bp, Homo sapiens; identical to SEQ ID NO: 142

SEQ ID NO: 4039 - DNA, 504 bp, Homo sapiens
cctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacag

SEQ ID NO: 4040 - DNA, 410 bp, Homo sapiens
aaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgttt

SEQ ID NO: 4041 - DNA, 405 bp, Homo sapiens
aaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccgcaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttgaactttccacctggtcatatactctgcag

SEQ ID NO: 4042 - DNA, 349 bp, Homo sapiens
ctgacaatctatgggggcgggggggggggcgcggcaaaaaagcaatgatggaccttggctgatccccccgacccctttcttaacaatataggtagatgtctatcgtcagcttgcctctttgccaagacctagggggcggctctgccatgagctgctgtgtgctgccctccccaccttcagcacactcatctacacacacacaggtagcacccacctcgatgagaccgccttgctctggcctgccccaaccctggaagttgaaaacatagaaccatttatttctgcttctactctctgtgcccatgtcttgtccacgaaactttgctgaacttccaggaccttacacctg

SEQ ID NO: 4043 - DNA, 373 bp, Homo sapiens
ccaaaactgcgaagagatgcagaataatgttgacaataataagttgctgaatcgtcaggctgcagactggtgatggttaaattgaattgtgtcccagatccactgccagtaaatcttaatgagaccccttcttctaaactggaagtcgcataaattaggacattaggggctttgcctggtttctgttgatgccaggccaaccaccgatctatattctgagaggcccgacaacttattgtaactgtatctccgacagatgcagacagggtggaaggagattgggtcatctggatgtcacatttggcacctgggagccagagcagcaggagccccaggagctgagcggggaccctcatgtccatgctgtgtcctg

SEQ ID NO: 4044 - DNA, 368 bp, Homo sapiens
aaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcag

SEQ ID NO: 4045 - DNA, 289 bp, Homo sapiens
catttagcaagttggttttggttttttcttctttacaaaatatttttatttttgttacccttatgtttatggtttagatttctttggccttatcaagcttttcttattttgtcttcaacaaagttaaatccagcatataaaacaagatttctacaaactgggtatctttttaatactttgtttccaaaggatgcaaggtgttgtaaaccgactgtccaagttactgaaacctgggggaatgctgttatttcgagactatggaagatatgataagactcagcttcgtttt

SEQ ID NO: 4046 - DNA, 309 bp, Homo sapiens
gtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaatttt

SEQ ID NO: 4047 - DNA, 132 bp, Homo sapiens
ctgtgagccaccctgcccggccacttttgtatgatttctaatgtatttgtaatttacctaacaaattgcctaatctgctatgttaatgtatttatgaattaaaataaatacgactgcaaaaaaaaaaaaaaa

SEQ ID NO: 4048 - DNA, 456 bp, Homo sapiens
  misc_feature (1)...(456): n = g, a, c or t
aaataaataggagtacactgtaaaataataaaagtatattgtatagtaaatacataaatcagtaatatcttttattatcactatcaagtattatgcactgtacataattgtatgtgctagacttttatatgactggcaatgcaggtttgtttacaccagncatcaccacaaactcatgactaatgtattgtgccacattacaatgtcgctaggtaacaggaatttttcagctccattataatcctatgggaccaccatcatatatacagtccatcattgaccgagatgtcattaagaggtacatcaacagaaataatgtatattatgtacaaaaataaatgaattaaaattaaatgaatacttgataaatgacaagttataaaagncnatttctgattctaaaanatacatgnnaatattttttctacagagcatggaaaatacattagatgttat

SEQ ID NO: 4049 - DNA, 435 bp, Homo sapiens
cctgttgaggagaaactgaggccagccctggcggagacctagcccagcggggtaaggagggtgggggaaaactgggtctgaaggaatgagggccccctccctctgggctttcctcctagagggcctcagtccctcctgctggctgggctgcacgacccccaatccttgctcccctaacccggaggagggggccagaccagggagggcagtggacagggagcctgggggagttggggagcgcagggcagggtccatggtgtgcagagggggtggcagccacctaggtggtcagttcctggcagcgatgaccacagagagtgccacaccccccaaggcaacagcagtcgccccaaacagccacttccatgggatggactgtggataaaaaggaggggagagaagggtggagggaggtcaagactggcctctggggcc

SEQ ID NO: 4050 - DNA, 206 bp, Homo sapiens
  misc_feature (1)...(206): n = g, a, c or t
ccaccccagtaactgacctgctctcctgttggagctctacatgggacaccagctcccatgcatttatccctcttcanacctcactggtgagaagctgggcttctgggtccccatgctgcttcatcccacctcccaaccctgtcttcaggcccactgctgatcccagtctagaaccacagcaccgcccccatcctgcatgaagaagg

SEQ ID NO: 4051 - DNA, 163 bp, Homo sapiens
  misc_feature (1)...(163): n = g, a, c or t
ctgtttgccggcaaatatcagacgctgctggtcaggtgggataccctccttgtcttgaattttggccttgacattctcaatggtgtcactgggctcgacctcaagggtgatggttttgccagngagggtcttcacaaagatctgcatgtttgcgtcagctcgg

SEQ ID NO: 4052 - DNA, 379 bp, Homo sapiens
ctgatggagatgactctactgcaaaaatgacaaccagcaagaaagcgggtggtgcccgtttcctccctggggaccctcagagggccaggccattctcttccttggtgtgactgcggatccagggtaagaagtgtgagactctcgtgtagacgcctggcttgtccttcagggcacatccacggccccagctcacaattccagtcaaagtcatgcggccttggagggaacagacgaggggtccccctgagtctccctggcaggaatctgttttccactgtgggtcagcagcacacagcattttggtggtgacttcagagccgtagtagtggggctgctgacactcccggtgggaaatcagcttcacaacagtcattttcag

SEQ ID NO: 4053 - DNA, 373 bp, Homo sapiens
ttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccag

SEQ ID NO: 4054 - DNA, 382 bp, Homo sapiens
ctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgtttggtgcaggtgagtttggcgaggtgtgtcgggggcggctcaaggccccagggaagaaggagagctgtgtggcaatcaagaccctgaagggtggctacacggagcggcagcggcgtgagtttctgagcgagg

SEQ ID NO: 4055 - DNA, 306 bp, Homo sapiens
ccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtgg

SEQ ID NO: 4056 - DNA, 255 bp, Homo sapiens
ctgccctgtggtttcacatgataaggcactacttccaaaatcttccacttccacaaaacatctgtttcccagaagacctgagaagcatattccaacaggcggacacgcccgaccctccccaacttaaaatccacaccaatggcagcaccgtgtggaaagtgagacattcgttcagtgacctggggtttttctgggctgttggagcagccatagcaaatggcaagttctgctgtctgggctgctgtggttctctgg

SEQ ID NO: 4057 - DNA, 332 bp, Homo sapiens
  misc_feature (1)...(332): n = g, a, c or t
aaagaactaatttgtaaattatgacacaaaattttattaacaaggaaatatccattaattgactactacagtaaaaactttataatgcttgtatcatgaagaaagaccttccttttccttatatattaattgaactacataggcttgctgtacattttgttattcatgttataagaattctagattccattgcttttgaaatatgtttctttttaggaactaanagtcaacttatagtttgatttctgttttatttgtactgtgtttctgattttgtgggtttctaaataaaaagatcnancccaccacttncantatactgtnttctattt

SEQ ID NO: 4058 - DNA, 229 bp, Homo sapiens
  misc_feature (1)...(229): n = g, a, c or t
cattatgggtaangnggggttgggcggggctttaattccatccagataatgctggatggcttgggaccacttggcagtccttcgctgcttttctgtgctgcagtggctatggagtgagcaaggctcctcagggagctatttctataggaagcacaattctggacggtatggctggggaagcgtaaagagggttaacaaggataagaaacctccaccccttccccttcag

SEQ ID NO: 4059 - DNA, 567 bp, Homo sapiens
ccaggctggtcttgaactcctgacctcgtgatccacccacctcagcctcccaaagtgctgggattacagacgtgagccactgcgcccggcccagctagtctatatctttcaagtgggaaatgtaatcagttcccattcaaggttattactgataggtgaggacttattcttgccattttgttaattgttttctacttgttttgtgcatcctttgttcatttcttcctctcttattggttatcattgtggtttggtggttttctgtagtggtaacatttgattcctttctttttctcatttgtatctgctccaccagtgagtttcatgttttcatgatgcaaatatcagccttttgctttcagatgtagaacatgttaagcatttctcgtagggctggtatagtggtgatgaatgccctcagtttttgcttggctgggaaagactttattactctttaatttttgaaggacaactttgccgagtatagtgttcttgcgtgacagttttctttttcctttagcacttttaatgtattatcacattctctcctggcctgtaaggtttctg

SEQ ID NO: 4060 - DNA, 309 bp, Homo sapiens
ctgcacttactcactgatgggaaaagttctttgagttacacagtttcaaacaggaacagccaggagactggggacttaaatcataactattgtataaataatgggagctgttccctgagctaaacgccgccctttggcagaggtagagccttttggcagagggaggcaggagaagagtgtgggaagtgaagaagttcctgaggtgacaaagtgaattgcaccggagagaaggggggataaagctgcttcccagaaactaggacagcaacacctggctggtccccgaggacgaggacgggacaagaaagg

SEQ ID NO: 4061 - DNA, 469 bp, Homo sapiens
ccatcatgtcgcgcacagccagcatcagcctgttcaggccctggttgcggttcagacccccagccactccttcctcgggcctctccccctccatggtatagtttggcaacagtgaccggaagaagagagcaatggtgtttccatggctgataggacttagcctctctggcctgacgtaggagtagattgtgtccgaaggaggcagaggatcaaaccccatcacagactgcgtggtcacgtccgggggcagggcagcgacggcttccttgatctcagagaggatcacatggcggtggatattcctgggtgcacgctggtagagcaccttccgccggttctcacaggcttccacggccgggtccccggcgtccactgcttgcagaacctcgtggacgttctcctccagccagctcatggtggcgggctctttccagagaaagtgtgacctcccaaggtacaggttcaccag

SEQ ID NO: 4062 - DNA, 281 bp, Homo sapiens
  misc_feature (1)...(281): n = g, a, c or t
tccatanctataaaaatcgttacggccaggatatgccggaacagaacactccccactggggtcctcanccttggatgtcagctcggcccctcaaggggtccctacacctggaagctgattccactcatcagtctcgagctgggcgcatgtggagttgatgtggagttgtagctgactggctggtggggtcagcctggcctcccagtgtggagcatgggcaccagcctcactgcgtggtcgccctagggcatatgctgcgggctgttgtggcattcctgtgg

SEQ ID NO: 4063 - DNA, 111 bp, Homo sapiens
aggctgcagcagcccttgtgacagggctgtggtcacccttagctagcactgacaagatctccatcatctcactctccatcagggtgctggcaatctccctcgaggacctcg

SEQ ID NO: 4064 - DNA, 234 bp, Homo sapiens
ctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacattt

SEQ ID NO: 4065 - DNA, 171 bp, Homo sapiens
ctggacgcacggaggccacactgagtatgtcatcaatctgccgactgttgaagttggacaggcccagcgcctgcaccagccccttagccaccagtgcctccagagccttccaagtctccttgtagtgggtggagtcgtagcatatagtcccatcagcattcttggggaagg

SEQ ID NO: 4066 - DNA, 568 bp, Homo sapiens
aaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttt

SEQ ID NO: 4067 - DNA, 389 bp, Homo sapiens
aaaagaaattcagaaactaagcggttggagaggagcattggaaatagagggggatgctatgagatgggggttgggagcagagaagaaactgcaggagggcaaagtgtaactagcaatataccttctgtgatgctccagaaacacatgtctgctaagattaacttgattggagtttcttatgaaacaggctgatcatcaagatttttaactcaggtttcagtgaaaaaattggaaacttttacaagaaagatttgagaagtagaaggcaggcagcaaattttccagatattatgcttgcatttcaaattcctgtttcaggcttttcaagtaggcatgcacattcccaaagccatgatatttggctaaatacacaaggaccccagtcgcac

SEQ ID NO: 4068 - DNA, 425 bp, Homo sapiens
ccttcctccgcttccgctgcacctcttccttgtctgggggcagaggaaaatgagattgagcccagttattgtgtcatgcctcaggggcccttcccagaagagccctcagggccggctcctaggaagcacctcctgggaccctcgcacttctgacttggctcatgcatccccacatctagctcttgggaccttcttctagcccagcctggccccccgccagcaccctgaggtcctcagcccagctccaccttccaccagagggtaataggtgaactgtttggaatcagacacgtcccctcctcgcttgcgtttcagttgcagaaacactgttacaggccgctcaatcttcatcttgtgataggggggtgtccggaacacaatggcatactgtttatgcacatctgtgggagagaagtccccaaagg

SEQ ID NO: 4069 - DNA, 361 bp, Homo sapiens
ctgaagcccaagaactgctgatacactgcagatgagaaaacatttgctactctcccagctctggcctttcttaagctaaatgatgatcacaacaatatagatcacttgttctataaaacaattttggcttacatgtatagcaagctgcactgccagcatttacatttgcaacaacatttcaatcccttttttgactctagaggttgcaactcttcagctttattggttcagcaatttagtcccaaattctcatgaaaaatttacactttttaatccagcatttattcccttgaaatgagttactacacctatgtaaatttttttaatgtttgaaccccaaagataaaataaatacattttt

SEQ ID NO: 4070 - DNA, 486 bp, Homo sapiens
aaaagagtaaaaaatggttttctggttccaagatggctgaataggaacagctccagtctacagctcccagcatgagtgacgcagaagacaggtgatttctgcatttccaactgaggtactgggttcatctcactggggcttgtcagacagtgggtgcagaccacagagtgtgagctgaagcagggtggggcatcacctcacctgggaagcacaaggggctgaggaattcccttttctagccaagggaagctgtgacagatggtacctggaaaatcgggacactcccaccctaatactgtgcttttccagtggtcttagcaaatggcacaccaggagattatatcctgtgcatggcttggagggtcctatgaccacagagcctcgctcactgctagcacagcagtctgagattgaactgcaaggcagcagcaaggctgggggagtggtgtctgtcattgctgaggcttgagtaggtaaacaaagtgg

SEQ ID NO: 4071 - DNA, 527 bp, Homo sapiens
  misc_feature (1)...(527): n = g, a, c or t
gacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcggatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggtaattctttcccacttttctataagtattcagaaatttatttgtattaagttgnctttagccctttgattttttttggcatgcttctgaatttgcttttcttttt

SEQ ID NO: 4072 - DNA, 342 bp, Homo sapiens
ctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgataaaaatctctagtggataatcataacactctcggtcacatgtttttccttcagcttgaaagctttttttt

SEQ ID NO: 4073 - DNA, 400 bp, Homo sapiens
ctgccgcaatttccatgccaggatatttttccgcaaatcagtcggttgaaattcagaggggtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagttt

SEQ ID NO: 4074 - DNA, 131 bp, Homo sapiens
caggacttaagacaaatgggactgatgtcatcttgagctcttcatttattttgactgtgatttatttggagtggaggcattgtttttaagaaaaacatgtcatgtaggttgtctaaaaataaaatgcattt

SEQ ID NO: 4075 - DNA, 116 bp, Homo sapiens
aaaaagctgatacttgacaagattttggatgaagacttatatatcaatgccaatgaccaggcgatcgcttatgtgatgctcggaaataaagcccaaactgtactaaatggcaattt

SEQ ID NO: 4076 - DNA, 229 bp, Homo sapiens
ccacatccctgcatttatttgtccgggaatagtggcattcctaatttagtaaaataaaagaatagactgtaaaattatgctgacctataattatacctataggatcaattaataaacatgtcaggttaatatctactgtagcaatgtggtagtaaattttctttgggtattaaatataaatgtgtacatataaataattttggtatattagtcataatgtatatatttt

SEQ ID NO: 4077 - DNA, 324 bp, Homo sapiens
aaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctgg

SEQ ID NO: 4078 - DNA, 337 bp, Homo sapiens
aaatgagaatacagctttacttaaatgaaaatcccaatgtttcttttgggtgtagacctcattctttccttcatagaaagaactgtaaactcagtaaattcttaatctcttgtataataatcggatgagagccaagcattttcttaaagatcctctaaaaagaatggctttggaatgactagaaaacatttgtggagtgtgggagctatgcttgcattatttgcttaattcatgtgcttggatgttgtgctttcagtctattcaacaatatttaatcaattattaaattttcttagagacatacacttaaatgaagcattttaattgagtatttttt

SEQ ID NO: 4079 - DNA, 267 bp, Homo sapiens
ctgggctggcgccttagctgtctgctgcactgcggccaccgtgaaggcctgtttcagggtcatcataatttcatcaaccagagcctcatttgtgcactgaaacacgtaacagacaaaatgaaagccgccacctccggaagactcccgacagataaacccaaagtggtccacgtgtctgatgccctgagagcaaaaggatatctccttaaaatttttctccaatgctattttttggtgtcaggactgatgaggtaaacttcagactgg

SEQ ID NO: 4080 - DNA, 268 bp, Homo sapiens
  misc_feature (1)...(268): n = g, a, c or t
aaagcttcttgttttaattaaaaacaagcacatattaacagccacatgtgaatgccaaatgattaaaacaaaaaaacaaaaacaagagccatctacactgcagctagggaaagcaaacttcttggcttaagagaagtgagggatgtgtgtacgtgtgtgtgtgtgtgtgtgtgtgtgtgtgtgtgtgtgtgtgtttcanaaaagccactccagtctgggaaaataaaagcacagaccatttctaatgactggttttgtttcnccagna

SEQ ID NO: 4081 - DNA, 568 bp, Homo sapiens
aaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaaggtaaagctgatggaaagttcttaggttctaacttgacattgtttatattcctagggccttaaaattgacaagccttttctagtgttctggagataaatgtatttttatgtgtaactgtaatttttatattttactttttgtgttagagagttctaaactagaaatcaagagaccacagttctaatctcagccctgccactgggcagcaaagcctaatgtgggcttagtcttcagatctggaccccatggtctctcaggtgctttccagcattacca

SEQ ID NO: 4082 - DNA, 410 bp, Homo sapiens
cctgctccattccaccctctgggggaggcgcccaatccccttgcgaccggtcatgaggtcttcccagctcaggactccagggcacctcccctcgggcctggtcaggaagcagcacctgagggtggatgttctcagaggatacagacggaacaccttccaggttctcaaatttctcttctcctgttgtctcagtctcccaagctctctctgcatatcctccacaagggtcaccgcttcttcgccgctctccggatgcagctcctgcaccctgctctggatctcctggggcaggatggtcaggaactgctctaacaccagcagctccaagatctgctccttcgtgcgcatctcaggccgaagccacccatggcaaagctcttggagccggctgagggcttcccggggaccag

SEQ ID NO: 4083 - DNA, 262 bp, Homo sapiens
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattactggtcagagagtaaattcttgataaaagctgttgacttggctctcac

SEQ ID NO: 4084 - DNA, 546 bp, Homo sapiens
ccatacctaggactagcccgatctgtgtgtcagccactgacccattttaccagtgaggaaattgaggctcagagaggttaagtgacttgcctgtggtcacacagggaacaagggcagagccagaatgtcaacggaggagtgtacaccctttcaactacgctctgtgcgcaatgtttaaccggagcctcgtgtattcatttgtaagtcacagaaaataattatatttacagggggaatctaaagatttcaggggacaacctgtagactgactctcatttagcaggggcccaataagcgattatgcccatccacttgagcttgtactgacgtaactactctcctcatgactaccactcaaagaatatacaaaggacctctcattttcccagaaataacctctctatatgaacaggcacagccaatgtggaatggccttatgtctactgagcacatcacatgcacagctcttcatttcatccccacactaatcatgtaatacaggcatgactgtccctatctgacagaggaggaaacagggtagagttt

SEQ ID NO: 4085 - DNA, 525 bp, Homo sapiens
ccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattgg

SEQ ID NO: 4086 - DNA, 318 bp, Homo sapiens
tgttcctaaaataaaccatttattgaaaaaagaacctttttcttaaatttcagtaatcagccttttgcattacaaacctgcagcttgccaacaacaacaaaaaaggtaaaggtttcacagtcagtgcactcaacaaacaggagattaaaaacaaggtatgggacgcctgataacactacaacttcttttgaacctagaaaggtcaaaacactacgctgatgtcacggttctcagtcgcgcgagacacggaggagacagaggcgatggtccgtgtacagtagtaatggcacttaacatgcagcttctttaacctcgtgg

SEQ ID NO: 4087 - DNA, 542 bp, Homo sapiens
aaactccaaattcctttatcgaagcagctatctgctaatattactgaatggcaagtctttggaaatgatagttaaccgaaaatgcagaaagaatcatagcaactaatgataatgacgggtaaaggatagaaaataaaatttttagccacaggttgtggttacagcatccaggccatcaccgacatctcggcagggctatgccgccacttcgtattaaacgtctactcctccgagaatgcccttattaaattaagtgcaaagtaaggcatcccaccccagacagagggatccacattctttaatcatgatgcgggccactgtaacagggagatggatgcaggacgcagacggggtggggcgcccaagcgacgcacttagacggtgatctgttggttttctctgaaaaatgatctctggtgtgaggcacaaatatctggaaacatccggaagacctggtctggcggcggctcctcgggggcctgcatcacagagccggctccacagctcttcccagcctcttctgccagttgccggacatacag

SEQ ID NO: 4088 - DNA, 549 bp, Homo sapiens
  misc_feature (1)...(549): n = g, a, c or t
ctggcagctcacattttacattagagagtggggtccccacattttacattacagagcggggtccctgagctgcaggaggagagcctgcagggctcttgggtagaattgcacttttgcaataagggaaacgggagcaatgtttcagcctcagtttctatttataatactgacacaaaaagaatattgctggatacatagcatggatctagatagagcagctccaggagttctcacggtgacagcccccctcactcacagacaccatgtgatactaatagggcttagacacaaagcactgaattcccaaagcattgaagagaaagacagctctcagtctgagtaaaaccgtattgagagaagaaaagaggttgaaagaatcttaaagacaaattcagattacatgtaacattggtcaaattgaccagaaaatattcttccaaagaagttcttctctaaacaccaaaagtgcacagctactctcagcatgagaaatacaagtattatgaganagagggcttattctgagcagaatttccatctctgctgctc

SEQ ID NO: 4089 - DNA, 275 bp, Homo sapiens
ccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccag

SEQ ID NO: 4090 - DNA, 248 bp, Homo sapiens
caccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaagg

SEQ ID NO: 4091 - DNA, 555 bp, Homo sapiens
ccagcagtggggcaagacaggtattttagatagggcagcaagggaagacctcgtgactttggagtgaaaatgtgaaagaagcaaaggaattagtcatgggggtgtctgcagagagagcatttgggggagagaaaaccacaaacgcaaatatgtcagaagtgagcctggcattttcaaggggcagcaggaggccacgtggctggagctgatgcccaacagggagagaactaggaggctggtcctggcgtcctcggtcctagttgatcacacagccttgtcagtcatgatggactcctcatgaaaaggagggcaacttctctgaagctcttataacaacttctcatcaaaggcatctctcacacaagcaatgcgctgccctactttgctattctggaccttgtcatcacatcataagcaggcgatccattatccgtacttactaggctctactggagttccacagccggcacagaaaaaattctgggctgccaccacaaggtccctcctgaatacgaaaaataatactagttacatttcagagaaggccaatggcac

SEQ ID NO: 4092 - DNA, 539 bp, Homo sapiens
aaatgtgagaatttcaagcagtaaaattactcaaaagtctactggatttaacttacaagttcttcagtggtaatctgttcaaaagaattattttagagttgttaggtatacttttgatgtggttgatatttctggtatccaagaagaaatctcccaagatcctacctaactttttgtaactaaagcagcatacatacacagggagtgggaaaatgtctagactggtgagtacacatgccaacatttttccagaattttctgcctccctatacggcttgagtaaggggtttagagattttagactatacttgggaatttgtctatttcttttgcagttctgtcaatttttgtatcatgtattttgaagcatttatgttattatgtacataaatatttaggactgttatgttttcttgattaattgaaccctttgtcactataaaatgacattgtatattgctggtaatatttttgctatgaaatgtactttggtattaatacaaccactcttcctcagccttcttttgtcaagtgttagt

SEQ ID NO: 4093 - DNA, 598 bp, Homo sapiens
  misc_feature (1)...(598): n = g, a, c or t
ggaggccacatgctcctcaaagctgttgatgcgaggctttttggtgggttcggggctggctagcggggtgacactattgcgtctcatgagcgggttaggtcccttctttgcatcctctgacctctcccggtatgtgcagacggactccacgttcaggtagatggattccacacggcagccataagcgacaggcgtcagtttcaggacggtgtgaagagggcatttcaggtagggcatctcctctgcactcttatccaggaagtaggcaagcaggcagcgcaggacggcctggtggcagatgaccagcacattctcctgccgctccagctccatgatcactggctccaagcgctggaccaggtcctggtaggactccccggtggggtagcggtaatagtacttgtcctgctcccgcagcgcatactcctcagggtaggtgtccctgatctcctcgtaggtcagctcctcacagacgcccgcgtcgatctcattgagcgccttccactgctcgtagggcagccgcagcgcctcggcccgtctggatggngctcttcagccatcaccatgtcacccacaccagcagcgggnaagtctgttc

SEQ ID NO: 4094 - DNA, 241 bp, Homo sapiens
ctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccagg

SEQ ID NO: 4095 - DNA, 458 bp, Homo sapiens
aaaaatcagcggccgggcgcagtggctcacgcctgtaatcccagcactttgggaggccgaggcaggcggatcacaaggtcaggagatcaagactatcctggctaacacggtaaaaccctgtctctactaaaaatacaaaaaaattagccaggcatggtggcaagcgcctgtagtcccagctactctggaggctgaggcaggagaatggcgtgaacccaggaggcagagcttgcagtgagccgagatcacgccactgcacttgagcctgggcgacacagcgagactccatctcaaaacaaaacaaaacaaaattagctgagcatggtggtgtgtgcctgtagtcccagctactatggaggttgaggtgggaggatcgcttgagcccatgaggcccaggttacagtgagccaagatcgtgccactgcacttcagcctgggtgacagaaagagaccttctc

SEQ ID NO: 4096 - DNA, 332 bp, Homo sapiens
aaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttcttt

SEQ ID NO: 4097 - DNA, 434 bp, Homo sapiens
aaatttttgaagggtacccatcaacaagccaaatattcgccggttcctttgctttccctttcatccatattttgatcctggataaggtctctacgtgtgcgctctttggaggtagctacaactgaagactgcaatgctggctttttaacatcatcatcctccgggtcgctttcctggcgtgattctcttctggtccgacgctccccgcccagcctactgactgccccttcaaggtctctctgtttggctgggggtcctcctccactatctgagaatccacgcctcagtaataaactaccacgtcctctacctccaccaggaccagaaagggccagcaatctggcttggatgggcctcacgtcattcggatcccgcccggtgagcttgcgaatgttctcatccacgttcttaagactctctttggccttttccag

SEQ ID NO: 4098 - DNA, 373 bp, Homo sapiens
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcctcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacag

SEQ ID NO: 4099 - DNA, 573 bp, Homo sapiens
  misc_feature (1)...(573): n = g, a, c or t
ctgcacccctggtttcagctcttctaactgtgaaagccccatccaaggctaacattcgagaggcacagggctgccaagggtttcttctgcccacttagtccccagtggctcaggctccttccttggaagttccctggggtaggtgaggcagaggcagatctccgaggaacttgactgactgagcaacgaagaccctctctgagttttcctcccaaggtcttagggtggcttggcagtccccaccccctcacactgtctcagggtctctaccctcaacaagattagattccttttagccagaaagagtagtgagaggctgccaattgggtacacctggggctttcagggctggagtgcccagagcctcctgaggtcagagttcagaggttaaggtatgtcaggggatggaaaaggagcagatgaccccatttgacctttaccagcgaggtctgagggtcctgccttcaagtgcagagcccccaacacattcagatggggctggacagacacaaagctacagggttcccctgaggggcagangctggnaagggccgccctcccactcagccctca

SEQ ID NO: 4100 - DNA, 424 bp, Homo sapiens
aaagtaccttctggtgaaggcaaacccaacaagcttctacagaaatttagtataaaaagtttagtgtgatgaaaactatattaccaactggaatgaagtacaataaactactaacaaacatactaacttgctacatatactaactaaaataaattagaattgtcaagttaataccactacccaaaataccagagatccaatatgtgcctatccataatgaagagttctttaattgtttagctccataccttccactaggcacaaatatcaaaggtcattccgcaaagccgtccatgcatcagtatcacatttgtgcaaaggcagatttatcagataaattctttgcaacttctgagggcttcaattaagtaacttaaaactatgaacttaccaactatgtagtaatttaatcaaagaatgtttt

SEQ ID NO: 4101 - DNA, 255 bp, Homo sapiens
cctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcag

SEQ ID NO: 4102 - DNA, 572 bp, Homo sapiens
cctcgagctcccttcagcgaggcaccttacgcatggaataggaggtttcacccacctgaaaccttctaaatacaatatcaatggtgaaaaaccaaaaacaagagagaaaataaaaacaagatcattagtaaaagttcaacaaagcaattgaaattctttggatgtctattacatatgggaatgaggacagtctcaagtctgtaatatgggaaacatgcagaagggagagggttaatcagggctattgcatacagcagggatttttgctggaagaaaggctcttcattttctacaaagacaacttaattttgcttccatctactaggaatatgctggcttgaattttcaaatgcactgattacaaaagaaatacattgcatttcactcaagagtattttcttgtttactaagttctcacaaaaaaacagaataacatttttcaaactaggtgtctccagagctctgaaataaagaagtcagcaacctaaggcaggcgcaatgtctcagcctaaaccgatctctaaagctgcagtgaagtgcaattcatgttagctgtccgcttggtggggtga

SEQ ID NO: 4103 - DNA, 548 bp, Homo sapiens
cctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacag

SEQ ID NO: 4104 - DNA, 261 bp, Homo sapiens
ctgtggactccacctggggccccaatacaagagcacccgtcaccccggcctgggttttttcagggccccttgggacacagggctcaccatggagtgctgtaggtccaggctatggagctggcagcaggctttggctagcatgaccagagcgtcagcagtcacaccgtggcagccggagagcttgaggaaagtgagccgaggacagcactcacctaccagacctgcccgggcggcgctcgagccctatagtgagtcgtatta

SEQ ID NO: 4105 - DNA, 353 bp, Homo sapiens
ctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccattt

SEQ ID NO: 4106 - DNA, 368 bp, Homo sapiens
ctgccggcgggtaacggtgaaaatggaccggagaaggcttcgcccaaagacatgagtggtttcgtagcgggggaggctatcacagctctggggcacgtggcagtaacagagccatctggtgtaattgaccttgtaggtagccacgtcctcagcctgagacctctgccgaaactgggcaggtgtctcaagcttccagtagttaaggcagagcaagaacatctttgagagctcgaacatcgtctgccgctcccggggagccaggtgactaaacttgtactgcacaaagttcagcacaccctgctcaatattaggtttctcaaatggagggctgcccagggacccctccaccacaggccgggtcatctgca

SEQ ID NO: 4107 - DNA, 373 bp, Homo sapiens
ccaacatggtgaaaccctgtctccagtaaaaatacaaaaaatagctgggtgtggtggtgcatgcctataatcccagctactcaggaggctgaggcaggagaattgcttgaactcgggaagcagaggttgcagtgagccaagattgtgccactggactccagcctgggcgacagggcgagactctgtctcaaaaaaaaaaaaagggaaaagaaaatgtagatttccattgtccaaagtgacagcgggaggatgggtcttgagtttctcaggttggagaagcagctccacgaaggtcctgagcttgggtccactgtacatgggacagctccaaaagaggaaggtcccagcactgcatctagtagtgaggcatcag

SEQ ID NO: 4108 - DNA, 247 bp, Homo sapiens
ccagtgactttatgtctggacctcagtttattcatgtgaaaaatggacatgataacaatagtcattagatggtagggttttgatttgggggctggaagagatgctgtgtatagtgtatgggcctaaagtaggcactccatgcatgagaactagcatcactgttcattaatttttaatttattttaggatggtctagtctatgcagtcgagttctcccaccgctctggccgtgacctcattaacttgg

SEQ ID NO: 4109 - DNA, 305 bp, Homo sapiens
atgatctggatagagaagatgaagttagattactcaaatatctctttactctaatccgtgctggaatgacagaagaggcacaacgactctgtaaacgccgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcag

SEQ ID NO: 4110 - DNA, 332 bp, Homo sapiens
aaagaactaatttgtaaattatgacacaaaattttattaacaaggaaatatccattaattgactactacagtaaaaactttataatgcttgtatcatgaagaaagaccttccttttccttatatattaattgaactacataggcttgctgtacattttgttattcatgttataagaattctagattccattgcttttgaaatatgtttctttttaggaactaaaagtcaacttatagtttgatttctgttttatttgtactgtgtttctgattttgtgggtttctaaataaaaagatcaaacccaccactttcaatatactgttttctattt

SEQ ID NO: 4111 - DNA, 423 bp, Homo sapiens
  misc_feature (1)...(423): n = g, a, c or t
aaaaaagtanttgcngggtttgtnaagattctttccactttttgncnnattaaatattttataaagtcatatgacatatacatatgatgacttttctgcctttctgcacagttagaaagtcattcangaaagacaatgataccacaaaacaacactcagagaatgcacattccacagcactgacatgtntcatctatggtcctggtctacaacatccgccgnggnctaaacacacactatggctgttattaaacaaaacatcccatttctacttacttnaatcagaaggaggatgaagctgctgctaacatttcgataacatatctgattctatcaagtgaaactacactgaatttaatgggggtactggctgacagatcaaacttaagttntagacagtctngtctaaaataatagaggttt

SEQ ID NO: 4112 - DNA, 318 bp, Homo sapiens
aaaacaatccttaactagctagcaggacatttactttggattctgcataactgcaaactgacatatttgtaaagctaaaaatcagttttaatacatgattaacagaaactctcatcatgctcattactttaactattgccctttcaatcgctatagaaatatcacttaatccaataagcttgatttcaatagtccaggaagaaaaggtcaaaaaggcacaatgtgaccttagctgacaagaataaccatcctgtctcaagtcttttgtcagtccctggcatgaattacaacattattttcaaaataataaaacatttt

SEQ ID NO: 4113 - DNA, 533 bp, Homo sapiens
ccatcaatttgtcctccatccatgtgcttcagcgccttctcggcttcatctggattctcaaactctacgtacgcatagcctttggacagatggggatgcatcctttccacgggcatgtcaatcattttaattttcccataggtggaaaatatctccatgatgtgatcctttgtcacattccgggtgagtctcccaatgtgcactttggtgggcttaggagatgggctccgccttttcctctccttttcatctcttttaggtggtttggatttggagcgggagcgcctcctgttgtcgtgtctgcgccgagaaggacttggagagccagaagagctgctagagctggagctgcgggaggtgctggagcttcctgagcggctggatgctgaggaagagctggagccactgcttgagccagtgctggtgctggagcctgagctggaagtcgagctggaccgagacctggtactactgctaccactggaagcgctgcgcctctttcgggttttgtcccggccgcgatccttctcact

SEQ ID NO: 4114 - DNA, 133 bp, Homo sapiens
  misc_feature (1)...(323): n = g, a, c or t
gcctncaccttctcanaactgcntagggcgtgagctttgntggtgatgtgacctccanaacanactgtgagcngatttttttctttaatcctgagcctatgcttgctgctgnccttcttgactttcaactagg

SEQ ID NO: 4115 - DNA, 83 bp, Homo sapiens
  misc_feature (1)...(83): n = g, a, c or t
ttttttttttttttttttctggaaggttctcaggtctttatttgctctctcacattccangaattgactnntttnattaatcc

SEQ ID NO: 4116 - DNA, 452 bp, Homo sapiens
ctgagaattaactactgacagtatccagcacttctggaacacgcggtacagctctttggctaatagttctgcagaattgaagtctggctcataagtgacactgaaatgtaagagatgcaaatactggaaaactatattcatgaggagtatgttcagggtcttcctgaggttttcaactgttcttcccagcccccaaaactcagaagaggctgtcatatgagatgacgcatgaatcactcaccaggcatcttactcaacatggctcctgcatgttcaataaataaagcatcttttatttactgagggcgctaagacttagaggtgtggtgaaagagcactggctttagagtcagaagacctgcattcaagccctacttctacctcacagccttcgtgtcccgaagcacatcctatatatgagtctcaatttttatgtctataaaatgaggttt

SEQ ID NO: 4117 - DNA, 375 bp, Homo sapiens
cctaggtgatgtgactctcctgccttggccctgccttcaggaaaaattgtgatgtgactctgggtttattacctagatgatgtgactcttgtgttctgcatgggcaagcccaaaggggtcattgtggcatatctctgggcacatcaaagaagtggtgtaatttttctctcattccaggactctagtctcagtagggattgtgacatatcactgggcccataacctatgtaatgtgattctagtatcctgcttgggccctgcttacaggaaagattgtgacatttggctgggcccatcacctagttaatgcgactctccttttcttcctgtgccctgccctcagtggagattgtgacaaatttctgggccaatcag

SEQ ID NO: 4118 - DNA, 453 bp, Homo sapiens
ctggagtccttctacatccagacgtacccctgagcagaaggctctggtgattggtggagaggcttgtatgtggggagaatatgtggacaacacaaacctggtccccaggctctgagaggaagagagtgggattgctacccacattttaatgaaggtggagctgagccgtagaactctctgggagccatccaacctggctgtggctcataacaaggcccagagcaggggctgttgccggaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctgg

SEQ ID NO: 4119 - DNA, 285 bp, Homo sapiens
aaacatggctcacatcccttttagaaagttatggcagggaagcaagtagagagcaggtggtaaactgaggattggtgcctacattggtacctacagtgggtcctacagtcatttttgtgcggatcaggagatgaggtgaagagaaggaaagcttctcatttgcataatgccttgaaatgaccctaggtttctagcgggcaccgagaaaccagagatgccccttgttgtctgtctgggagatccaaggagacatctggcagtgttgagaagagatgaaggtgacag

SEQ ID NO: 4120 - DNA, 455 bp, Homo sapiens
  misc_feature (1)...(455): n = g, a, c or t
ttacttangatgnttgngatctgccgaccttgctatanatgccatgttaccaatgatttcctgtggtggnggcttgccattgtttactctcttatttaccaacttctggcctaagcatgacagtgggcaccttcccccagccctggctggncccagngcctgtgttctgtgttngaaaggntttatatatatataanatnacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgnattatatatatgtgnntactgattgaaatttttaacagatttgtacttttttta

SEQ ID NO: 4121 - DNA, 251 bp, Homo sapiens
gttcccgagaggctcctgaaggtggtgaagcgggtcttggtggcagtcaatgtgaagtctgtggctgaggcactgcaggacctgctctttgagcgggatgaagagtacctaatggactgtgactggcggtgggaccctgtgcacaccaaagggtccatagtccgtggcctctattatgaggaggtcagactaaaccgcctgctctgtttggaccctgtggactactttgctgaacctgagtgtgagtttgg

SEQ ID NO: 4122 - DNA, 432 bp, Homo sapiens
aaatattaattttctcttaatttcgtgtttccttgcacataatagcactgcccctaacttcagagatgctgattgcagttaaaaaatcaaaaagaaatgatgtgaatcagaaaataccatgttgtattgaaagcaaatcaaatagtgtaaacaccatcaccagaactctgtgcgaacaagctcccaagaggagggcagcttgtaacttacaaagactgttagagaactcagagcatcagagcataaagcatgtgggatccaaagagacacatttggaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcag

SEQ ID NO: 4123 - DNA, 218 bp, Homo sapiens
cctggagtcccgacagccggtctgccaggcacccgcctccgcttcctactgctgcttgcattccgccggctggctgggttccttctgtcaatgaaaaagacaaggcttgtagagagcaaagccagctccattcaccaattagctccaatcaacaatgaaagccaagactgaatgagttcattctcattgaaaaaaatggttactgcaaatatactttt

SEQ ID NO: 4124 - DNA, 295 bp, Homo sapiens
gtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtgg

SEQ ID NO: 4125 - DNA, 309 bp, Homo sapiens
  misc_feature (1)...(309): n = g, a, c or t
ctgttactcctcagggatttgggatgccccttgggggattcttgggaatgacccatcacaattcctcaatctgcacttttgtgcggagattcccttggtcacttttgaaatgaactcagatgtgtttggagatagctgtgccgtttttgccttctttccctcttgtagggaaaccttcgcttattcccccaagttgctggcaggtgtgctgaaaatttggcaatggactcaaggctganctanaagaggaatttctcatttttgtggttgacaattagggggtggaaaggcaaggcaaaccatctgcag

SEQ ID NO: 4126 - DNA, 321 bp, Homo sapiens
ctggaggtagcatttaacttgctgtcgaatcttctggaagcaatccacgataggaacagttggaatagtatgaatccgacttaatatatccagagctacattgaccagtccttgtttccgggcgatttttccatactggatgatcgctgaagctgatgcatgaaccccaagcatagcgttatttgaactgggatcatgctgagagctattctcataggcagttacaatcgcctggtaatgatgctgcctccacatgaagatgctgctccagtgggacaagtcgtcagacacgatgggcagtcggttcctccaggtcttcac

SEQ ID NO: 4127 - DNA, 577 bp, Homo sapiens
ggagcacggagatctcgccggctttacgttcacctcggtgtctgcagcaccctccgctccctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctg

SEQ ID NO: 4128 - DNA, 586 bp, Homo sapiens
ctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatcc

SEQ ID NO: 4129 - DNA, 452 bp, Homo sapiens
ctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtgg

SEQ ID NO: 4130 - DNA, 545 bp, Homo sapiens
ccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcagtaagttcttacggccatttcttaatctctgctctttcgttgagtgtgtggaagttgctacggggatgattttacgaactgaactctctctttctgatggattagtggagaaaacagaaaattctgagtagcactgtactgtacgcaacaaatgtcagggccctattgatttgtctgaggtgttagtgaagggtgttattttttcagatgttcagcccacaagagcttact

SEQ ID NO: 4131 - DNA, 580 bp, Homo sapiens
ctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgc

SEQ ID NO: 4132 - DNA, 483 bp, Homo sapiens
aaaaaatctggcttgttacaggcaaattcacttgccacaagctgtccagtctaatcgacaggattccgattcctgaacagtgtcattcgaatcagaatgtcagagctgagtctgctgttctgacttaaggaacaacttgactcagtctcttgatggctggagaatgcacatcctagctgtcactggggctacaggcaggtcagtgagcacgctaaaattttccttctcaattacacttcaaatagcaggcatattactcgtataagatgctatctgatgatactaacctttctgctggtaccctcccactgctcctaaagccacaccttaatatacattctggtgctgtgtactaatgtagttccactgtcaagtcttaacattcttcaaaccagtgtctggggttgatagactatttgtttgacatggcacaatgttttgaattgggtgggaatcttttcccccagttagaaaaacagattt

SEQ ID NO: 4133 - DNA, 409 bp, Homo sapiens
atggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgattttt

SEQ ID NO: 4134 - DNA, 231 bp, Homo sapiens
cctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagcttt

SEQ ID NO: 4135 - DNA, 541 bp, Homo sapiens
  misc_feature (1)...(541): n = g, a, c or t
ccagtacacccatgaatttgatggagatgaggagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgnggtctgcgccctggggttgtct

SEQ ID NO: 4136 - DNA, 395 bp, Homo sapiens
ccatcagtccccaatttccccgaggtaagataggacgacaaaatgggacaagatatttgaagtgaggtcagtccaatttggatatcatagaagaaaagaaataggatgtgctaggttaagcctgagatggtatctgggaagtcacattcatgatgtgaactgaaagaacacaggtgctacagtgcagaccaaaacccagcctgactcgacccaacagggtcaggtgtggatctgtgagtagtgctcactgagcccccacgagcagtgtctggcagggcaccgctgctccatagtgtgcttttagaacctgccagaggagctccagcaataggaccacgtgccccattcatcggaatcagggtcctatattcactgagttttccatctcaggacag

SEQ ID NO: 4137 - DNA, 292 bp, Homo sapiens; identical to SEQ ID NO: 29

SEQ ID NO: 4138 - DNA, 332 bp, Homo sapiens; identical to SEQ ID NO: 4096

SEQ ID NO: 4139 - DNA, 387 bp, Homo sapiens
ggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagatactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattctttt

SEQ ID NO: 4140 - DNA, 417 bp, Homo sapiens
ccagcacatagcgatataactgacgtaaatgctgccagtcttaccaaagactgttcccttttagccaccggagatgattttggtttcgttaagcttttttcatatcctgtcaagggacagcacgcaagattcaagaagtatgtggggcacagtgcacatgtcactaacgtgaggtggctgcacaatgactctgtgctgctcacggtgggcggcgctgacacagccctgatgatctggaccagggagtttgtggggacccaggagagcaagctggtggacagcgaggagtcagacaccgacgtggaagaggatggaggctatgacagcgatgttgctagagaaaaggccattgactacaccaccaagatttatgctgtgagcatcagggaaatggaaggcaccaagccacaccagcag

SEQ ID NO: 4141 - DNA, 481 bp, Homo sapiens
gtgtgcccatctccttgaggaagcccactctatttttggtagcatgacgggccactgagaggtggaaagggcacaagaaccatgagatctcctggaaatgcttccctgggaaggcaatttcatgaatgaggtcttccaagcaaatgacgccaaacttccccaggtgctcctcaatcactgtattgtctgtcagagggatggtcttattcttgaccttggcttgtccacgtttcaaaatgagttctcggacagacttcagatttggaaatccccaggtcacataaggttccactatacgcagcatttttagattctggggggtgacttttacaaagacaccactaaaaattttctttaggcgaagtcttgcaatggttctctgcaccagtaaactcacgccgtcaatcctcaggacttcagcacgtatgcctgaaaaatctcccaacactggtgaacgcctttcacatctttcaggtctcag

SEQ ID NO: 4142 - DNA, 503 bp, Homo sapiens
aaatggtctctacaacaaattgtcacttgttgggttcaattaagtgctcattgtataagtgcacatggtacaaatcaacaccagcttataggattgtggaaagaattaagagatgaatttagtgatcttatataccctgtcagttggtcatattgtggaagagctctacaaaacttactgtactgttaactccaagattttcttccaataacagggatgctagccagatatttaataatcaaagaccaaaaatggcagtttaatttttctacccaatatcctatggcatatgaatgatccaaatttgaagctccaaggataggaaaaagcttacttgtgcctgtcctagacaagtactagagtttatattgaaatcaaaacttctaaaaataaaaatcagtaagattaattttactcatttttctaacacgagtcagtatgcttgaagttttcattgtatttgatgtcatgtaaatttactgtaaaaaataagaaaaaatttt

SEQ ID NO: 4143 - DNA, 304 bp, Homo sapiens
  misc_feature (1)...(304): n = g, a, c or t
cctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtatnttccatccttnacatccttctgtctgttcaagaaccagtctgggatcttgtactggcgtggattctgcataatggtgatcacacgttccacctcatcctcagtgagttctcccgcc

SEQ ID NO: 4144 - DNA, 554 bp, Homo sapiens
  misc_feature (1)...(554): n = g, a, c or t
ccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggngtctgagggcatcatcttcctcatctga

SEQ ID NO: 4145 - DNA, 559 bp, Homo sapiens
  misc_feature (1)...(559): n = g, a, c or t
cctttatatgtaaataacaaaatagtgattttaattcatatagatgtatttgtttatctaagtatgcttttatactctctgctatatttttgtatcaattaagtgtgcctggcagcatgaagaaagtcagtacaacaatggtttctctctgttgtgtaaaactgaagttggaagtgggtaacccgacaatggcacagcagcttcacaagatcctgagggatcagcctcctcctttcgtgctgcctcactaccctcagtccttggcttctgcctcagagtctaagatggctactttagatccaggcaccaagccctcatcattacatcatctcattccaagaaaaaaaaagaagcaatgacaagtattccctctccctgtaaagacaccccctagaagtccaaagtaacatttctctttccattctttgttacgaatgagactggaaaatacagtgtgtatttgggaggctgtatgcctagctaaaaatcaggaggcttattactaactaagaaggaagaatgtgatactgaaggtcaactggcaggntttgccacagtg

SEQ ID NO: 4146 - DNA, 556 bp, Homo sapiens
  misc_feature (1)...(556): n = g, a, c or t
ccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggngtttcataggggcttttcgtttcctgt

SEQ ID NO: 4147 - DNA, 161 bp, Homo sapiens
  misc_feature (1)...(161): n = g, a, c or t
tgatggttactgagtcggcacctatgacagctaanagagctttcttaaagactgcctcagngtcttcttggcttttggcaccttcactccactctgcccangaaatncacaatggcagacnaacctggggntncangtgcacaaangcttcntcanaaagc

SEQ ID NO: 4148 - DNA, 440 bp, Homo sapiens
  misc_feature (1)...(440): n = g, a, c or t
cagtttccatgtatatnnngtctatattatgtttgttattgagaaataggcatttttgggaagaaagaatttggcattttggaaataatcagaaaattaaaaaatgcacacaccactttcccattcttctccccaccccaacccctacccctatcctcaaatgcttagctagtgaaatattaaaatgttgtaatagaaattggagtcaaggtctccttgctgaagagaccatctattttcagagactggaaggagagagaacaaaccaatcaagagtcattggtttgttgcctctattgttttatttctgacctgcgcaaatagcttttgaagtggagatatgctagttcttggcaactaatacttttctgggcatgcattttatgaaataataggtatgtatctgcctcattcttttaggctatgtgtttctctagttt

SEQ ID NO: 4149 - DNA, 174 bp, Homo sapiens
aaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttgg

SEQ ID NO: 4150 - DNA, 319 bp, Homo sapiens
cttccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacag

SEQ ID NO: 4151 - DNA, 544 bp, Homo sapiens
ccaaacagaaagcagctcctgaagccaagaaacagaaagtggaaggcacagaaccgactacggctttcaatctctttgttggaaacctaaactttaacaaatctgctcctgaattaaaaactggtatcagcgatgtttttgctaaaaatgatcttgctgttgtggatgtcagaattggtacgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggaga

SEQ ID NO: 4152 - DNA, 557 bp, Homo sapiens
ccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaataggtatgttcacaggcc

SEQ ID NO: 4153 - DNA, 430 bp, Homo sapiens
aaattatgaaaactaaggcttttgtgactgtttagcttcctgctttcttaagctacctgatgggttctgtatcctttcagactaggccatttaactgatttgtggcttgaaggaatttcacttccttgggtgctggtaccttattcacagcagatggtcatgcttagaaaaccctgcttcagggtcagtgactgaaaaaccaggggtgccatgccagtgcctttgtcagggctgttttctgcttaaccactttctcagaataatgcagaagaaacccagtccgctaccttttgagtgtgtgggaagataagtaagtgttcaggtgggaatggtagttgcctctcgcatcagggtttgcatggagaaggaagaggtgcacactcctgccacagagattcatgtctttgatgtggcaatgtctctgcgtggt

SEQ ID NO: 4154 - DNA, 437 bp, Homo sapiens
aaatgtgttctatcaaacacctaccttggcttcttccaagcgacccagggctttgagcaggttccccaggtcactgcgaacacagtacaaatcaggattgtactgaagagcagagacgtaagcttgtactgccccttccatgtcacccgctgctaccaaggcggctgccaggttaatatgaccatcgatgaaatcaggtttgagacgcaatgcatgtcgataatgctcaattgcctcctgcaactgccctctttccttgtacacattccccaaattcgaataagcttctgccagaagggggttctgtttaattgccagagtgctaaagtgagcagatctgtccagccttcgacactggaagtgtatagatgaaagtaataaaagcacaccagtattgtctggctcttgtctccagagctgcatgcagtgtctctcag

SEQ ID NO: 4155 - DNA, 147 bp, Homo sapiens
ctgacatattattatatctatgggatgaattaataagcatgtcagattaatatctactgtaacaattagatagtaaattttctttggatattagatataaatatctaagtagaagtaatttcaatatactagtaatgacaaattttt

SEQ ID NO: 4156 - DNA, 475 bp, Homo sapiens
  misc_feature (1)...(475): n = g, a, c or t
ctggtggttaacangtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgcgactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctt

SEQ ID NO: 4157 - DNA, 417 bp, Homo sapiens
  misc_feature (1)...(417): n = g, a, c or t
ccatcttcattgagaagncnaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatca

SEQ ID NO: 4158 - DNA, 353 bp, Homo sapiens; identical to SEQ ID NO: 327

SEQ ID NO: 4159 - DNA, 143 bp, Homo sapiens
  misc_feature (1)...(143): n = g, a, c or t
aaaattcgtttttgcaataatgacaaatgccctgcacctacccacatgcactcgtgtgagacaaggcccataggtatggccccccccttccccctcccantactagttaattntgantaattgnattgncagaaaagtgatta

SEQ ID NO: 4160 - DNA, 318 bp, Homo sapiens
cctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccagg

SEQ ID NO: 4161 - DNA, 397 bp, Homo sapiens
  misc_feature (1)...(397): n = g, a, c or t
ccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatnccaaatctattgcatcaactgcacgttggtacctactgagacacttatatgccaaanatgactatgagcttattgacgtgctggtaaacannntgccaaaactcatggagatacaagagcattggaactgaatcagagattgtcctcacaataacattggattattttatagtaaggaagcaaagaaaaagctgtaagaatgaagcaatgaatcaagacttctacccaaagcaacattttttt

SEQ ID NO: 4162 - DNA, 566 bp, Homo sapiens
ctgaatgagcacccagaggcatgaagataacctggagcctatttcctggcaatgcaaattgtggctgctgcataactacaaattgtgtatcaagaaactacatagtttcaaggcttaaaaattacccagatttgggggagtatgggtggtgagaaaaggctgaaaggaatggacagagcatgtagacaaaggaagggaaaggaaaaggagacagtttcctgatttcatagcaactcaaagataacatgacccaatgacaggaaaatggagaacgtataaaaagcatccaaatcccctaaacaagatgacttctcctagctagcaggaataatgctactctgaacatacatagttcacaggtaagggaactgacccttcctgaaagggcaaaggcagggtaaggaagaatgggaagagaagaatacaaatgttttttaagatggaattgaaagttgaatataataaaaagcccagtacatctcacctgcagaagagtctacaggcatgttcctaaaggcaaataggactttctatcatatgtatgagaactaaatcaaagcttaaaa

SEQ ID NO: 4163 - DNA, 212 bp, Homo sapiens
  misc_feature (1)...(212): n = g, a, c or t
ctgaaaagatctgtnttnaattctgcaaatctttattgagtgccaactatttgctgggcacaggctaggcactgattctgctggttctgagaaacataaatggtaccatagggaggtgtttcctcctaagtggcaggaggatgtttgctgggagttaagtgaaccaattcctcctctgcttacaccacgtgggggtaggtccagaactcagg

SEQ ID NO: 4164 - DNA, 370 bp, Homo sapiens
cagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaagccactctgggccagtgcggggtggaggccctgactaccctggaagtagcaggccgcatgcttggaggtaaagtccatggttccctggcccgtgctggaaaagtgagaggtcagactcctaaggtgg

SEQ ID NO: 4165 - DNA, 438 bp, Homo sapiens
ccacctaagcacacagctaagattacagaaccaggactcgataaattcgagcccaacaaactgaccaacccaggacagagcctagtcatcctgactccctcctccccaggccacacttctaaaggccagtttgctcaccgactctctgagtggtagtagggaggccacgagaggccggagcattaccagttggagccagatggcgaagagttgggcgaggcccagactggcgtatagcacttggcattccttggaagcctggtgaagagaaaaattgcacatcattgagaagtgatgtggaccagaacctaggctgtgcctcagagtggggaagaaggaaaggcaggggagaccaggacaggtatatcctgggctgtcaattactgttccccaccacctaccttgaggtctcccaccttgctgccagcgtggattagg

SEQ ID NO: 4166 - DNA, 461 bp, Homo sapiens
ccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccag

SEQ ID NO: 4167 - DNA, 521 bp, Homo sapiens
ccactgtccttgcaggtactatgcctggctttcgataatcttttgctcagaaactcatgctcaaaagagttcaggatctctgaggtaaggccaactttatgtgtgctggtgcagaaggctataagctcgcctaccattccctcctcattctgtccatactgaacacaaagctctaccaatttctcaattagagcctcctcgcagtctaggccgaagatctgcagctcctccgccagccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggc

SEQ ID NO: 4168 - DNA, 372 bp, Homo sapiens
aaacgtgggagtggggtggggcaggagaaatttccttaaaccagcgtttctgccaatagccacttcctggggaaccatctctacctggatggttgaggtttcaaaactagattccagcaaaatgaagacaaggcaaactatgaactggaaaaagtcagtagaccactcaccgccaagggttgagagtcttaatagaaaagtgtgcttagaagatgacaagcaggaaagcaggctaagcgtatgagtgggcgacctccagtgaagagatgcgaatggtcatccgcacagggaaaaaatatcagcctcacaattgctacatagagcatgtgggagcccatggattcggacagagctcccacacaaggcccaagg

SEQ ID NO: 4169 - DNA, 373 bp, Homo sapiens
  misc_feature (1)...(373): n = g, a, c or t
ccaccctgaccatcaacagggtcgaagccggcgatgaggccgactattactgtcaagtgtgggatcttaataatgaccatgtcgtcttcggcggaggaaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccnnacnctccaaacaaagcaacaacaagtacgcggccagcagctatctgagcctgacgcctgagcagtggaagtcccacagaagctacag

SEQ ID NO: 4170 - DNA, 247 bp, Homo sapiens
  misc_feature (1)...(247): n = g, a, c or t
ccagtaaacaaattctaaacctaactgcctattaaaagaggaactagattttcttaagagacagataaacccaattcctccaaggagtttgaggcatggtggtattgttgaggggtgaggagtgggaggaagttgcttttcacaacacctatggaatagttcacttataaatcantctcctgacgtatatggcggcatctcctaaggtgcctagtccctttggacccctgcattaaccactacttaa

SEQ ID NO: 4171 - DNA, 283 bp, Homo sapiens
aaacttgctaaacaattttcctctatcttaaatgctaaagtcaagttgcttttgacttaattcacacaagtttctggatgtataacatttgtccacctagtaattagtcttatacataaaatttcccttagctttaatttggctcctatcagtggggagttttggaattgaatcataactttacattatcgcccttccttcaaaataatgtcattaaccatatgaatgctgaagaactgcatatttgcagagcaattacttctgtgaaagagaaataattttt

SEQ ID NO: 4172 - DNA, 406 bp, Homo sapiens
gcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctactttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgattt

SEQ ID NO: 4173 - DNA, 547 bp, Homo sapiens
ctgcgtctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtgttgattttcacagctttgaggaacatgcataagaaatgtagctgaagtagagggggcgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgata

SEQ ID NO: 4174 - DNA, 355 bp, Homo sapiens
gtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaagggaagggcgagtaacaagccctggctgctgctgtgctagg

SEQ ID NO: 4175 - DNA, 319 bp, Homo sapiens
ctgaaggaagtttccgtggaagaaagaccacccgttagccgagcagctccccagcctgagaaactgcagaagaacaatatcaccaaaaaaaagaaactggttgaggagctggctctagaccacgtgtttggctacagaggtttcgactgtcgaaataacctgcattaccttaatgatggcgctgacatcatcttccacacagcagcggctggcatcgttcagaacctctccacagggagccagagcttctatctggagcacacagatgacatcctctgtctcacagtgaaccagcaccccaagtacagaaacgtggtgg

SEQ ID NO: 4176 - DNA, 443 bp, Homo sapiens
  misc_feature (1)...(443): n = g, a, c or t
ccaaatcttttgggagccccaatagagcttatacacatcaggttgtaaccaggtggtatcgggcccccgagttactatttggagctaggatgtatggtgtaggtgtggacatgtgggctgttggctgtatattancagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcancaggagacnacttactagatctcatacaaggcttattcttatttaatccatgtgctcgaattacggccacacaggcactgaaaatgaagtatttcagtaatcggccagggccaacacctggatgtcag

SEQ ID NO: 4177 - DNA, 173 bp, Homo sapiens
ccaggctagtctcgaacccttgacctcaagtgatccacctgccttggcctccctaagtgctgggattacaggcatgagccaccacacctgtccgacagtgtagcaactttctaaaactgaaaaatctcaaaggagatcattggaactgacttgttcatttattttttgttttt

SEQ ID NO: 4178 - DNA, 567 bp, Homo sapiens
ccacaagaaagacctacaaagaccacatgggaggaaaaagaaacatctgtaaagactgaatgcgtggcaggagtaacatctaataaaactgaagttttggaagaaggaacatctaagatgatcacatgtcctacaaaaaaacagctacaaaagcaagtacacatggtaagatgcttgagtgaactttgtagagtttattggcactttgggttccctagtggaaatagtgtggtatgggagtagtcgggaatggcttgaatgtctagataaggcaagcttgggcaacacattttaatagtgtagaaatgagtagatcttattctataggccctggaaaaattcccagaatacttctggctgtaaatattagatgaactaactaacaattgctaaaaccatagaaaccaaagtttttttggtggtacagggatattataggatctcactctgccccccacccccattattagttgtgctatcggcagtgttttgtccatgtctcctttcttggttggctaattagcaacagctccaatcatcatgctaactcaagacaatatctgaagg

SEQ ID NO: 4179 - DNA, 510 bp, Homo sapiens
aaatgtcccttcagttgtaagagacaattgtgtgaagagccagtgtcagaatcgtgtgtgtgctcacatgcgtgcaagttactctagcaggagggaatccaagaagccactgagacatcctcattctgtcccttctgtctaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgca

SEQ ID NO: 4180 - DNA, 509 bp, Homo sapiens
ctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgcgagtgttccctctggctttctgaaggacagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgt

SEQ ID NO: 4181 - DNA, 503 bp, Homo sapiens
ctgttcagactctagtaggcctcggtttgctgatctatgagcgatactggtttgtgtgtagccaaaaatccctacagaccagtggttgtcaggcgaggaaagttttataccccaggacatatttggcaacacctgagaacctttttgtttggcaccactcaggaagacgcgttactggcattgaggcaagggacagtgctgaacatcccacaatgtacaggacagcctcacagcaaagggtgacctggccccacatgtcagtagtgcagaggttaatccctgctctagagacaacacagggatcatgggacacaagtcactagccctggaccagccactgctcaagaggccacgtgcaatccacggcattcatctgtccctcttcctccactgttcagcacttgtcgtcaatctggaagctgctaagagcctgtctgtcactggcagagaaagagcagaccctgtgccggctgcaaaggccttgagttgcaggaaagtccagg

SEQ ID NO: 4182 - DNA, 526 bp, Homo sapiens
  misc_feature (1)...(526): n = g, a, c or t
gcggtgcgacgaaggagtaggtggtgggatctcaccgtgggtccgattagccttttctctgccttgcttgcttgagcttcggcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgngaagaaaggacaacagangactgtctaaaggatgcctggattccttggtatctcaggactctaaatactctaac

SEQ ID NO: 4183 - DNA, 384 bp, Homo sapiens
aaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattattt

SEQ ID NO: 4184 - DNA, 338 bp, Homo sapiens
ctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttcttt

SEQ ID NO: 4185 - DNA, 539 bp, Homo sapiens
  misc_feature (1)...(539): n = g, a, c or t
ctgatggagaatagctgaaaggtggaaagactttaccaaggaaggtctatataataggttaccacctaagaaatgaaacaactttctgaaagcccgggaaggagatgctctcctgagctcctcatgctccacaaggaggtcaaaatcaccaccctctttcagccactattttaagtttgaaataaacagcaagcttcctgccaccttgagtcttcctttgatgtgcactccctgcaagcaggtaagcagaggtcatctagattaaataggcacagaactcagatttactttctggacctcagcctctttattttaagtagaaataataatacaatatctaccttagagagttctagtgtgtattgtgctagcatagtgcctgacataaagtagggttcaaaattagaagatattttctgctttctttttctgaccatcatcttccttaatatcaaagccgtgccaccaaaatagtgccaccacagacaaggtaatctctagggtataaagtggggtgatctanagagagtaagcgagcc

SEQ ID NO: 4186 - DNA, 261 bp, Homo sapiens
aaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagtttt

SEQ ID NO: 4187 - DNA, 514 bp, Homo sapiens
aaagcagtaagtcttaggtatacttacagtatgtctgtaagtcttatatactcagagaactccagccctgcctccttctagctgtgtgaccttgggcaagtgtctcaaattctctgtgcctcgaattatctgtgtctcaaattatctactctgtgagataaggagaataccacctaactcccaggcatgttgggaggattaaagctttcttacatgctctactgcatgaacagggcccagaagggcatctgtgttaggccccatccaagtgtttctgatctggttgacccccagacccccactgagaagcaccacagtgtgctatcaggtacctgtctaaaccagggcagaggaacgagcacacccctaaccacagccatcaaagggagcggcgactgaaggcaagaagtcatcttctagagactgtatattgtgcactaagtaatacttgtgcactaatgagtaatacacggtcctgggctgtcctgggtacacgcaggcacccagtacacgg

SEQ ID NO: 4188 - DNA, 232 bp, Homo sapiens
aaaaacaaaccttgaaatcagtttctcaagttaaaattctgatggatgtcacaaatagtaaggtcttccttactgagctctgtcatctgttttggcttttatgcatactgtgatttgggaggctgctgctcaacattctagcccatttccagagtgttccattattctaggacatggctgtcatgggagtctgcacaaggcaactaatgctctagatttaactgcctttttt

SEQ ID NO: 4189 - DNA, 457 bp, Homo sapiens
aaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttacttttt

SEQ ID NO: 4190 - DNA, 285 bp, Homo sapiens
cctgggatgcagggagaaaggctgaccacaagttgagacaagatacagaaacaaacaaaaacagcagaaagtccgatcgatggtgtaagtgttgtgttcactgcttagggtgcaggtgagcttgatcgaggctcccagtaaggcagatgtagacgggggctgagtcagcacaggcagagcacagagacctgtggagaaaatgaagggcagtaggtagaaggagacccaggccatggttggagggacttccaagagctctattcgagactgcccagtggaacctgg

SEQ ID NO: 4191 - DNA, 294 bp, Homo sapiens
  misc_feature (1)...(294): n = g, a, c or t
ctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccanccgccgaggaggccctcaatgncttctattactgcacctatgagggggctgtagacctggaccatgtgacanatgagcgggaacggaaggctctggagggcattatcagcaactttgggcagactccctgtcag

SEQ ID NO: 4192 - DNA, 478 bp, Homo sapiens
  misc_feature (1)...(478): n = g, a, c or t
tgacaggaaaagcagcaatgacaagattacttaagtcttgtgaaataacacttctcttccttgacctgctgcttcccttttttaccacacacacacgcacacataccacagccctttgagactgaaagcagctctattgagaatagtagtgtcaactgtattatgtanaaattctaaagtttttgggattatttcatagccctgaccttgctacttctctccactttatgtggcaggtttaatctcaggtctccctcatacacttctcagcctcagcacctaaccctcacacaacactccagtattgatgcagtcaatcttgtataacattttttgaatgtccaatgtgcaaagcacgatgttggaaattatacagaggtgaataagacaaaaactcttgctctcaaagatgtcagtctttttctntgcaangataacacatntagagtaaaatncataaaggggacttaattttacc

SEQ ID NO: 4193 - DNA, 147 bp, Homo sapiens
  misc_feature (1)...(147): n = g, a, c or t
gcacgttggaaccgaacagagctctgttgttgcaatgttcancccacaagagcttactggtgaaggaatgggacaagacccatctttatgcaaagccagcgttncagtaatgttccagcatctnataatctatcctggggaattcag

SEQ ID NO: 4194 - DNA, 505 bp, Homo sapiens
aaaaggggtagctcactaaaaatacagcttagcgtaaaaagaaaaaaagacttcagggcaagaggatcctattatctttatgaaaacactgtgcagaaaagtccacagccacttaccctagagtaaagccagctcattaagcagccagcttcctacgctgagaggctctgcctcatcagtcagcccaggcgggaagacttcatgaatgctctgggatggacaccaagctactggaaggggaaatggttttccaagtgtccctgtatgttgctagcagaatggggagaggtctaattcctaatcacatttaccacttaggcccaatggcctggtctgatgagtgagacatctagtgaaatcgatcacagtctgacgcacacactgacaatcatatggaatcatttgaaatgggatctatcacaccatggtccttaatcgttccagtctattgccgcaggaagacacccgccagctcctgctctgggtggggtcaggctggtgagca

SEQ ID NO: 4195 - DNA, 375 bp, Homo sapiens
  misc_feature (1)...(375): n = g, a, c or t
ccattcccccagccttctccatgacgtaggccatggggttgcattcgtacagcagtctcagctttccattggggctcttcttgttagcggggtacagaaatatccctccgtagaccagagtgcgatgaacatcagccaccatggagcccacataccgggtcccataaggagctgaattatctggggggaacttcttcctctggatgtactcagtgacggcagggtcaaagtccttggtgtagccctcgttaaggctgtagattttacctttcttttttatcttcacatccttgtccaccaaaatgaactccccgatggcctttttagacaaggaaggaaaggtggagagatgacnagcgcactgggtcccccagg

SEQ ID NO: 4196 - DNA, 225 bp, Homo sapiens
ccagcagctcgctgatgtcctgcaggcggctcatgttggggaacttctcctggagcagcttcttcatcccgcgactcgcgcccacaggaacaactttgatgctatagtggcggaagtccagctcctgggagtcggggttgtagtcgatgaggaggcagcgcttgatggtgttcaggttcaccttgtgtacgttgatggaggggaacaggttctggaacatggtgg

SEQ ID NO: 4197 - DNA, 248 bp, Homo sapiens
ccatcttctctttcagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcgatttgtcctgccacctagaaaaagttcacatgtggacagtgagcagccaaggtctcttcagagggaccccaggccag

SEQ ID NO: 4198 - DNA, 516 bp, Homo sapiens
  misc_feature (1)...(516): n = g, a, c or t
aaaggcaaatctttactccttaaagaaaaaatacaaactgtggtatttttaagagatcgttatattttacataatataaacaaaatcactaatgcatctatatgcttggtttccttaaactacaatgaaccacagaatgggtgaaaatgcatttactttttggtggcaaataaacatactggaaaaaacacgtaacacatagcatgcctttttttccttactgtctacacacaggaactgacataaccaagttttaatagccgccacctcctcttccctgtccaaagtagccagttccataggcccccctaccacctcctcgctggaatcccccagatcctctgtagcctccactaggccctctgtagtctcctccagagttgcctctaaagccacctcgggaaactcctctatagcctccaccaacacctgcaccatatcctgcccgaaaggagttggcgctgccaccatagcctccgntaccatagcctccactgntatagccaccgccatagc

SEQ ID NO: 4199 - DNA, 362 bp, Homo sapiens
  misc_feature (1)...(362): n = g, a, c or t
aaatgtgctgcattttatnacataaaagtagttagtaaaaagatatactactaattttaatttaattttaactaaaataaaagatattttcactagaatgcagaatattcctctgaacacttccctcatacatcattcaatattataaattaaacacaaagagcctctccacttagatttttatcatgcatcctacattgtaatgtctttactcttccatagaaaaggtaaaaaatattgcccacctaacaaaaaagaatgtctcatatctttgatgaagcagcaattgatcacatgctttcacatgtgaatagaatgaaaagcatgaagtaatttgagttgaattacatcattcacttttt

SEQ ID NO: 4200 - DNA, 345 bp, Homo sapiens
aaatataatttaagaacccctccaagcaccggcgtccgtttctgggttccaccaccaactaccgcccttttcactacctcaccccacaccccttcataggacacagcttgggggtcccaggcggggtccggggatgtgggatgaccaaggcactgttctggaaacagacatgatgatgggcccctgtttcaacttgggcaaaggaggccatagtgaaacaggttccctccaacacaaagttatgacaaggacggtagaaaaacaaaacgaagaaacaaaaagggaacggggagaaaaattaagaccaaaaacaaaactcaaaaaccttcaatatgaaggcagcag

SEQ ID NO: 4201 - DNA, 495 bp, Homo sapiens
ctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggtgaaggcgcgggcagctccctgagtggtggggctcctctgggtgccacctcttgctgggccaagtctgcagaccagggactcatgagctcgtctccgcaggagcatgcggcgatgctgagtttcatcaaataggacgcagcagaagttgggaagcactgcagaagatgggttgtcttccagaaagaccactgttttggggaacagctcggctctttcttcggccgctggtggttg

SEQ ID NO: 4202 - DNA, 455 bp, Homo sapiens
ccaacagtgccacctgttgatgacgaagagatgctacacttgagtcctcagccaccacagccccagaggtaatgattgtgacctgaaagacaaaaggaggtcttccattccacctgcagtatactctccctccccacaatccaaataaacatccctccaattaaggtgctgggaacaacccagaagagaatggataaaaccgtatgggtcagattaattagcctgaggctcagagctaagtaaggctgggtttcctcccaacttagagcccaatttaatttagggattttgaatcacagaaggacagagctgtaaaaaattccaaagatattttaatcccctcacttgaaaatggacagaagtccatggaaaagtgatttgcctaaggttgcacaacaaatcagggttgaattgagatttagaaagtgtctcttgacctccattcaactgctttt

SEQ ID NO: 4203 - DNA, 465 bp, Homo sapiens
aaaaaacaaaaaattaaaaattacccaaattccttattagaaaaagagacaattacctggttctacttaggatctgtgtatgttctaagtctttctctcctttagaaaaaaagagataatctgattctattttggatctgtgtacattctaagtctttctctcatttagagaaaaacattctcaagtctatagaagaggaaaaaaaattaagattaggaccaacatttcaagctgccttttggaaagaaaattaaaaacagaggtagatggttaattattagtggccaagttactcaggtgactaattttttcttggtacacattcaccaaaattttatacttgaagccaaatagtaaataactttaggagtagagagtaatacctagcagaagttattttctttatgtcaaagaaaagtaatagaagcaaaccaggcttacgacccctgttaaggagatgattg

SEQ ID NO: 4204 - DNA, 396 bp, Homo sapiens
  misc_feature (1)...(396): n = g, a, c or t
ggcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcanacagagtgg

SEQ ID NO: 4205 - DNA, 79 bp, Homo sapiens
ggatcacttgaggtcgggagttcaagaccagcctggtcaatatggtgaagcctcatctctactgaaaaaacaaaaattt

SEQ ID NO: 4206 - DNA, 162 bp, Homo sapiens
  misc_feature (1)...(162): n = g, a, c or t
cttttttttttttttttttnnnttttttgatgtataaanaggtttaattgactcacaattttgcaggctttataggaaacatggcgctnacgtntgttcaccctntcgggaaacctgaggaaggttaaaatgatggtgggaggtgaagggcatgtcacatgg

SEQ ID NO: 4207 - DNA, 523 bp, Homo sapiens
  misc_feature (1)...(523): n = g, a, c or t
aaaaatgtagagtttattcatggagcatgccattgaggtttggatggtggcaggtaaaacagaaaggcaagatgtcatctgacattaggctacttataaataaatgtttatctagcttttatttcatgccctaatgaataaaacatgcttggaaaaagaaagtaacaagaagtagtggtatcatactttgtgggtttttttgggtttttttttttttttttttttttttganacggagtctcgctctgtcacctaggctggagtgcagtggcatgatattggctccctgcaacctccacctcccaggttcaagcaattntcctgctgagcagctgggactacaggngcgcgccactacacccagctagtttttgtatctttagtagagacagagtttcaccatattggctaggttggtctcgaactcctgacctcaggtgacccacccaccttggcctcccaaaatgctgggattacaggcatgagccaccgtgcctggcccatacttntataaattattatc

SEQ ID NO: 4208 - DNA, 420 bp, Homo sapiens
ctgtagcctctgcaagtgaaaatccaggccgacttgcagtcattggactgatgtccaagtgcaatcaccatacagcagctacaggcagggctggctgatagggagtatgggagaaggacacgctcagatgaaaacatgcatgcaacgattttcaccactgaacacactgttttctgtgatagaaactgtcggccctgctgggggacaagatattcacggcctcactagccagtgtgatgccaccagggcagcctgcccctgatgctcctttgttacctgctaaagaaggaccataaggtaaaaggcaccttaccttatggagtgagcccagaccccagggaaaagcttgggtagaacaatccaaggggcagcctgggtgtgagaatccagcccaagctagctgctctagaagcctggagg

SEQ ID NO: 4209 - DNA, 266 bp, Homo sapiens
ccttttgatttgctgtctaattctttagcatctcctcctgctggacttccatttttctgttgtgctacaagtgcattcaaaataatttttgttgccccagaccttggcagagtaacatttgtaagaaatggcaagttatttttcttggcaaatgcctgacttgtttctcgcctcttcctgaggaagcccccttctggaaacaaaacaatccattttcgatctctgctcctgtaattattttctaagtgcttcttgagaagcagcag

SEQ ID NO: 4210 - DNA, 552 bp, Homo sapiens
  misc_feature (1)...(552): n = g, a, c or t
ctggaccagagtgagaagtctgggtggggagggaggctgggaactgtcattgccctcaaacctccagtttgcagaggtctgtggggagctagacatttcttaaggaggtgagtgaagttaggattgcatttggtggaactgagggagattccaattccaactgaagctagaaggaagggcagacagtattcctgaacatgtgggaaatatcaagcttgaacctgttagttgaaggtaatactttagttgctactggtgcaaggtctgccagaggctggaggtggagatggaggcatgagagcagagttgagggtaacactatgggagccagccctgactcttaggctgccctggcctccagcatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttnctgcgcccactcacccaggccccctccgagggagctcgtgat

SEQ ID NO: 4211 - DNA, 278 bp, Homo sapiens
aaaaacatctattgcacatctaccatgtaggaggaatgtgctcacactggagaacagaaaaaagttttcaatcttcattacctgcccatgaggggcttagtctagctgggaaggaaagaaagaaccaatcaaaaggagtttagtgccacaggagcacagcaaggagagaccaaactgcccaggattcaaggaggatcatccagagatctgtcagggggtttcctctaggtccccttcgtttgtctagaaggccacacaaataaagaaattagattttt

SEQ ID NO: 4212 - DNA, 497 bp, Homo sapiens
ccaggcgagcagggccagcaccaacagcgaaaagtcttggtgacagtgtgtgccctcgatactatgtgacaggaatggctctttacctcctgaacacccatatatacctcagtctaataatgaggaaaaaaaatcttaattcaggggtagaacaaaagacctgaccagcagccaaaactgtcaaggtcaacaaaacaaagtctaagaaaccatcccagcaggcagagcctagagcagcaactaaacgtaatgtggtgctctggacagatcctgggacagacaagggacgtcaggtaaaaattagagaaatccgaataaaatgtgggctttagttaatgaaatatatcaatactggtttattaattgtgacaaatgtcccataccagtgtgagatgctaataataggggaaacagtgtggagtgtatgggaactccagatactgtcttcacaatgttttttgtaaatctaaaactattctaaaataaaagatttgttt

SEQ ID NO: 4213 - DNA, 365 bp, Homo sapiens
aaatctgacttccaagtggcacccctgccgacggtcaaaacgccccctctcctggtgtgtgccctccatccccgcttcctgggggcagccggtttcttgctgtctggacaacagagctctgccaatgccacttatctcgcccgtccaggactttatcaccaactgtcctacttccgactccagcaaaggagcgacagcgagcacgtctgtgcttggctgtgactaacagggcctctgaataaagtgaaaataatcccactttaagctgcaagaggaaagacccacagaaggaaagtccttcacggacggagacccaggatcctgaaatgcagtgcgtcccttcaacgttctgagaataaaaattt

SEQ ID NO: 4214 - DNA, 524 bp, Homo sapiens
aaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattctaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgt

SEQ ID NO: 4215 - DNA, 318 bp, Homo sapiens
  misc_feature (1)...(318): n = g, a, c or t
ttttttttttttttttttttttttngntggaaaccaacattttattgagcactcctgctcctngnaatctattccagtanattcttcnccgngggcatcacatatcacacaggggtgtgaccagcactccccctgctacctgccgtgngggcaggggcaggagtnaatggctnttcctgggcacaggccacagttaaccggngacaattgcaganccataggaattcatnttttaaaaaaaacnaaaactggaataaaaaaaaaacaaaaancctgagtataaaacctcagcagngtnccancactatctnggggttt

SEQ ID NO: 4216 - DNA, 599 bp, Homo sapiens
cctactatcagaaccaaccaatcaaaatgtccacttaactaagcagtgagcttaaaactgaaacttaaaactgtccatttaagtaagcagtgagcgtaaaactgatttacatcctagtgtaacctcattatcttgtgcagacaaacagtttacaaagtgtcaggccaggaccgcattttgagtagcaccggtacagaggaagagctcaatgatgagattctagatgagtacttcccaagctatctgtggtgaaaggccaatttttatttctaaaagaggtctacactgtgtaaataggataaaaatgaattataagaaaaataaaactaaaatataaaacaagtcctaaatttttatttttagcttcagacaaaattactccaattacaataaaagtttctgcttactcccaaataagcagacattctttagttataggaccagaatgagtctatgaactgactttcagtagcaatgttctgggcagtatcctgacgaagtatatgcttaaaattaaggtcaaacagcaaggttacagaagcttagtcctatgagaaattaacaatggaggcatataatatactagttaaccaactgag

SEQ ID NO: 4217 - DNA, 79 bp, Homo sapiens; identical to SEQ ID NO: 4205

SEQ ID NO: 4218 - DNA, 541 bp, Homo sapiens
  misc_feature (1)...(541): n = g, a, c or t
ccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaagactttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatanccatggggaggagtgc

SEQ ID NO: 4219 - DNA, 527 bp, Homo sapiens
  misc_feature (1)...(527): n = g, a, c or t
aaagatacaaaaaatcttgnatttttttttgtgtgtgtttacaagtagtaaatttattttcagaaagccagatttcttatatttgcataggcaatgaccagaaattcactcaataaatagtaagacaatgtaaactttatagaaaaaaaaaaaactcactcctctgaggcagagcccaaccttaggggtagagaggagtactgtaaataaatgttttaggagggaaataattccactcaactttcaacatttcaagtcttaaatccattggcagcatgtatagcaagtgggctaaaaagccagcctccaccaacagtccagcccacactacacatttcctttcgccaataaataccccagcctatgcttttagtaagaatcagcataggtaagcgcatgcttcaatgaaaaatagtcacaagcaaagagaataaaaccttttgtgacaatttcttgaaagctatgcttattaatactatgcagaatatttatatacagcaagaaaaagtttgttgcatttcaacttt

SEQ ID NO: 4220 - DNA, 511 bp, Homo sapiens
aaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacag

SEQ ID NO: 4221 - DNA, 458 bp, Homo sapiens
ctgctggataaggatgcctgaactttaatcatctttagcagaactttagctaataggtatcaagtgatcatcacttcttttcctcctccgacagcagatgcaggacaggaaggctgaggactctttctgatactcttctttgctactgcattccttcaggaattcctgcaaatccgtttcaggaaacccattctgttggaatttctttagaaagtacacaatgttgttaccttatttataaggcatgagaaattgctcttttgtcaacaaaccaagcccacctttgctaaaataaaactctcccacattgctagctcagatccaagaactgatatttacaatgatgaatcaatctgtcagtcccagaacaccaaggcagggccactgtgggaacagagaacaatccaaagaaaaacttcagaaagaaagcagagaagagccagggagaggtttttttt

SEQ ID NO: 4222 - DNA, 561 bp, Homo sapiens
  misc_feature (1)...(561): n = g, a, c or t
ccttccctgaccattctctctaatggactgcatccatcattctcagtctaacacatacctcattttcttcatagaactcttcaatatctgaggtgttccaagtatttacttttgtgttatctcccctatcaaaatgaaatcactatacgagcagatacttttttcattgttactatgcacaacacctagaacagtgtctggagcatgtgttacacatatttgctaattgttagaattaacaaacgaattcagtgtgttctaaccagaaactgtaaactccccattttaatatgtagtctcatccatccttctttaccttttaccagggcttggtgtgtactttctaggctggtgaatgagggcctcaacaaggagtacagaaggagaattggaagtgaagttgcacaagccagnggntctatctattctatgatttttccccttgntctcagtataacagaaagttgcctttctgcccactctagctttttttggtcgaagggcangggtatgggtggcaggggtttggagaaagaggggagtcctcatcattttggcaat

SEQ ID NO: 4223 - DNA, 302 bp, Homo sapiens
aaaatgaaaagtgatcaaaagcaggtacattacaccctataccatattatgtatgggaatacatttcatatttctcaattatgatttgccaattttaccttctacattgagcccttctatggtccatgctcatcggctcaccaatggcatacactcaaaggattcctctttatgggtaactatctcaggacctgattttatgagctatgatttggtgcttgcagcatcttcagcactgtgtgtgaaaatgaaggcagtatttttgaatatttttctttgttgcagagataagcaggagtttt

SEQ ID NO: 4224 - DNA, 452 bp, Homo sapiens
  misc_feature (1)...(452): n = g, a, c or t
ctgtgctccattgaanngacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctntgnantttccataactatgataattnnanacactttgcnaaaaaacttgatcctcgaagagaaggtggtgatcaaaggcattcctttggaccattggactatgaaagtctccaacaagaacttgcttt

SEQ ID NO: 4225 - DNA, 387 bp, Homo sapiens
aaagcattagctatgcttcatctgcatgctactatattttagaatctcatttttaggaattactatataaattgattacatattcttttgaagaacctcagtaataggaaatctatggcctctgagagtggatttactttttgataacagtcaaatcctatgactattgtgtaaaggtgaaggacccagctaggcaattctgcttggggttaaaataataataaatgtacctgaaaataaggaggttgacttcttatacagcagctacacaccagctcctcaaacacgcctacctcaggacctttgagcttaatgctctcactttgtggaatctttttatagcatgttctttttcactgatatgagttacaggtcacttaaaaaagg

SEQ ID NO: 4226 - DNA, 233 bp, Homo sapiens
aaattgtttcatatcaaaaaggtcaacatcttcacctggtcctttactcatctgaaaaacatcccaaactttctggtgctgatgaaattgcatataaatgatgtctaacagggcagcatcactgatacttgcacgcttttcctcacacagatggatcaagtgctgaactacagattcctttctctgtcggaaatttacagtctgcagttgattttcagacaaaaaatcccagg

SEQ ID NO: 4227 - DNA, 510 bp, Homo sapiens
cctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtgggagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtg

SEQ ID NO: 4228 - DNA, 438 bp, Homo sapiens
  misc_feature (1)...(438): n = g, a, c or t
ctacaatccnncactaacnntccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcanagctttttagatgaggaatttcctcactatgattccctgtcctgcgcagatgcaattcaacaacctcttcaagaaaaattgaagcantgttgccacaaactatatggtggtcaagaagcannaatacatcnanacacccctgaccttgaaacatacgtgctggnacacacctntgctggatg

SEQ ID NO: 4229 - DNA, 427 bp, Homo sapiens
cctgcattgaggccaagcacgtgagggtgccccccacccacatgtgggtctgtgtgtgtgcgcgtggcgtgagagcatccccgccttgtgttgggtctgtgccccatggaggagggaggtggggtgtctcccccaagcacagcactcaactcttcacaggacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgagg

SEQ ID NO: 4230 - DNA, 476 bp, Homo sapiens
ctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccact

SEQ ID NO: 4231 - DNA, 258 bp, Homo sapiens
cctgggatgcagggagaaaggctgaccacaagttgagacaagatacagaaacaaacaaaaacagcagaaagtccgatcgatggtgtaagtgttgtgttcactgcttagggtgcaggtgagcttgatcgaggctcccagtaaggcagatgtagacgggggctgagtcagcacaggcagagcacagagacctgtggagaaaatgaagggcagtaggtagaaggagacccaggccatggttggagggacttccaagagctc

SEQ ID NO: 4232 - DNA, 254 bp, Homo sapiens
  misc_feature (1)...(254): n = g, a, c or t
aaagtattggtgtttggagggaggcttataggaggaaagttggcttttagaagatcacatcaaggtaagcaactagttctatattctttttttgctgttgcttangaaaattttaattttccttttcttctgtagaaagtaaaatatgaattctggatattttgttacaagattatcctagtttttagagagctcaataatactaacacctcatgtatttcangctgcttcaggtctaattcaaccataaattt

SEQ ID NO: 4233 - DNA, 497 bp, Homo sapiens
ctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtc

SEQ ID NO: 4234 - DNA, 366 bp, Homo sapiens
aaaggccgagaactggaaacagcctttcctccattttctgtgtattggtgatgggagtgataaccttttgggggagctttctaaatctcacagaagaggaaagtggcctgctctggcaggtatgtgcaagatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcattggctgtgggtgtgaaaaacctttcctagcttagagcatttgtatctacaatacatttt

SEQ ID NO: 4235 - DNA, 456 bp, Homo sapiens
cctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcactccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttagg

SEQ ID NO: 4236 - DNA, 408 bp, Homo sapiens
  misc_feature (1)...(408): n = g, a, c or t
ccagaggggccgtaanactggtacaagtttacaccataagaggcgacgtggtcagccacaatgtcttcacctccacaggggctcatcacggtggtcagggcaagggtccccagcatcagagctttgtttaggatcatcctcttcccaaggcagtcttagcagttgctgttctgagttgtagagcaattgtgaggacctcgagacaaggcaatctgaagacacccaaaccaaaccctgccaagtcaggttttggctaattagaaaaatcccctatgatgacacctcagttactagttgaagagtttgtattaagagccctggaaggagacagggcaatccccttgttgtgatgcagcctccactcagagtggacttgaggaaaatgttctagggatctctgctggtggt

SEQ ID NO: 4237 - DNA, 558 bp, Homo sapiens
aaaacataattcttgaaaggtatatgtacaggtatatatgaactcaaagcatgagaaatacaaagtatcaaataaaataaaaagagacagagagagtgatatttaccctccctaagtagaaaagtataaagctgtacctacctgataggaaataaccaacaaagagaggttttgccctccaaatggtatcatgttggggctctgtagcttttctttgcctttttttttgtcaaaaataatggaatggagaggctggaaaattgagaagagcagaaagagaaaattctcgtaggtctattgaaaagaaagttgaataaggagtgatttcaagagctaaggctcacacagcaagcagctaagagggactgcaaaggcttttgacaccaaggtggcctcaggtgaagagcaagtcccatatggatcccactgtcactggagtctctgcatacagtttcggttggaataaactgggaaagaaaaatgttagggatgcatagggaaagtgctaagaggaagaaaggagtgaggaaagctcaggctggctgtccaggcagacct

SEQ ID NO: 4238 - DNA, 370 bp, Homo sapiens
  misc_feature (1)...(370): n = g, a, c or t
aaactatgaaggttgagaacacctgaagttttagtgttgaaatgaancatanacatactgcnaagttaattcaacatatcatttatttgaaacattattgtggtgttcatggtgattanaccatattgttaaacaatctanatgcnttttnatagttaaattgagcatttctgcnnaaatagaaagtcaaatgcctnatgtcttcacttataagtgggagctaaataatgtgtncacattganananattgtggagnaatanactntggagactcngaaaggtngnagggtgggattgagagatgagaaattgcctaatggctacnatgtacactatttgggtgangcttacgctaaaagcccaaacttc

SEQ ID NO: 4239 - DNA, 301 bp, Homo sapiens
  misc_feature (1)...(301): n = g, a, c or t
ctggggatggtccccaaggttctggggaagcagctagaactggtgactctggagatgaggctgaaggtggccccaatgtttccgggaaatgagactgcttctggggtttgggattactaanagtancctttactgactcaggagatacaggggcaggtttctgtggttctgganaaggaacaggggcaagtttctgagactcacaaacagggactgattttgggggttcaggagaagaaacagaggcaggttttgaaggctcanganaaggaagaggtgtctgtagctcangagaaacaac

SEQ ID NO: 4240 - DNA, 367 bp, Homo sapiens
aaatggagctaagtccaagaaagtacttgaagctctcttccagcgagcttaattgcgtaatccctgttgtcctccagggtaagctgacacgtctacataactggttttccacaggcatcttcagttattgcttgtcgggtggactgttttggatttaaccatgtaatccatgggaccaattgagagtcagctacttttataggcatcaaagtattctcagacacctttaatatctttatgaaaacttaatttttggccttttatcaatatgtcataacagcattctgaagtcagacattgttaaattgagctattaaactaatgagttttatgtaagttatatggtcttaatttggtacttgtaaat

SEQ ID NO: 4241 - DNA, 373 bp, Homo sapiens
tttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtactttgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggt

SEQ ID NO: 4242 - DNA, 206 bp, Homo sapiens
aaatccagcagccaagtggtttcaacagactttctacttgaggtgaaaataataacactacaaacatatggcagagcttcgtacaagcatttcactcacagaggagtttatggtttcgaggatgtaggaaaagattttccaagtgtgaaaactaaatatatacaaaagcaatacattttgttattagttaaataaaatgtgtcttt

SEQ ID NO: 4243 - DNA, 368 bp, Homo sapiens
  misc_feature (1)...(368): n = g, a, c or t
ccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcancgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggccctt

SEQ ID NO: 4244 - DNA, 190 bp, Homo sapiens
  misc_feature (1)...(190): n = g, a, c or t
cctctattcaaaggcaananactctgggaaatgtaatcttcctctactggaaaaggaaaatgacactgtatgttctatancattnacttattataaggnnagncattganaacaatgaggttgnttngatanatcaaaaagaatnagaaatnccgctgggcgtggtggctcacgcctgtaatcgcaaaac

SEQ ID NO: 4245 - DNA, 373 bp, Homo sapiens
gcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaatt

SEQ ID NO: 4246 - DNA, 375 bp, Homo sapiens
aaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacat

SEQ ID NO: 4247 - DNA, 340 bp, Homo sapiens
  misc_feature (1)...(340): n = g, a, c or t
ctgccccaaccactttgagggccttttccgntacaagagtatccctgtggaggacaaccagatggtggagatcagngcctggttccaggaggccataggcttcattggtaagggggcacctctgcccagaaatcccgaggggctncagaggagaggactgggggcacctgtctcctgggctgtgcacattccgtctgacaccactcccccatctcccttgcagactgggtgaagaacagcggaggccgggtgctggtgcactgccaggcgggtatctcgcgctctgccaccatctgtctggcatacctcatgcanagncgccgngtgcggctggacgagg

SEQ ID NO: 4248 - DNA, 178 bp, Homo sapiens
  misc_feature (1)...(178): n = g, a, c or t
aaaattaagtanaacaaaaaacccancgcacctgttagagtcgtcactctctattgtcatggggatcaattttcattaaacttgaagcagtcgtggctttggcagngttttggttcanacacctgttcacagaaaaagcatgatgggaaaatatttcctgacttgagtgttccttttt

SEQ ID NO: 4249 - DNA, 262 bp, Homo sapiens
ctggcttgcctgctggcctgcttcctggagataggatgctcagacccaccgctgctcttcaggggtcgtggaaggaattaatgcacttccttctgtcccccaatctccgtccctttacgtgtctctggagctgagcaggtattctttttctttcttcatctcagtagagcttttacttttatccagcatttcttagctcggttggcaaactggatatttatgcacctgcatttcacaatccatctccaccgattattcctgg

SEQ ID NO: 4250 - DNA, 176 bp, Homo sapiens
  misc_feature (1)...(176): n = g, a, c or t
aaatgggactgnaaatatgttttggtttntaagctatattancaaaatttatttttcaaaaatgcccactgngatgngaatgncanaatatattnttaagtgctttataactanttgtaaactttttttcanaagncttattttatacttgtgaaactgaacacaatnttgggaca

SEQ ID NO: 4251 - DNA, 373 bp, Homo sapiens
cctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagcattgtttgtgctccccaaacctaaagtgatctcctgtctagagcaaggggaagagccatgggttcaagtatccccggagtttagggatagtgccggaaaatctcctacagggttaaagctcaaaaacgacactgaaaat

SEQ ID NO: 4252 - DNA, 302 bp, Homo sapiens
aaaaacaattcaacacacgtactgaaagttgctggtatacagtggtgagcaaataatagcagaccttcaggagcttatattccaaggacagggatggacattgataggagaatcacacaaacaaaacgcaaagtcacatcaggaagttctgggcagcaccttgcagaggtggtggttggatggaccatctgtagggagtgaagcaggagttacctgagtgattcggggaggaggggcccttcacatgtgcaaaggcccagcgcaggaagtgacgggagaggaaggccggggccaaactgcct

SEQ ID NO: 4253 - DNA, 376 bp, Homo sapiens
ccaaaccagactcttctctggtttgttcttcagaccacgaggtggaaccatctcttcaaaggagccctgccaccatcaccaaagctcacaccagaaaaaaccgccatttacacaacaaactgaacctgaaaaaggaacggaacatggtgcttccgccgtgaacaaaatcagcaagtgaatccgttttcctttcccgggctgttcgaaaaagattcggctagagaaaagggggcactgtgggcagcccgtaggggatggcctggagctgtggggcccgggctgagccctccctgccttttaactgcaggatgtaaactctatggaaatgtatagaacttcagtttctcccaaccctccacaacctcaactcttgaga

SEQ ID NO: 4254 - DNA, 365 bp, Homo sapiens
  misc_feature (1)...(365): n = g, a, c or t
aaagaggttntttatacttttgtatttgaatagntatgtttcactgatgctgagccagtttgtgtgtgtgtgcatatatgtgaactgtaactgacaagatgaattactcagtttctctttctctaaagcttgtntgatgaanctggttggtcctttcagtgaacaaaaatatgaccccaaatctgtttgctctggcttttatttcttcangaagcanacttncacttaaatgccattttgtgattgtgtcaatcatacacattttatttacttcagagtttgaatagagagtacacatttnttctgcagatttatttcatgatgagtttgagttgcttagcagggcgtgtgggtcccgttgaagt

SEQ ID NO: 4255 - DNA, 376 bp, Homo sapiens
aaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgcaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttctttt

SEQ ID NO: 4256 - DNA, 373 bp, Homo sapiens
aaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagcc

SEQ ID NO: 4257 - DNA, 378 bp, Homo sapiens
  misc_feature (1)...(378): n = g, a, c or t
atatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcnaaatancaatgttaaggaaactcttatctcagtcatgcataaatatgcagtgatatggcagaagacaccagagcagatgcagagagccattttgtgaatggattggattatttaataacattaccttactgnggaggaaggattgtaaaaaaaaatgcctttgagacagtttcttagctttttaattgttgtttctttctagtggtctttgtaagagtgta

SEQ ID NO: 4258 - DNA, 372 bp, Homo sapiens
gatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcagga

SEQ ID NO: 4259 - DNA, 372 bp, Homo sapiens
  misc_feature (1)...(372): n = g, a, c or t
cttttaggctaagttacaaaattggggaagaggagctcataggtatattttcctaaaaaacagtanagagttgatagcaatttggcagccnaatctttggctattntttagatttcttcctgaagtccaggctccaagaacaagatgtntggagaagatccacttctttctatacccacatgtgcaacccctgggtctccctgttgggggctgtngggtcccttctcatcatgtttgtgatacagngggtgtataccctggttaacatgggtgttgntgccatngtgtatttctacattggccgggccagtccagggcttcaccttggatcancctccaacttcagctttttccggtggatgangnctctct

SEQ ID NO: 4260 - DNA, 376 bp, Homo sapiens
aaaaatgattacccaccaataacaaaattggcaaagtatatcttgaaatatagcttatgctcagacaaaaaaagtactactagcagacttacattaataagtcacagttttgaacagaaacatgtaaatactccaaggttcaaagtaccacatttagaaaatgttttgaattaaaaaagacaaaataagagtaccatggtttttaatactgatgaagcaaagtgtatccctcaacttcaaggtggcaacttgcttcgactgcttatttacagttagggtttttaggacaaaagtaaatttctagggtaaaaaagtcttcaaagagttgcttgcccaaattccatttggctagcaggcaataaggaaacagcaatga

SEQ ID NO: 4261 - DNA, 374 bp, Homo sapiens
aaaattagtcccctttatgcattttactctacatgtgttatccttgcaaagaaaaagactgacatctttgagagcaagagtttttgtcttattcacctctgtataatttccaacatcgtgctttgcacattggacattcaaaaaatgttatacaagattgactgcatcaatactggagtgttgtgtgagggttaggtgctgaggctgagaagtgtatgagggagacctgagattaaacctgccacataaagtggagagaagtagcaaggtcagggctatgaaataatcccaaaaactttagaatttctacataatacagttgacactactattctcaatagagctgctttcagtctcaaagggctgtggtatgt

SEQ ID NO: 4262 - DNA, 371 bp, Homo sapiens
ctgaaggtctgtgcgttctttctctattaggattatttcatccttcaacttggaaacaatcttcttgtcaggttttggtgcattttgaatagaatttagagcttgccttttatattcaagtttctcatttagttctcgcagtttgtttacagcaaaactggcttgttcattgatctgattggtaccatcatccacggcttcctcaccagcctcatctcttgggcccatctcatccttgttggaaatcatctgtgaggcatgtttttcttcctcttttatcaacaatttctcatacaggtcactgacaataaatgaagggtgatacctatcctttagggtctcataaacatcttcctggattttgtagaata

SEQ ID NO: 4263 - DNA, 370 bp, Homo sapiens
  misc_feature (1)...(370): n = g, a, c or t
ccaacatggcgaaacacctgtctctactaaaaatacaaaaattaggccgggcgcannggctcacacctgtaatcccaacactttgggaggccgacccagatgggtggatcacctgaggtcaggagtttgagaccagccttgacaacatggngaaaccccatntctggtagaaatataaaaaattaaccgggcatggtggtggacgcctgtagtcccagctacttgggaggctgaggcanaataatcgcttgaacccaggaggcagaggttgcagtaagccaagatcgtgcctctgcactccaacctgggtgatggagcaagactccatctccaaaaaaataaaaaatacaaaaattagccaggcatggta

SEQ ID NO: 4264 - DNA, 129 bp, Homo sapiens
  misc_feature (1)...(129): n = g, a, c or t
ctgtggatgaacaccgngaacctnanttattgctngatattaaagaagaaatngaagatnaanaaaagacaattgaagattatattgataaaaanatgaatgatgctgattccactncanttgaagcta

SEQ ID NO: 4265 - DNA, 375 bp, Homo sapiens
  misc_feature (1)...(375): n = g, a, c or t
ctggctcgatagtcgtaaatgaagagtgtgtccgaaaagactttgaatccagtatgaatgtagtacaggaaattaaatttaagtctaggatcagagggactgaagactgggctcctcctanatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcanagtcgtgcatncctgcccgaatcctgatgatgngggacttcaagaantactacntcagcaatttctccaaacaaacctgcc

SEQ ID NO: 4266 - DNA, 374 bp, Homo sapiens
tttgcttcttatgtctacaggaaaaagagacctgggcttagagtctgctgctgggaacggatgggatgtacatctctggctctcagagctggctcaccggcctcttccttttttcctccacatccagggcaagctggcctcattttttctgtctagggtggatgccttgagccctcagctccaacaggtaaagggcagggagggagagggagagcccggggatctgagcctggattgtctcttgctgctcctcctctagcttttctgtcctgccttcatatgcccatctgtgtccttcggcctcattgtcccatctcaggtttccctcagagctctctctgatctccatctcttttgggtgtcagtggggctgg

SEQ ID NO: 4267 - DNA, 374 bp, Homo sapiens
ctgggtctctgtccacccctctagggaggcaggactgagggaggctgggcgccccgtccctcctgcacttgctttccttcagtagggccctggcctcagcacaggtaacttcccccctcatttcagctcccagaggtctcttggttagtgcacttgaacccagccacccccaacccagaagctccaaaaagtgccaatgcctgggacccaccctgcagatactgttgtagttggtctgaggcacagcctggacttggggtttttttaaggttctgcatggggttctacctgctgctgtcacctggtctctgcagctctgttccaaagctgcagcctccaggaagccaccctgacttccccccacctaccttccc

SEQ ID NO: 4268 - DNA, 375 bp, Homo sapiens
  misc_feature (1)...(375): n = g, a, c or t
aaatttagattacatttgagtgtgtaatgtagttgagcaaagtcattacgtttataaaatgtggcacattactatgggatagatgtttaatgtataaagaaataatatactcctntaagagtanttaaaaggcattacccaagttacctgnactccanactgagtattacctcatcaatgagcattttagtttattttttcatactttgtaaagctgttttgctaatctagagaaaaggccatacatattttgatttctctattaactgatgtgattacttcaattaaagtaatgtttataaaccacagtcattctttatatctaagttcccttgacccttttatacttataatttctaaggcggataaaagaga

SEQ ID NO: 4269 - DNA, 373 bp, Homo sapiens
aaatattgttaaagaattctcaaaggagtaaggttaatgagcaagattaaaatggcagcagcagatccaattgcgttttctttttcataagcctaaaagcatcgcggtgtgtttcagagctgcttcctctacaaattctgcatccacattgtcatgtccttcaaaaggatacagggcttgattggaggactctatatctgtcagaatttcaatgaagtagttcagaggcagaaattctacactgaacgatgacttgttaatcatagaattccgaggctgtttcttatagttctgaagcagtcgcgtcacgtggttccgcgaaatgatgttagaactcataggatgatcccaaagtctacaaatcttctgccca

SEQ ID NO: 4270 - DNA, 376 bp, Homo sapiens
ccaggctggttttgaactcatgaccttaagcggtctgcctgccttagcctcccaaaatgctgggattacaggcatgagctactatgcctggcctggtttgattttagagatagacaggctctgtgttgccctggctacagtgcagtggctgttcacagctgtgatcatggcacaccgcagccccaaactcaaggtgggctcaagctgtcttcctatctcagccttcctggtagctaggaccacaggcacactccaccacacccagctagttctaggtgttttgagtaagttagacacttggtgagctttgtgtataaaagactcagtgacctgcttagattaaaactagggcagtggaatgaaaaattctcatggg

SEQ ID NO: 4271 - DNA, 324 bp, Homo sapiens
ccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgag

SEQ ID NO: 4272 - DNA, 372 bp, Homo sapiens
  misc_feature (1)...(372): n = g, a, c or t
tagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacnaagagtgactattgcctctttacccanaaatattggaaatgcaggaatggtggctgggatggaaaataatgatcgattcagtanaaggtcaagcagttggcgtattttggggtcaaagcagagtgaacaccgtcc

SEQ ID NO: 4273 - DNA, 359 bp, Homo sapiens
  misc_feature (1)...(359): n = g, a, c or t
ctgtccccggcctgcagctctgggatgaggacagggcgacagggacttccgacctcctctcatagaaaaacgtgggtgctgcaccacccaaagtgaaaggctgaatttggaagtcccttttatcatacacattcagattgcctgtggaaattcagcaaaaatatgacatgcatttccattctatctgccttttaccttctcaaccttaaatcgactttcagttctgtgtcatgttttctcttctttttagaagacttctaatgacttgggaaaatacttttgaaggatgtgaaatggtgtttttgngtctgctgnttgttgagtatcggtattttcagccttggttccctgtggaggag

SEQ ID NO: 4274 - DNA, 364 bp, Homo sapiens
  misc_feature (1)...(364): n = g, a, c or t
ccacccaagaatcatagtagctcttcagttagctatcttgcaatctctgatataattctactatgtgaatagagtgaattccaattcttcatcaaaaagtgctggtggaggttgtcaggtgtgttccagtatagattcccaatccaacggccggcagatgggagagcagcagagatggaaattctgctcagaataagccctctttctcataatacttgtatttctcatgctgagagtagctgtgcacttttggtgtttagagaagaacttctttggaagaatattttctggtcaatttgaccaatgttacatgtaatctgaatttgnctttaagattctttcaacctcttttcttctctcaata

SEQ ID NO: 4275 - DNA, 253 bp, Homo sapiens
cctgggatgcagggagaaaggctgaccacaagttgagacaagatacagaaacaaacaaaaacagcagaaagtccgatcgatggtgtaagtgttgtgttcactgcttagggtgcaggtgagcttgatcgaggctcccagtaaggcagatgtagacgggggctgagtcagcacaggcagagcacagagacctgtggagaaaatgaagggcagtaggtagaaggagacccaggccatggttggagggacttccaag

SEQ ID NO: 4276 - DNA, 375 bp, Homo sapiens
aaaatacatttatttaactcacctgagttaataagctctgaatttcatgaaaattcacaaatgtgaatggcgatcacttaccttcaaacagtcttgtctttcatacctggtcctatgtgtttccactcatccattgtttcagtggtgaacgttcagtggtgaacgctctactatccaggaactgaaccacaacttctcattcaaggagagtggaagaaactagatgcatacttgccctggacatcaggctgtccacctaagatccacatccacaaaatcaggaagtttcccacttctgtgttgccttctccaggagttggtcccatagggtgacactgcatccacagaagcatcaaaagcacctgtgtccctgcc

SEQ ID NO: 4277 - DNA, 308 bp, Homo sapiens
  misc_feature (1)...(308): n = g, a, c or t
gagatgcanaataatgttgacaatantaagttgctgaatcntcangctgcagactggtgatggntaaantgaattgtgtcccanatccactgccagtnaatcttantgagaccccttcttctaaactggaagtcgcataaattaggacattaggggctttgcctggnttntgttgatgccaggccaaccaccgatctatattctgagaggcccnacancttattgnaattgtatctncgacagatgcagacagggtggaaggagatngggtcatctggatgtcacatttggcacctgggagccagagc

SEQ ID NO: 4278 - DNA, 105 bp, Homo sapiens
aaacaaagaggtgacctaaatattttacattttgtaaatcctttggtacaggagataagtgggcacaagtgaggaatgatgtttgtacagcagtgatagtaatgg

SEQ ID NO: 4279 - DNA, 299 bp, Homo sapiens
  misc_feature (1)...(299): n = g, a, c or t
ctgtgagatggagaactgcagcctctgccgctgtggcagtgagaccgtgcgagcctcatccactctgcttttcacactctcctaccctgatggtagcaaaagtggtatacccttcagctcagttgggaaggctccccaaaatgtcctgtaatatcagggagagggtgctggggactaactgtgggtagaggggagaaccaggagtatagcatctaattttccctcanataaaactgggaagaactatgactttgctcaggtgctgaagcgaagcatctgcctggaccagaatacacagg

SEQ ID NO: 4280 - DNA, 337 bp, Homo sapiens
  misc_feature (1)...(337): n = g, a, c or t
ctcttcttcagcacatgccaaagctgttcctcacggcctgtgagacaagagcatcttggatgtaggacaatggaagagttanatgccttattggaggaactggaacgctccacccttcaggacagngatgaatattccaacccagctcctcctcccctggatcagcattccanaaaggagactaaccttgatgagacttcggagatcctttctattcaggataacacaagtcccttgccggcgcanctcgtgtatactatcaatatccaggagctcaatgtctacagtgaagcccaagagccaaaggaatcaccaccaccttctaaaacgtcagcag

SEQ ID NO: 4281 - DNA, 356 bp, Homo sapiens
aaacagcaaaagaccaagaaataaaatttgagtcaattatttttcaaaatattctcaatgcacattatccttaattcccttattatagtgaaacatacaaatacagaaaaataccccatttaacaaatactagtgttaaatggttatttggcttaaaatctgagttaagaaaatcctttttagcaacctacatacagataagtagcaaactttattatattaaacaaattcattctgctaaaacatgtaaagaatttcatccatcatgtattctgatcccagtacaagtgtttattctcttaccgtcacgattcttatatgaaggaccaactcaaagagttgtcctagatataacc

SEQ ID NO: 4282 - DNA, 349 bp, Homo sapiens
  misc_feature (1)...(349): n = g, a, c or t
ccagggggaggaagcagtgcagaagtctcataagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcanaagctctaaagcaggcaaatcgngtttctggaagccgggagccaagg

SEQ ID NO: 4283 - DNA, 328 bp, Homo sapiens
  misc_feature (1)...(328): n = g, a, c or t
ccaggactgcgatttctagcgcgtgtcttcacattctatctctggggaagcaagacaaacaggctctacccatttccctncttttgtctccacaagccancacctaanatcctntgaatttgttcccatccaatcctgcaaacttncaanaagggcagtagataacttttcaaaagaaaaagaaattgcataaggtccctacataatactgaggctgaaacnagaaggggctgtccantgtaaaagcaaggcacttggggcagganccaggcaggtggcctgancagggtccctctcagtgagtcaacagtttgaggcgcgtaaacca

SEQ ID NO: 4284 - DNA, 371 bp, Homo sapiens
aaataacatgttaaatttgatgaattgatgacaaattgttttttggtaaactggtctttcagttgcttgtgcttgggtaagctgccctgcttctcctggtgagtggggtttatagtgaagacgccaggctacccagtggcactgaaagaggtggcaaaaccaattgtttctctcttctcactgcctgggccctgttgctggtgaattcaagttgcctggagactgtctcactggggatctggtgttttcctacaataaaacttctcactccagggtcctctcccatccgaggcatgcgtctagcatatctctaacagtctgtgcatttgtgatttatgcgatttcaaccaaaccttaaggctcttgggcag

SEQ ID NO: 4285 - DNA, 368 bp, Homo sapiens
  misc_feature (1)...(368): n = g, a, c or t
ctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcanagacgggggactggagggagacttttatacgttttgtacctttgtaaccagagagatgcttatgttatttttcagcttttctgtntcttggggggtttgaggctgggctgggagggggagggagatngaggganagatgcanttngaccccntttgggtcctgagcaaancctatgctnatatctctctccttcctggggtggactc

SEQ ID NO: 4286 - DNA, 363 bp, Homo sapiens
  misc_feature (1)...(363): n = g, a, c or t
gagcanagatcgtgccnctgcactccancctgggcnacngagcgagactccgtctcaaaanaaananaaaaaaagagnncaagaccagcctgaacaacatggtgaaaccctgtctctactaaaaatacaaaaattanccaggcgcggnggcncgcgcttataatcccagctactcaggaggctgaggcagganaattgcttgaacccaggaggcaaaggttgcagtgagttgagatcgcaccactgncctccagcttgggcgacagancgagactncatctaaaaaaaaaaaaaaaatacngaaattanctgcctgtagtcccaactactcaggaggctgaggcagganaatcacttgaaccc

SEQ ID NO: 4287 - DNA, 372 bp, Homo sapiens
  misc_feature (1)...(372): n = g, a, c or t
aaagatatnagcctgtntgactacaaaggaaaatatgttgtgttcttcttttaccctcttgacttcacctttgtgtgccccacggagatcanctgctttcagngatagggcanaanaatttaagaaactcaactgccaagtgattggtgcttctgtggattctcacttctgtcatctancatgggtcaatacacctaanaaacaaggaggactgggacccatgaacattcctttggtatcanacccgaagcgcaccattgctcaggattatggggtcttaaaggctgatgaaggcatctcgttcangggcctttttatcattgatgataagggtnttcttcggcagatcactgtaaatgacctccctgttgg

SEQ ID NO: 4288 - DNA, 140 bp, Homo sapiens
  misc_feature (1)...(140): n = g, a, c or t
ctacatctgananaagcatnttatagttctgcttntggaccagaccatcctgggtttttctctgttctgctgaagggttccctccacgtgtccatcacctcggngaactcttgggagacctgggaagatgctggcctcac

SEQ ID NO: 4289 - DNA, 370 bp, Homo sapiens
cctcttccctgatggccgcgtcttcatggaagtaggagagaagactgtaaaaagcgaaaggcagcagcctggtgtgctgatccggggccacacggaggaggagccgccccagcctgaggtcactctctgtcaactgaaagagtgccagccaggatatcttcctcttctctaaacactcgaggattgctgcacaaacgtggaaagcctttggcaggtctgtggtgctatttgaggtcagatgtgacgacagcaggcccatcaaggagaagaagaaaaggaaaaccaatagctcctctctctcgcagtccagcttctttagctgcttcctgatgttttcttccctgacttgttgaatcgcaaagtgcagtgc

SEQ ID NO: 4290 - DNA, 375 bp, Homo sapiens
aaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgag

SEQ ID NO: 4291 - DNA, 364 bp, Homo sapiens
aaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcagg

SEQ ID NO: 4292 - DNA, 375 bp, Homo sapiens
  misc_feature (1)...(375): n = g, a, c or t
aaaaatctatttatttatcaaaacagtattggcacagnaattctcatattatcatnaaatnataaaattgctactttctgtactcaattctttagaatcctagaaattgcaaangcattcaatttaacaatattgnaaataacaatacaaaagaaagaactctgcatatttatggaaacattgttgatggtacanttctactgaaactcatacacatttcactatttaatttacatatggtcttgttgaaaaaaaccagnatgttttacttttttcaatttccttatgctaaaatacatgtaattctaaaggatatctcttaggtgttataaaaaccaaggaaggtccaccaccaagtcaaagttngagtcaaag

SEQ ID NO: 4293 - DNA, 373 bp, Homo sapiens
  misc_feature (1)...(373): n = g, a, c or t
tgaagatgtgggaggaaaagattgctcaaatgcgatgggaactgatgatgaagacaaaagaacacaccagaaagctttatcagatgaatgatctgtgtattgaaaagaagaaacttgattctnggttgaatacactacagaatcagcagggcaatgccttccagggccctcgggaagcagatgttgtggcaagagaggaggtcactgaattgatccaactccaggcggaaaggatttcggccttaaaggaggagattgctcttttgcgtaggaaaggcggtcttatcctcccacccattcagtctccacgagagaaagagatacagcccgcagacctttgagtttgctattttctcaaacccatacaagattt

SEQ ID NO: 4294 - DNA, 372 bp, Homo sapiens
  misc_feature (1)...(372): n = g, a, c or t
ccaacgtggtgaaaccctgtctctactgaaaatacaaaaattagccaggtgtggtggccgacgcctgtaatcccagctactcangancctgaggcaggaggatcgcttgaacgtgggaggcagaggttgcantgaactgagatcacaccactgcactccagcctgagtgacaagagtgagactccgtctcaacaaaaaaagaaaaagttataatgttttggggacttaaagattactgaagaggggataaaagtnaacactgcttacaaatacctgaacatggagagcacagtcaacacattcatgtggacagnacatgaacggatgtattaatacattacacagcttcttctatctgacctattcctcttg

SEQ ID NO: 4295 - DNA, 369 bp, Homo sapiens
ccacgtagatgaacttgtactgcgcctccgtctgcaccatgcccgagcgctgcgcccgcaccatctggatggtcttctggatgtcaatgtcacagtccaggcccttggtggagatgttctccatgagcatgtcgatgacaatgatggtgcctgtgcggccgatgccggcgctgcagtgcacgatgatgggccctgcgtgaggcagactttcctgccgctggttgatctggtccaggaagctgaggacacccccaggctcactggggaccccatggtcgggccagctcaggtactggtaatgccagatctcccgaatcaggtctccattgtccagcggggagacctgtaaggtacggagtttgtattcgg

SEQ ID NO: 4296 - DNA, 373 bp, Homo sapiens
  misc_feature (1)...(373): n = g, a, c or t
tttttttttttttttttttaagataaggaatgtgtgtttagctttaatgtctattaaataggttggaaaaacaggccaagtgtagggacctgactcctgcaaagggcctaccgcagccctctgcactcaagcagcagccccatccanaccaggagtgtgttctgttctcctggcaggcagggctgataggtgtaggatggcgtctgtttcctttgcagtgtgggctggtcanaggagaaacagcaacttcctgctccttctcactgngtcgttggctcaccatagaccacgtcctgcattccctctgattctctcatggggagagccctggaccttctggtggtgtcccanctgggtgggttcaaggctgcta

SEQ ID NO: 4297 - DNA, 372 bp, Homo sapiens
  misc_feature (1)...(372): n = g, a, c or t
ccagtcacgaacatgttgcaagggtttatgatatggtttgagttgaaggctgaggttttctgaacaaatccatatagtgaaatattgctgagtttcttgagagagacgcattccttccattatctgctgcactgtggtattatttccatgcttcaattcaacagaacgatatgacccatccattctgtatattcgaactttttcatatggtttgttaattgcttccttcaacaattttgcagcttcttcccagttgttttgtttgntttcttcacaaatatttaatggagatcttccttgttggtctgttatatgtctatccgnttctgggtggtttaggagaatctgtactatttcagcatgtcctnctcc

SEQ ID NO: 4298 - DNA, 351 bp, Homo sapiens
ccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatccc

SEQ ID NO: 4299 - DNA, 370 bp, Homo sapiens
gctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaaaaaagaacatactggtcgtcttgttataggagatcacaaatcaacatctcacttccgaaccggggaagaagacaagaaaattaatgaagaactggagtctcaatatcag

SEQ ID NO: 4300 - DNA, 348 bp, Homo sapiens
  misc_feature (1)...(348): n = g, a, c or t
ccttcagaagttaaacgtgatcacttgtgctgggacagccaatagaggagtctgagatgatcatttccaaggagttcttcacagaggaggtagctttggagctgggctttgaggttgggcagtatttgaaacagtanagacggagcaaagaacccctgggcagaggaaacagtaagtgcaaggcataaagtgaaggtggagggtgttaccgcggggtgcactggttgcattacctcctggtggggtcagtcattcgctttcttttcctcctcaggaccagggctctttgaagatgaagaatgcccacaagggaacacaggcagaagatcagataagccaaagtcacag

SEQ ID NO: 4301 - DNA, 271 bp, Homo sapiens
cctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgccaaagagggtgcccgtgttcttgcgaaagcggggctgctgg

SEQ ID NO: 4302 - DNA, 371 bp, Homo sapiens
cctggtcccggctctctaggtccagggacattaaaaagtcagagtcctctgtggggagaaaagtgggtgaggacttgataagccctagtagatacttgtaggcccagttcttatctgcagatgggtgaccctcaacagtcacagagttgttttcactgcccacaaattcacagttttccaggacacacaggggcacgttgtgcaggaagatatgggtgtttttgaaggtacagaacttcacttggcaagtacccgggccatggacctggatgtgcccgttctcaaagttgcagttgtcaaactggacgtgacctgatgttgtcttatacatgatgggtgagaaccaggctggcgtgaagacgaggttgcac

SEQ ID NO: 4303 - DNA, 366 bp, Homo sapiens
cttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaaggtaggtacctttgacgtgagaattggaactcccttttcagtcctgtgatgatggacttg

SEQ ID NO: 4304 - DNA, 372 bp, Homo sapiens
ctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagagcaatttagtcttttatggaaaagctgactatctgggatcatatgctcagtttgtatatttgagatctgagagatcacgttctgaagtcttctcatatttagtacac

SEQ ID NO: 4305 - DNA, 222 bp, Homo sapiens
atgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggattt

SEQ ID NO: 4306 - DNA, 194 bp, Homo sapiens
  misc_feature (1)...(194): n = g, a, c or t
aaatattaaaagttaggtactgtaagtgntcttaaaacctgtaaacttnattctgtgggctagtgnnagngggacaaaatattcctaatgaaaggaantaccaattagttgatttgtnggtggcattcccnttttgggaaagcaatgtaaggttatgtctgtgtatgtnattcacacttaggcaagcatacaca

SEQ ID NO: 4307 - DNA, 585 bp, Homo sapiens
cctcggatgatgaagacagtgcccaccacaatgcccacgaggcccacagacaaccccagggcgcagaccacagtctctgtgagctctgacataggggctggaatctcaggctcccagtgtttcagaagaggcttgtccagtccccagtgctccaccttgcagtcataactctcctcagcagaagggaggagggtgaggtaactgatcttgaagaaggaatgatcactcttggagaggaagctggtctcagaaacaccttctgtgactgagtgcccattgctcagccatgtgatgttgaccacaggaggaaagatgttgtccacaagacagatgaggatgctgggctgacccagtgtcacgggagacttggaaaacactgtgacctcaggaacctcattggtagcagcggtagagttggagcgtttaatcagactgttcaagttatgttttaggacagcgatgtttgtcagtgcaaattgcgggtcaaatctaaattgtctgagaacaggcaaacaccagacagtctccttcctccccaggtccacgcagaactgctcatctccatcaaattcatgggtgtactgg

SEQ ID NO: 4308 - DNA, 308 bp, Homo sapiens
ctgctccagcatcttgtcacactcgtccagcacaaagtgcttcacattctttaggctgaagctcctattccgcacgagcgccaggatgcggcccggggtccccaccacgacatggggacagttcttcttcaacacttcttcatccttcttgatggagagaccaccgaagaacacagacaccttgacgctgggcatgtacttggaaaagcgctcatattccttgctgatctggaaggccagctccctcgtgtggcacatgaccaggaccgtcacctgtccgttgacaggctcaatctgctgtagggtgg

SEQ ID NO: 4309 - DNA, 522 bp, Homo sapiens
ctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcacgtatctttgcattaattttgccttttcaagatatttcattaaaatatgatttattactgagttcttttggtatcccccaaattttgcacctaagccaagtgcatcccctacatcaccctagtcccagccctcttttccattcttcctctt

SEQ ID NO: 4310 - DNA, 318 bp, Homo sapiens
aaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaggaagctgtgacataggacttgaagaccaaagactttgaaatttgcgagctgctcatgtgtgagttattatcactgctgtctttctattgagttacaaatctatatttttattgaagttt

SEQ ID NO: 4311 - DNA, 444 bp, Homo sapiens
  misc_feature (1)...(444): n = g, a, c or t
tttttttttttttttttttttttccaaagtntananaaagaacagngggcccaggggaccagcnctcancntacagaggacccgcgctggccctggtctntgagttccctcagtntttatngatcactatctctaccatctcgganaggaggatgtggccgganaatagggtaatagngggganagggtcancaggaaaacatgtgaacaaanatctctgngtcataaataagtttaaggaaaggtgctgngctttgatgtgcacgtacacaaacatntcagttcattaaanagcagtnttgccgccagcatgtntnacctccagccctaagggggttttctcctatctcagtaaacagaacatacaatcaggttttacaccaanacattccattaccagggacgagcagganacanatgccttcctnttatctgaactgcaaa

SEQ ID NO: 4312 - DNA, 372 bp, Homo sapiens
ctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttcccttttttttttttgagacagagtctcgctctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttgg

SEQ ID NO: 4313 - DNA, 332 bp, Homo sapiens
aaaagagctttccattgaagaagaaaacaggaaccaaaaaaaaaaaaaagcaaagagagagagaagacagcagataaatataggcaaatagaggtggaaaatataatcacgtagaatttagtatagtaaaggattatctctgaaaaacaaaaacagaaaactatcagagccaaataaagaaaaatggaaatgactggggaaaaccactcactaatgagttgaatgttcaagagaaactgagaaagagtactgcttatataaaaattatgtgaaattaaacaaaaatgtagtttagtaatgaatggtgtttaagcacttatggaatataaaat

SEQ ID NO: 4314 - DNA, 450 bp, Homo sapiens
ctggttctctcggagcttatatcgggccagcagctctgtcacctcctccttggtcatgacgacgtgctcagggactagctcgtgctccgtgatgttgatgagcagctcctgctgcagaaactgctccaggatgtacttgggggccatgtcgaccagggactgcttggcggagggtgtcatgccctgctgcaccacgatgagagcccgtgtgatgttctcctcctgcatgcgctggcagtacaccttgatggtcttgatgcccaccttgggctcctctggaaagaacacaaacatctggtcggtggggtcatcgttgtgggccaccagcacggtgaggtccgtgcgccgcggccgcccctcactcggcttgtccccaaattgggctttgaactcctccagggtctggtcaagctcgtcctgggtcaccagatagccacggtcgtggcacag

SEQ ID NO: 4315 - DNA, 420 bp, Homo sapiens
ctgtggcctggccgctcccaatgctgggggcttggcttggtgccccatccccttcctgactgagctctatgaaggactcttaaaaaaaataaaataaaatgcaagcaaagtgctttgaaagaagggaggacaccctattcctgctaaggggtagaggaagaaggtgaaggcagctaggtgcccataagagaaggctggcacaatcttcattcccgccagtgtgatttcagtctcaaaagatgagtatttggctgagaaatggaaggatactccaggccccctacggagttgtgctggggccatgctgagctgcccttgcaggcagccctgggtgctgggggcagacatgcaggacactgggaagagtcagaaccacaggtgggagggaatctcagagcccaggctccccactgagcttgg

SEQ ID NO: 4316 - DNA, 502 bp, Homo sapiens
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcggtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggaaaaaaactccag

SEQ ID NO: 4317 - DNA, 365 bp, Homo sapiens
cctgcatccaaatagcaggtgaaggcacctggctgaccatcaatgccttccacattgtattcatcaccagtcacctccacttggccttcatagatcttgtccatgccaaacctattgagaagcctgcgggccagcagcaggccagtacaatatgctgcagcataatttgtcaggccaaccttcacaccatattttggcagttcgtgtgcatacgctgcgcagactatcatatccccctctatacgggcataagcaatctgacaaatgatatctctgtttgtcacacgaactatcatcctgtatttgggtgtgttgtatttatttttatcttgtatcaccaagcgtttccgagcataagaataagg

SEQ ID NO: 4318 - DNA, 409 bp, Homo sapiens
  misc_feature (1)...(409): n = g, a, c or t
cctgaacaaggacctctgccctccctattcagacccttcgttgcctcacctggtcaatacaaccacttcacctntgaccgcaggggcaggggactagatagaatgacctactgagcctcgnctgnctgnctgnctggctggctctctctctctgnttggctctttgngngnctgacaggcgcanactgggtctctaanccttgttctgttctggncccctcantctgggntcttgtcggaacangnttgcccttgggttacgtgggttccatctnctggggaattgggaacaaggggtctgagggaggcacctnctgggagactttanaaggacccagtgccctcggggctgatgctcgggaatcacaganctgggacccaaagccaggatccagacccaaattgaggt

SEQ ID NO: 4319 - DNA, 193 bp, Homo sapiens
aaaaatcttttttccttaaaacaaaaacgattaaaaacttgggttttctaaagaaacttatattaatatgaagttacgaagatacacaaagctgaagtatctggaaccatttggctgcctgtagtcttcagcaagatcacaaagtactcaaaaactctttgaccttttcaaccagactttcatatttgtcttt

SEQ ID NO: 4320 - DNA, 509 bp, Homo sapiens
ccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctac

SEQ ID NO: 4321 - DNA, 156 bp, Homo sapiens
aaagcttatataactttattcagttgaaaatttattaaaccactagtatatgaaaggaattgaggtaagggctgggaaaaaaaataaggcataattcctgctctcaaagaatttaggatcttgagaaagacagagttcctacagggtggggaatgg

SEQ ID NO: 4322 - DNA, 320 bp, Homo sapiens
ctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaatttt

SEQ ID NO: 4323 - DNA, 308 bp, Homo sapiens; identical to SEQ ID NO: 3350

SEQ ID NO: 4324 - DNA, 335 bp, Homo sapiens
  misc_feature (1)...(335): n = g, a, c or t
aaatcctagcatcagaggtttgttcatatgtagcaggaggtcatctgaagtagcaggtcctccttttttagttttttcttaggggggtgggtgatagatatatggtgtgtcatagtcgtttgggagtctggcatcggaaacctcctttaatgcttggatttgtggttttgcaggtatgggcggagctgccattgccccacccacttctctggtagagaaagacaaagagttaccccgagattttccttatgaagaggactcaagacctcgatcacagtcttccaaagcagccattcctcccccagtgtncgaggaacaagacagaccgagatctc

SEQ ID NO: 4325 - DNA, 451 bp, Homo sapiens
aaaatttatgtatctatgtaagactggtgatagtaaatcttaaaacagtccagtggcaatctgctgctcagttaataattactaaaattcttggatccctgaatagaaattaaaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttt

SEQ ID NO: 4326 - DNA, 215 bp, Homo sapiens
aaaagagcgtgtttcttcggggcttgccgttcgttcgtttccagcctcaggaatttatggtcgcctttttgaatgaggtcacataatgagtatgactcctgaacagcttcaggcttggcggtgggaaagagaaattgatgagagaaatcgcccactttctgatgaggaattagatgctatgttcccagaaggatataaggtacttcctcctccag

SEQ ID NO: 4327 - DNA, 479 bp, Homo sapiens
ctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttattt

SEQ ID NO: 4328 - DNA, 411 bp, Homo sapiens
aaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtctccagtagaaagggaattagaaaataaaagaagactgcaaaaacaggctgcaagtagtcaaagtgccacagaggttcgcttgaatagagctctagaagaagcagaaaagtataaactggagataagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgtttt

SEQ ID NO: 4329 - DNA, 373 bp, Homo sapiens
  misc_feature (1)...(373): n = g, a, c or t
ctgacagaatagcatgttcattttagttttcagcactgaacataagtgggtcaacataaatgtttatacaaaatactgacttcaacaaaatacaaagcactttctttatctttcanaaactgaatatacacagcaagtttttttccaaaatattttcataggcaaaggattaaaaacgattttaattatacacatatggtcacaattttgccttaaaaagattgttgggaaatgtacataaggccgcttgtaaatgtacatcgtgttactgttatgtcttatgtccagaggaaaaaatgttatcatacagatttgctcttacttgggagtaggctattcaaaaatacagtactcttctgtacaaagaaaaaag

SEQ ID NO: 4330 - DNA, 418 bp, Homo sapiens
ccgccaagaggtggtgattgggagcccacaggcactggtcagaggccacctgctgctcctgctcctttgcaagcctctcaggacttgcgaggctcagaatgaatggatctggaacagggcttgcgagcctcagaatgaatggatctggaacagggcctgcgaggctcagaatgaatggatctggaacagggcttggtaaactgccaaggcacctggggactcgggagctctggcagggtcagcagaggaaggcagaaggcagggctgtctcacggcgtccccatcactgatgtcctctgctctcccctggcctttccagggtgcctgcggcagttgctggactttctccaccactggggccctggagtctgcgatcgccatcgcaaccggaaagatgctgtccttggcggaacagcag

SEQ ID NO: 4331 - DNA, 482 bp, Homo sapiens
ccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgttttttt

SEQ ID NO: 4332 - DNA, 512 bp, Homo sapiens
ccacttgaccagggacttgcaaagttgttcctgtcacctgttgagagctcagacttccagccagggcctgagcactgaggggctggatggagcctgtcacagcttgtgcctgccccccaacattgacttggacagggaagaatgttatccctccattttcattggcaatacctagtgacagagaaaaaaagcatgaagaaaatgttgataataagaggttctccgggcagaggtttacaatttctgctctcccaaaccctctctccccatcactcctctgtcccctatgtcactctagccaaacctcgggtaacttttcaatacatgccacagagaaggaactcaatatccaactctgccttccttaccttgcacaggaatggttaccgtttgcccattgttggctgtgacagtgacggttgccatggtgaccaaagtctgtccaggaactggtgtgacagaaacagtctccccagatacattctgcacagggacagcattgactaggggct

SEQ ID NO: 4333 - DNA, 484 bp, Homo sapiens
  misc_feature (1)...(484): n = g, a, c or t
ctggagcagcagatagaagggacagggttgcacttataacaccactatcctcccagccctggttttatcatcatcatcgagaaaaatacaattaatcagcagtgatcaaaggtaagtctaaacattccatttaactaacttaaatgtgacctggtgtgccgtgtcattctataaatgacataacagaataagactcactttctaattcacagcctctggttcaatttcaagtaagcaaatacattttgctttggttttgcttacaatattctgggaaatgcaggctataaataatcactcaactgttttgtgggtcaacagaatcactactactttcagtttcgttgatgccatttatatcatgagctcaagcacacgggcgcttcanaaggcactataaagtttanttttgatgtggtgngatgttctgatctatcttgaaaggtaaagaaacccacaggattcagcgtcaagccaatccatg

SEQ ID NO: 4334 - DNA, 525 bp, Homo sapiens
ctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagta

SEQ ID NO: 4335 - DNA, 469 bp, Homo sapiens
ctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatgg

SEQ ID NO: 4336 - DNA, 467 bp, Homo sapiens
gcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcag

SEQ ID NO: 4337 - DNA, 256 bp, Homo sapiens
cggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaattt

SEQ ID NO: 4338 - DNA, 308 bp, Homo sapiens; identical to SEQ ID NO: 3350

SEQ ID NO: 4339 - DNA, 347 bp, Homo sapiens
cctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccag

SEQ ID NO: 4340 - DNA, 221 bp, Homo sapiens
  misc_feature (1)...(221): n = g, a, c or t
attaggacangggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggctgaggcaccaccagtgctgcttcc

SEQ ID NO: 4341 - DNA, 331 bp, Homo sapiens
ctgtttactgccagccagaagttcaggaagaacacagctccatctctctccagccggaaggacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatgg

SEQ ID NO: 4342 - DNA, 300 bp, Homo sapiens
gagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcag

SEQ ID NO: 4343 - DNA, 172 bp, Homo sapiens
aaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgttt

SEQ ID NO: 4344 - DNA, 177 bp, Homo sapiens
ctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccag

SEQ ID NO: 4345 - DNA, 359 bp, Homo sapiens
gcaaatctgttgttaaattacttaaagaaaatttaacaatggcataggcaccttgtcaactaaatgattttcataaacaccaaaaagtagttaaaacttttgtatacataaccaaaaaaaaaaaaaaagaaaactgtacatttacagtatttgctgctgttcattccccaaaatacaattaggacataattggctattaaaaatttataaaatttaataaaaaactttgctatgaatgtagtgttacccacttttgcattaaattcaccttcataaatcaaaacatcatgactctcattcttaaattaaatgacccaaaattagaagttccaaaaaagttctgagaacaattatggttt

SEQ ID NO: 4346 - DNA, 263 bp, Homo sapiens
  misc_feature (1)...(263): n = g, a, c or t
ttgacggggctnctatctgccttccaggccactgtcacggctcccgggtagaagtcacttatgagacacaccagtgtggccttgttggcttgaagctcctcaaaggagggcgggaacagantgaccgagggggcagccttgggctgacctaggacggccagtttggtccctccgccgaagacgacatggtcattattacgatcccacacttgacagtaatagttggcctcatcgccggcttcgaccctgttgatggtcagggt

SEQ ID NO: 4347 - DNA, 448 bp, Homo sapiens
ccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcgtcgcctcgcttccttgcatggatgaagaggagtgattgctacatgttcctttctgttcccgccgcccaatagagttatcttgttttggttatttcctttgtggcatcagcgtccccaagtgcggccag

SEQ ID NO: 4348 - DNA, 237 bp, Homo sapiens
ccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagagg

SEQ ID NO: 4349 - DNA, 478 bp, Homo sapiens
ccaagaacaaggcgtgtgccacagtcacgtagtgacacaggtcacatttgctttctgccagcagaagagactggactccagtgcaggggagtgtgcaaggacaggttctggggggtggaggcatctgtggacatcccagggcaggggtgagggccagaacatccctaggtcctgagactacagtttctccacatttagatcagacattctcttccaaggaaggaaaccaagagaggctggtgaaccgtctggtaatgacaagccctcacttttgcagccctcttggctggtccctcagcaggtcttccctatgagcctgcaaaggagacaggcaggaatgagttccatgttcgagatagggaaactgagggccagggagaggcagtgactcgcccgagggcacacggcagaatgcaggcagaggcagagtggccctgggcatcctgagtccagttctgggcactctgcacctcacagg

SEQ ID NO: 4350 - DNA, 413 bp, Homo sapiens
aaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccatttt

SEQ ID NO: 4351 - DNA, 337 bp, Homo sapiens
ccaccctctacaccgatgaggcaggccaatttctgagtgtcgttcagagctgggggcaggtaggtcaggtgattactttccagggctagagtagctcaatcaagttcctaacgcttcccatcaacttgcctacctttagccgaggtcacaagctccagctcagaataggaggcacacatgcggcgtatgaggtcaatctgctccagggtgaggcgcagggcatcccggtcctgggtctggcatggcacataggctgaccagaactggggggaaggccagggtttggcttggatgggggctgctttggaggaccctggactgctcacagcctccacag

SEQ ID NO: 4352 - DNA, 411 bp, Homo sapiens
aaaggtacttcaaaagcttattggtgcttctgtttgttttatcccatccttatagtttttttctattgttaatagatgtttgtgaaaatagaaggagcactagttctagttcatgctttcttttgcttttccatagcttctaaaactaacagtgaaaatgatatattgaaacagtaaattatagatctataccagatttgtaattgtgtatttcattgctatttgaagtataaagtaatggttctgtataatttattgggaaggttgaatttccatagcttcaaaatattcaaatttttttgcatggatttagctacccttttcaaaatttccttttgatgaagtcattgactaaagcgtcattaaaacagaacaagaaaagaattccaaaaaccctccaaaattcctttt

SEQ ID NO: 4353 - DNA, 397 bp, Homo sapiens
aaattaaagtggaagaaaaggagctttacagttgatagtttcaactccctaaaataatgccaacaaggtaagcttgcatagaaaaaaaacttcaaattattactggctacatgcttaaaaaattagaaatgcaggtattataatcatagtgcaaaaccatggcagtttgtgatgtctattactgcctaaggttgagaaatagaccgtagtacctccagttatcacagtttctggtcttttaatcaattatttctgccaactagaagcaatatgtatgtaaagatgggcagcacacatctgctgtgctattaattaacgaagtttgaggtcatcaccaccacctaaattggaaccaggactagggtcttgttgtcttcttgccagttactgccagcag

SEQ ID NO: 4354 - DNA, 440 bp, Homo sapiens
ccagcctcgggtttcagaaaaagcgctggagccagcggaataccaaagccttgtttccccctggaaccggtttggtattatgcctggttgtggttcttcccctctacatttggtgttgacacatttctttaataagctttttccctatcctttttcctttcagtcctattgttaaaggtgtcttgggtccggtcttaaatcaatttggttgtgactctgggtcccagaaaaaagctgctatctcattagcggcttggtgtgttcgaaattcatatttgaaccacatagaaaacatacactaccagtaccattacttccctgcatatatatgtaaaaaaaaggaaaaataaaacaaatcacacagaacacagaggggctgctgaacaacgcagcatgagtgtaaatacattctctttcgggtcagacatttggcctgacag

SEQ ID NO: 4355 - DNA, 507 bp, Homo sapiens
aaatcctccaagggatgagaaccaacctctgaaaagggaatctggagactatcctttccaagtctgaactgggatgtgagctaacttttggattttagcagttatttctttgatgacctttccttcgtcatcaagttccaggcagcagttagtaaggctgaactttccgcatactccctcttcctgggctaggaggtagtctaaggccagtctattttgataaatgacatttctcatttttgtggcttgctgggcaagcagattcaaggcccctgcagtttcattggtaatgatttctagtactgcctgcaatcttataatgcggttaagcatgtaaactggggtgcggtatccccacattccatcttctgcccaggtggctgggccataatattgaattattctttcaggaggccattcactgtccttccaatctcctatagttatgcctcttttgcttttccttttagtttcatcatagatggggtatcctaaggcttctccctg

SEQ ID NO: 4356 - DNA, 147 bp, Homo sapiens
  misc_feature (1)...(147): n = g, a, c or t
ggtggtggagggaggattgggatgcctgaggagggtggagtaggtgctggggccaacacggaggacaaactgttggtcgngtccagctncgcaaggtcgatgaacgtgccttggntactgcactgactgtntccttncgagtcaggc

SEQ ID NO: 4357 - DNA, 226 bp, Homo sapiens
aaaaagaagacacttccatggcgaattgaattagcccaaactttccccccaaatgggacaaggtattacattttggagtttttcttcgagtcacaaactaaactccagatctctctgtccaaaatttcatcgcttaaagaaaaaaagttctaattacaggagcggatactgagctgaagaacttcccaatttgagttggttattcctactaaacgcagccacacag

SEQ ID NO: 4358 - DNA, 573 bp, Homo sapiens
  misc_feature (1)...(573): n = g, a, c or t
ctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcanatngctatgggag

SEQ ID NO: 4359 - DNA, 395 bp, Homo sapiens
ctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacag

SEQ ID NO: 4360 - DNA, 576 bp, Homo sapiens
  misc_feature (1)...(576): n = g, a, c or t
cagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactggattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggntataataatgttaacatggacatgatcttctttataatttctactttgagtgctgnctccatgtttgatgtatctgagcag

SEQ ID NO: 4361 - DNA, 444 bp, Homo sapiens
ctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttattatatagtgcttaataaaccaccccaaaatgatatcagttcttcccaacttgatctcattttggggtggttt

SEQ ID NO: 4362 - DNA, 353 bp, Homo sapiens; identical to SEQ ID NO: 327

SEQ ID NO: 4363 - DNA, 531 bp, Homo sapiens
ccagtgcttgtcctggcagtaaggctttcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacag

SEQ ID NO: 4364 - DNA, 245 bp, Homo sapiens
aaagtcctatacttgcctgagatctagtgaattattttggtactccttttatgagaagtgaagttgcagagtttggcttctgcatgcgggtttaatgtgcttgtccccccgccccgactttcttaggtgcagtggagtagtgcataggtggtgcatcctgagggctcccgaggggcatcacctgcccagtggggaagtgagcctgctttcagttagaggcagggcctgtgattgttgggtcacag

SEQ ID NO: 4365 - DNA, 251 bp, Homo sapiens
aaaaggtccaagatgactgcagttttacaaaaatgggcagggtggaaagttgcaaacttcatgtgcttctggatatcaagatttgtttttatacaatagtcacagttaaaaacaccctgctggtaatacataattacactttattaaggtcataaaccagcaataaacaataaagcctatacaacttgtagttctacttaatcactgactggtacagctaacatgagataagtgaaaagttcctatggttt

SEQ ID NO: 4366 - DNA, 224 bp, Homo sapiens
aaaaatataagccccaaaaacaatgacacaaaattcatttggttaattcatgtaaaggaaaaaacagcaacaccaccacacaaacaggaaagtgggagtatgattaggaggggtgagatgaaaactattttacagtaacatttccaccaaaagactgtcctaagaacacgctgtcaatacagttcacagggaaaaagcaaatgtggtatttttttgtatttttt

SEQ ID NO: 4367 - DNA, 244 bp, Homo sapiens
  misc_feature (1)...(244): n = g, a, c or t
ctactaacgttgcttaacaaggatttanaaaaggaaatacattctctttgctggtataatggtataaatcanatcttcaaatctatgggaacgagtcatcttctctgtcctctatctcaagaaattagctcttttacagnngtttttatgaaatcttttctttcanttaaatcataagnaggataattttcatagacctttttgcanatctgtttcattgngacttnttccaagttagcactgg

SEQ ID NO: 4368 - DNA, 526 bp, Homo sapiens
ctgtagctaccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgt

SEQ ID NO: 4369 - DNA, 500 bp, Homo sapiens
ctggagcagcagatagaagggacagggttgcacttataacaccactatcctcccagccctggttttatcatcatcatcgagaaaaatacaattaatcagcagtgatcaaaggtaagtctaaacattccatttaactaacttaaatgtgacctggtgtgccgtgtcattctataaatgacataacagaataagactcactttctaattcacagcctctggttcaatttcaagtaagcaaatacattttgctttggttttgcttacaatattctgggaaatgcaggctataaataatcactcaactgttttgtgggtcaacagaatcactactactttcagtttcgttgatgccatttatatcatgagctcaagcacacgggcgcttcagaaggcactataaagtttagttttgatgtggtgtgatgttctgatctatcttgaaaggtaaagaaacccacaggattcagcgtcaagccaatccatgcccaggcacatcgcag

SEQ ID NO: 4370 - DNA, 542 bp, Homo sapiens
cctgtgttcaccctggtttattccagagtcacgtcagtcaatcacctctcatactgggcgtcataggtgtttgtctggctgatccctccattcgaagctggtcctgaaagttcctggctcctgctggactccagcagactttgctggatggcaaactgcattatctcgtaatcttcatcttgcaaatgcacatttctgccattgtcttgaacatagtaagattcgggaatttcaaacacagattgatcaacctcaaagtttgtgatgtgggaagctgaatcagcctgggtcccttccacattttgagatacagattcttcggcagtgctacagccattaacatttccaaatgtaatccgtgcatttaagacatgaaacaagggaatttctattttgacaggaaatccaggtgggaattccaatttgatgaaatctctcagtcttgcaaaatgagcactcgttcgagccattaggtcaatgatgggaatgacctgctccaccagagagaggggaaactcttcacacatccacaacattgcttt

SEQ ID NO: 4371 - DNA, 396 bp, Homo sapiens
ctgtcgccatgaagtaagcacgacccgtggttcccaatccgcttacatcctcgggcagaactcctctctgtcgtccctggcatggctgtagacaccctccctgatggactttcactttttgttgcagggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatgg

SEQ ID NO: 4372 - DNA, 563 bp, Homo sapiens
  misc_feature (1)...(563): n = g, a, c or t
cggccgaggtaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacaggaaacccagctagactattgggtatgaactaaaaagagactgtgccatggtgagaaaaatgtaaaatcctacagtggaatgagcagcccttacagtgttgttaccaccaagggcaggtaggntattagtgtttgaaaa

SEQ ID NO: 4373 - DNA, 267 bp, Homo sapiens
aaatgcttccttcaaagaacaaagttgtttttggtgaaatacaatttttccatttttttctttaagtttctgaattacaattaattggaattttaatctactggttactgtgttggacagcatgggtcagaagaggagatgaaaaataacaaaaaattaataaatggtgataacagttgataaaaaagcaagcatgacattgatttagacaaatgtgattgttgagagtgattgtggaccactctccattagggtgttcaggaaagg

SEQ ID NO: 4374 - DNA, 214 bp, Homo sapiens
ctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgttttt

SEQ ID NO: 4375 - DNA, 145 bp, Homo sapiens
ctggaggtgctggaccgcgtgtttgagaggcagcactactcagacatcttcaccaccacagagcccatcaagcccgagcagaccacagagtattcagccatggcctcgctggctggtgggctggacgacatgaaggccaatctgg

SEQ ID NO: 4376 - DNA, 225 bp, Homo sapiens
ctgcaatactccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcag

SEQ ID NO: 4377 - DNA, 519 bp, Homo sapiens
cctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggttgggctgctggcaggcacactgggtgtagcccaacaccgtgaggcactggcccacttgcggaacctgactcaggctg

SEQ ID NO: 4378 - DNA, 475 bp, Homo sapiens
ccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggc

SEQ ID NO: 4379 - DNA, 366 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggcctcatcgccggcttcgaccctgttgatggtc

SEQ ID NO: 4380 - DNA, 450 bp, Homo sapiens
ataaagcctaaagcaaagttagatttgggggttattcagccaaaattaccgttttagaccagaatgaatagactgcactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctattt

SEQ ID NO: 4381 - DNA, 486 bp, Homo sapiens
ctgctccatgtccttcacctctgccagggcctcatcccggagaaggcccatctgctcgtggttgtagaaggggcaggctgcctgcttctcctgcctcctcctctttggcttctcctcctcagctcctttcttcttctctgagggtggcacaggcacaaagagagaaaacagagaggacagcaactgtccacgggcccgagagggggttgtgtaatgttgagacccacttccacagggtggggtctataagaccctcccaagtactgcctactgtgtctcatcggaacactgtaacgttttacttttgttctccagaaagagcccgtaaaatcatctccaagccaacgattcggaccagacgctcacccagagaataggaacactttttcccaaggagaggggactcagggaggaactggggtctcctctgccattctttctatgaaagacactgaatggtcttcagtcactgccacccctgcctca

SEQ ID NO: 4382 - DNA, 438 bp, Homo sapiens
ctgcagccccctggtgcccgcagcaaagcagacacttcccactgtccccaacaccagagggaggaaagtaaagaagcggacattgaagctagacctgggtgctacaagtgagatctacagcgactgttccacacaattgggggccctctcagcattctggggtggctagagtctctgtgtctctgggctttctcctgagtgttgtaccccatgctactgcgaaggtgaggacacggacactgagaaacaggagacttactgagacgtcactgatggtgatggctgagatgccttcccgatgggcgggcaggcgggtcacgtgggtgaggtggtccagatcccacaggatacaggtgcagtcctgggagccgctcaccaggaggctgaaggtgactgacgctgccaggcacgtgacagcctgtgtgtgtccatacaagg

SEQ ID NO: 4383 - DNA, 510 bp, Homo sapiens
  misc_feature (1)...(510): n = g, a, c or t
ccatacctaggactagcccgatctgtgtgtcanccactgacccattttaccagtgaggaaattgangctcananaggttaagtgacttgcctgtggtcacacagggaacaagggcagagccagaatgtcaacggaggagtgtacaccctttcaactacgctctgtgcgcaatgtttaaccggagcctngtgtattcatttgtaagtcacagaaaataattatatttacagggggaatctaaagatttcaggggacaacctgtanactgactctcatttaacaggggcccaataagcgattatgcccatccacttgagcttgtactgacgtaactactctnctcatgactaccactcaaagaatatacaaaggacctctcattttcccagaaataacctctctatatgaacaggcacagccaatgtggaatggccttatgtctactgagcacatcacatgcacagctcttcatttcatccccacactaatcatgtaatacaggcatgactg

SEQ ID NO: 4384 - DNA, 368 bp, Homo sapiens
cacagcatggacatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcactaagatttactggcagtggatctgggacacaattcaatttaaccatcaccagtctgcagcctgacgattcagcaacttattattgtcaacattattctgcatctcttcgcagttttgg

SEQ ID NO: 4385 - DNA, 193 bp, Homo sapiens
cctcaccgtgagaccttacaaagccggattccggcagagttcctctatctcgtcttgttgctgattaaaggtgcccctgtctccagtttttctccgtctcctgggacgtagcaggaaatcagcatcatggttgggttcaaggccacagatgtgccccctactgccactgtgaagtttcttggggctggcacag

SEQ ID NO: 4386 - DNA, 609 bp, Homo sapiens
aaaaaaaggcccccagggcaagttatttacagtttaattgccactgtcaactgatctggaccttgatcgggaccgggacctctggcgatccacagatgctggagacttagatctacttgaagaaccacgtttctggctcttctcaggcacgggagacctactaacagaacgggacttgctccggctccggctcctgctcctgcttcttgaccggctgtaagatttgcgactacgggaacgggatcggctacgagacctagaggaacttctggtccgggatcgagacctgcttcttgacctactgtgccttttgctgccttcaattaattttatttttctcccatttatttcctttccagaaagtttttcaatagcattctttaagtcaccataagaggcaaactcaaccaccccttcatttaatttaggtcggtgtgcatccgcaaacgttacttccccagcttgtctcatgaaatctttgagatccttaacacaagataattgtgttaagcaaagaagaggaaaggggacacacaaacaatcacatgatataaaaaaaacaagactactgaaagagaagatgttagataaagtacaaacatggcattt

SEQ ID NO: 4387 - DNA, 575 bp, Homo sapiens
  misc_feature (1)...(575): n = g, a, c or t
ccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgntgcctaaagacatctagtagtaccaagatgatgggatggaattttaacatcaggttttgtagccctactgaaaatttagcacgatcagcacaagtctagaaaccagactaccctgct

SEQ ID NO: 4388 - DNA, 397 bp, Homo sapiens
aaatatgttaaccagattaaagcatgcaaaagatccaatgataaagacattaaattaataatatgctaatagtatctaatttacccactatagggtctttatactctgtcacaaaaatattagtaaacatcaatttgaagttcggtgaacggacctgattcctgatttgtatatatgatatacccttgcatttatatggctaactttacaggctgtgttacagtacagttagaggaattggtataaatttactccccatactgcagtaaataatggttggaaatgattctcctaatttgctctgtgaactcagaatgcattaatgaattaacaacacaggtcactgagggaccaaaattcctcagtattcacattaacttttcccatgaaaagcttt

SEQ ID NO: 4389 - DNA, 471 bp, Homo sapiens
aaaggcattttggcattttggaataaagttacacaggtgcataccttatggaccaataatcccttgcctaaagaaacttttgcatatgtctatcaggaaacatgaataagaatatccagtgcagcattgtttacaatagtgaaaagctgaaaacaacttcaaaatatttatcttaggaaaactgattaaaaacctggaggaatctcagacacccaatattgagtaaaaaaggcaagtatgaaaaccatatataagataccaattttgtaaaagtaaaaacacttataattaaagaaattgttaaagagatatacatatatgtatataaacctattaaaaaaagacaatgggaaacaacaaaatcagattgatgctaccccggggatcaaggtaagtgattgaatagagaaaaactattcttggggctttgataatattagagatcttcttcataacctgggtggttccttt

SEQ ID NO: 4390 - DNA, 405 bp, Homo sapiens
aaaagtgtcacaagccacagtggagccatatacatgcagttcagcctgattttacccttattttcttctaatacagactccattacaattttggaccatctgcagagagtacagatacacaaaaccaaaacaagtatctatgataataaaatcttcagaaacttttcagacgtacctttcatggagccccctccctcccccgagtagaaccctaacagggacctcgtttgttcctgtgagtcctgccaggacttgtttaatgggtgcttggggttttggttttcctccttattcttcctcctcctcctcctcttcatcatcatcttcgtcatggcagtgtgtaatttcctggggggccagtgggaagaggttgggaggtttaatctcactaattgaccgtgtcag

SEQ ID NO: 4391 - DNA, 212 bp, Homo sapiens
ccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcag

SEQ ID NO: 4392 - DNA, 306 bp, Homo sapiens
ccaaaactgcgaagagatgcagaataatgttgacaataataagttgctgaatcgtcaggctgcagactggtgatggttaaattgaattgtgtcccagatccactgccagtaaatcttaatgagaccccttcttctaaactggaagtcgcataaattaggacattaggggctttgcctggtttctgttgatgccaggccaaccaccgatctatattctgagaggcccgacaacttattgtaactgtatctccgacagatgcagacagggtggaaggagattgggtcatctggatgtcacatttacct

SEQ ID NO: 4393 - DNA, 445 bp, Homo sapiens
  misc_feature (1)...(445): n = g, a, c or t
aaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatanctagttaaaacaataagtatcatctaatttgggtgtttattttgcngatgagaaaacanacctagaaccgnggcatgttttgcctgaaacatacagtgagttananacngggcctaanatngctnctagcatcanancaancccaagaatccatcagcaacctcagaccaacccaagaagataattt

SEQ ID NO: 4394 - DNA, 290 bp, Homo sapiens
  misc_feature (1)...(290): n = g, a, c or t
gtcaggacacagcatggacatgagggtccccgctcagctcctggggctcctgctgctctggctcccaggtgccaaatgtgacatccagatgacccaatctccttccaccctgtctgcatctgtcggagatacagttacaataagttgncgggcctctcagaatatagatcggtggttggcctggcatcaacagaaaccaggcaaagcccctaatgtcctaatttatgcgacttccagtttagaagaaggggtctcattaagatttactggcagtggatctgggacacaat

SEQ ID NO: 4395 - DNA, 447 bp, Homo sapiens
  misc_feature (1)...(447): n = g, a, c or t
aaatatatgggaggatgtgcgtaggttgtatgaaaataccaagtcattttatatcagggacttgcgcacccacagattctggtatctgtggaagtcctcggccactcccccgtggagacaggacaactgtgtgttgacagaagtcacatgggagaatgctcatagcagcccccacgcagtgacacaacctggaacaccgcccagtctgaccagcacagaaaagcagcacctgctgaattcatgccacgggggactccacagcagccaaaagagcgagctgtggctactgtatgatcagtggccccaccagtgatgcctcggacataacgctgagtccaagaagcctgagacccaaggggatagactgngggattccatttctgtagtattcagaaccaggccccactggtggacagtgttagaagttggaactgggttctcctctgt

SEQ ID NO: 4396 - DNA, 627 bp, Homo sapiens
  misc_feature (1)...(627): n = g, a, c or t
ccacctggtgagcagacctgagatgggatgggggacatacagaagagaccattacacgaggccccaggaagtaccctcagggcgttcaaacagctcaccctctcatccagctcactgagggctctggcctcttcaacatctgctccctaggacccctcccgaggctcgggcagcccctcatcctatatcccccacagcatgctaggttaccatttgccctctacccccattccacaggccaagggctcaggatcaccttgacccagcaagatcagcctcacccacttaccccacacagcccatggttggcagaacccctcctacaccctgaactctgacacagagaggcagccctggcccaatgtcaccagcacccattcctctcgctgccaatgacagtgacaagccaagcagcacgtgactagcacctgactcttgacatctgcaaggagcagtagcagagctgaccagccccctgggaatcaacatcaggcttctctacttttgtgccctctccctgccccacatggcccctagctcctgaaacagtcccagcaactgggctataaaggcccagaatcaaatctgagtatctagatgaggcttanaaatctaggtgctactcag

SEQ ID NO: 4397 - DNA, 262 bp, Homo sapiens
  misc_feature (1)...(262): n = g, a, c or t
ctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccangangtgcttgangccccgatggactcctgaccatnatcctagccccgagacaccatnctgagccagggaacanccccangnttggngggngccggcatcnnccntagctcacca

SEQ ID NO: 4398 - DNA, 323 bp, Homo sapiens
  misc_feature (1)...(323): n = g, a, c or t
ccttcttcacattgtggcagaaactaacatcctttcaggaagatgggcactagggcaaaggtgcagccctcccaaaccccgggccctggtctcccaatctccaatatctccgcttctcaagccatatgtctctctcccacaaacagagacagccccttccctccagcattctctaccaagcccttcaaaccttgtcagcctgtctcatatgctggacttcccagctcctacccatcacanantacaaactgatccagccgntgaaggaggcnncagagaacactgaagggncccgagggcaccactgcacatcaaagcaccag

SEQ ID NO: 4399 - DNA, 316 bp, Homo sapiens
  misc_feature (1)...(316): n = g, a, c or t
cctgtcatgaataatcaccgttctcctttcgtctcgctcccctcgtacttctcgcctgtctgattctctaagttcatttcttggtggtggaggctcatttcttctggagtcactgaaatttttgggatatctttcgaagcttggatcttcccttcgtgcantaggtcgtgcttttttcccctcactttgaccaacaaagcgatcccgcctttcaaaagatgaagactgtactgctgaactctcaggaaacctgcctctctctcggtgatcaaagtcattaaatctgttctgttggcgagagtagtcggatccatgg

SEQ ID NO: 4400 - DNA, 243 bp, Homo sapiens
ctgttcttctttcagtcattccaactaaaacagacattttgcatagagagaataccagcccacttggtttcttgttttttattattggcgtcagctaggactatacgtggccttaaacgtcatgcactgatggacagaagagaaaaaaggatgaaaaaaaagacaaaggaggggaaagaggagcagcagtgaaaatttgtaataaaaactcttcttaatttataggtaagttttggcattttt

SEQ ID NO: 4401 - DNA, 493 bp, Homo sapiens
ctgcccagggcagcacagggcaggcaatgagtgtgagaccccacaatgcaacagacccttacaaaccccgcaaggccacacaccctgggtccatctgccctgctgtttcttcaggaaaaaacccagaatggaaatgctggagccccaggggctggagaccggggagaggtggcctgtaaggctgtcccatcaccatccccgcacgtcagaagcaccgtcacgttggaaaagaatgacgcttattccaccagttctgaagccagatgtcctcacaaccgaagcagccctgtttgtgcttgggctatgacttgagggtaattaaactgtcaaaacaccctccctactatttccattttcttgcagttggtgtcatttagtcactgcaggctgacagacttattacaggattgagacatgagaatgaacagtcagaaacctataaatgaactcaccacaaatggctgctggaaaggaagaaaactatctgtcgatg

SEQ ID NO: 4402 - DNA, 445 bp, Homo sapiens
aaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcag

SEQ ID NO: 4403 - DNA, 68 bp, Homo sapiens
  misc_feature (1)...(68): n = g, a, c or t
aaaaagananagagaaatggagaggttaantggnttccntanagttaaccaggtancaagctgggacg

SEQ ID NO: 4404 - DNA, 496 bp, Homo sapiens
  misc_feature (1)...(496): n = g, a, c or t
ctgctttcacttctgcttcaacttcttctggcagcaactcagaaagcttggcagaggcatagttcttcctatcgccaactttctgtaaacatttgcagtatgttaaattatctgaaataatttttcctaattcagggaaatgccagccataccattctctacatcgcataatgtagttgtttagttctttatccaagtcatctaacaaggaaattgcctgaacaatcattgtgtctactttatcagcgctaaacttcaatctatatcgagacaggctgtgagccaatccaagacacatngctgccatttcacgtggttctaccccagggattaatccatccatttgngaacgaattnctctcataagttcattaacaacaggactatggatacaactgagattcancttttcctttatgacccctcctagtttagcatcagctactgccagcggttcatgggcttcttttactattttcttcagaacttttttcag

SEQ ID NO: 4405 - DNA, 418 bp, Homo sapiens
  misc_feature (1)...(418): n = g, a, c or t
aaaaaaatgctggtctttattcaatataattgaanggtcacctagaaaatngaattgtgaattcagttccaaggtatttgtgtcttaaactatgaacaactttacttttntttcangncantttaatntatngttttaacagaaaactnacatatttngtttttgnaaaggaanccttaaaaatgtcatgctggtattgggctacaaccggaaaaatactgaaggtacacaaaagcagaaaggtaacatttagaaggatactgttttccaaacagggcaatgatgtgaatgatggtancatantatgtgtttcataaatttgtagaaaatattacatatggtataatcaggaattntaattggtngnttgnagtgtaaanaacttagacataaattttcaaaattacaagtgatntga

SEQ ID NO: 4406 - DNA, 565 bp, Homo sapiens
ggtaaagttatgtaaatatgtagctatgtaaatagctataaaataatatttacaattgtgaatagtatgtaaatagttgtgaacataactattgtgaataatatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaatttt

SEQ ID NO: 4407 - DNA, 597 bp, Homo sapiens
  misc_feature (1)...(597): n = g, a, c or t
gcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgnacgaacctncagcc

SEQ ID NO: 4408 - DNA, 561 bp, Homo sapiens
  misc_feature (1)...(561): n = g, a, c or t
aaaccactccaacaactgctgtgaaggtcactgtgcagagaccctgggtaggggaggctggagccaggtgagtgtgacaggtcacagatggctctcaggccacctgccttcagctccttttgtttcgggttctagccagaagccctggggcctgtctcttgcctcttcttgtagcatgagacacccttgggggccctggggaagggaaggccagtggtgtggcttccctttcagcctagcaacgcccaaacccttttcctctacctggctccacttgtccccagatgctatctccaaattccaagtagcaaaattcctgggtttccccttcccagctcagagtcacttatggctggaatgtgggacaaactcttctaccagaaggtccagggcggttgcagcagctcaaaggtggggatgctggtgacattgactgggatggaaatgatggcccatggcagcccatgctgttccaganagcggcggatcatgtagccgtctcggccgancaggaggagggcggggatgtcagctgtgcgctgggtactgncctggatcatc

SEQ ID NO: 4409 - DNA, 121 bp, Homo sapiens
  misc_feature (1)...(121): n = g, a, c or t
aaatgttattaacatcaatacctactatttctagttaaaattcanatggagaagaaaaataatagctcccacgcattacatttgtaacttcaaatggtaagcctctcaggagctttccagg

SEQ ID NO: 4410 - DNA, 620 bp, Homo sapiens
  misc_feature (1)...(620): n = g, a, c or t
aaaggcaaatctttactccttaaagaaaaaatacaaactgtggtatttttaagagatcgttatattttacataatataaacaaaatcactaatgcatctatatgcttggtttccttaaactacaatgaaccacagaatgggtgaaaatgcatttactttttggtggcaaataaacatactggaaaaaacacgtaacacatagcatgccttttttccttactgtctacacacaggaactgacataaccaagttttaatagccgccacctcctcttccctgtccaaagtagccagttccataggcccccctaccacctcctcgctggaatcccccagatcctctgtagcctccactaggccctctgtagtctcctccagagttgcctctaaagccacctcgggaaactcctctatagcctccaccaacacctgcaccatatcctgcccgaaaggagttggcgctgccaccatagcctccgctaccatagcctccactgctatagccaccgccatagcctccaccactgtaactagaacctccccttctatatccgcttccattgncgtatcgggccatcttgggangacgtggaccatctccataccgngtactgccaatca

SEQ ID NO: 4411 - DNA, 265 bp, Homo sapiens
ccccttttaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatattt

SEQ ID NO: 4412 - DNA, 233 bp, Homo sapiens; identical to SEQ ID NO: 4019

SEQ ID NO: 4413 - DNA, 460 bp, Homo sapiens
cctgaatctggaacatgccctggatccccccacctcagtcctcaagctttctggacccctgaagccaaggcagattctttctcccagcgtcatttctggggcaggaggaatctcttttctggtttacctgggccagacctaagaatagcaggatctctgaaaccacagggttttgatgtgtttttatcaagccaaatgtacaattgccaactgacactctggataattgagcacagggggtgccctcgtacattgtaccgtcactcccttctgaacagttggcagaccaaactgtttggaagctcagatactctggctcagggtaacacttttgttccccttacactcctcaactttccacctcagctagggaaagagaatgacagttaaggcttgacccaggattataatcgttagagcaagtgggagtttcagagacttaaggggcactgcagggagg

SEQ ID NO: 4414 - DNA, 350 bp, Homo sapiens
  misc_feature (1)...(350): n = g, a, c or t
aaaaatgtnattcctctgtacagtaaattacaaatctttanggatttttttgtaataagagaatttatatttgtaatggtctaagaatttttttgtaatgnggtatatagaattttaattnggagcacttataagctggtaagagagactatancatntnaattatcttggtttatgnttcagcatttcctctagaatttttgctctcaaatatgtgatttaatgaactaaaaacancactcatcagtcttgggaaatttgaactttgatcaacttaactaaagaaggaagggtagtaagaatttttcaaatacaaatatttgccaattcacagatgataacatttaagg

SEQ ID NO: 4415 - DNA, 211 bp, Homo sapiens
  misc_feature (1)...(211): n = g, a, c or t
ccaagcacaggtgtgtcagcttcttgctgacaaccaagacagcagcaagntccttgcaactggcttctgtaanacgacagttttncaacgacaacatctgcaggaagtgttttgggcgtgtcatggtcttgtacagcaacatggcaccctcatccaggagcacattggctgagagacgcaggtgcttcagggactggttggctttgaggac

SEQ ID NO: 4416 - DNA, 431 bp, Homo sapiens
  misc_feature (1)...(431): n = g, a, c or t
ccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacttgcatggattcnaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctnactgnccaccgtggcggcatctttaactggcctccactcaatgggaaactgactcgcctgtgaaagacacagtgggagagctgaaaatgaatcagaagctttatgtatatgattttt

SEQ ID NO: 4417 - DNA, 577 bp, Homo sapiens
ccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggagccgaatatacaatttatgtcattgccctgaagaataatcagaagagcgagcccctgattggaaggaaaaagacagttcaaaggacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacagg

SEQ ID NO: 4418 - DNA, 472 bp, Homo sapiens
  misc_feature (1)...(472): n = g, a, c or t
ccagggagcagcacgatccgtgtgaactgagttgggccctgggcagccagagccacacattccctctccatgggcctctgctgagacctatagggcttcacatgcatgcagtgcagtcccagggccagcagcatcancatcccctgggaacatgttanaatggcagtctcaggctctacacagacccactgaatcagtatctgtattttcacaggatcctcaggtgatccacaagcacatgaaagtgtgagaagcccttcctcttgctgaacagtttcctcatncaanctccttctcttccgntgtntcttagggaagccagaatacctcccggatttcctagggagtgcactggattttatgccagtttgattacccacagttttcttcctcattcattcattcattcagtcagtcagtcaaatagtaattgagcacctcctgtgttccagtatgtgttctgtctgcaccc

SEQ ID NO: 4419 - DNA, 432 bp, Homo sapiens
  misc_feature (1)...(432): n = g, a, c or t
aaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaanaaatcatttgccttgtcctcacggaatctgattaagccctggcctcttgattgtatagagtcattgngtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaa

SEQ ID NO: 4420 - DNA, 284 bp, Homo sapiens
ctttctattagctcttagtaagattacacatgcaagcatccccgttccagtgagttcaccctctaaatcaccacgatcaaaaggggcaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgtttt

SEQ ID NO: 4421 - DNA, 321 bp, Homo sapiens
ctggcttccgagaggcaattctgtccttggaagccaggtttgaccatctgtaatcagccttgtgagaagtctcgtttgagggggccagggatggaacgggagggcgcatatcgtatgaggtatgggcattgtgttaagctgggggaagttgcagcttgtcctgaattacatggagaggaataaagtgggtgagtaggaggagccatttcatctgaaagcctgaggcccctctggtcccctcgataaaccccactggtgtcccaggccacaggtaacaggagaatagacatttaatgtcacagaatgtcagagcaggcaagg

SEQ ID NO: 4422 - DNA, 322 bp, Homo sapiens
ctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagagtttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatctttt

SEQ ID NO: 4423 - DNA, 456 bp, Homo sapiens
  misc_feature (1)...(456): n = g, a, c or t
cctctgcgattttgaaggacaactgctgctaaggagtctatctgtgattggagggttgaaacagtattaggtaagtcttccaaactgtttgtaagatcttgtgagagggagcaatagtacatgagggaagtagaaagcccgaccactccggttccaactgcagtagtcattcctagtcgtactaggatgggtattaactgaacggccctgcattggcacacttgagtttttacagggataggtaggttttgtttcctgggacaatgtcgatttttgggcttagaaaaaccagagtacaggtaccagtccagttgatagggtancagaggtaggtggaggtaccgcacaggaagaatatgccttggctaggtaagtaaaattggttgtgtatgttaaaaagatgtgtaagcttgnggtctttgtatatccatgctcctagggtgcttgctaaggcag

SEQ ID NO: 4424 - DNA, 312 bp, Homo sapiens
ccagtcctggtgtctgagtgattcccagggcccagcaaagggaccaagtttccaggtcagcgacattggatgccttccctctgcctctgggagctatgggttggcatgcattggggtagagatccaatctggcctgaggctcactcaggacttcggggtgagaggaggggaggagctgagctgccttggctaatggggttgaaatttctgatcttaaactctccactgaatattctctcagagccctgaagacaaggggtaacaccccaaaatatggactcattttccactccaccttcattggccgagcag

SEQ ID NO: 4425 - DNA, 161 bp, Homo sapiens
  misc_feature (1)...(161): n = g, a, c or t
cctatggaggtgcctatgatgtcatgagctctaagcacctttgnggtgataccaactatgcctggcccaccgnaganattgcagtcatgggagcaaagggcgctgtggagatcatcttcaaagggcatgagaatgtggaagctgctcaggcanagtacatc

SEQ ID NO: 4426 - DNA, 183 bp, Homo sapiens
  misc_feature (1)...(183): n = g, a, c or t
taactcaaaagctaataattaaaaatggaaccangtgagcagngcctnanatacntgcaaaacctntctgcacaaatgtgctccctgccntanaagacaaaanggatnggaatggagaagcctacaaccacccacgggtcctgacaaggctgacgggtggtaatcncaccttggaggcnangc

SEQ ID NO: 4427 - DNA, 145 bp, Homo sapiens
  misc_feature (1)...(145): n = g, a, c or t
ccagcatcacatccctctcctcattgngctcatccttgacnatgaagatcatgtcgaagcgcgacaagatggtgggcactggagtcaatgtngtcctcccccttcgnctcaccccngcggccgaacactganttggcagcngcca

SEQ ID NO: 4428 - DNA, 192 bp, Homo sapiens
ccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggttt

SEQ ID NO: 4429 - DNA, 612 bp, Homo sapiens
  misc_feature (1)...(612): n = g, a, c or t
aaacaaacactaggaatgtgctagttagggggagagataacgaggtggccacagaaatatccatcaagtagaataatctacatgcaaagactcatggtgagactgcattgttactgcaccaaagttaaagccatagctctcagagtgttctgccactgcttacctctttcttggcctgtttgatgtctccctcatccttgatgcctagtcctgaggtggaggccttctcagcctccattcggcttcccccagcccggccctccccaccttcattagtcttgaaggatgaatggctatcagagtcagcaaaaccaccttcactgacactattgcagctcaaccatgaggccaccttgttcttgggtgtctcttcggaggaaggtggattgcagccacctacagggattgagggaggaacaggaatatgtgggggtccaagatctggggggtgggagtccttggaagttgtctcagagagtccgttctctttctggccccgggtctgcctccgggtagcatagctccgccacactgaactggtgctgaagtcctcatccttacagaagttatcatctgagctatcatcattggactcttcagggtcctctgtnc

SEQ ID NO: 4430 - DNA, 411 bp, Homo sapiens
ccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtgg

SEQ ID NO: 4431 - DNA, 518 bp, Homo sapiens
  misc_feature (1)...(518): n = g, a, c or t
aaaccaagaagaagagaagagaagaaatgccaatatattaaatgaaaaaattagggaagaattaggaaaaatcgaagagcaacaaaagaaaaagttagaagtgaagcaacttgaactcactctccgaatatacaaaatatggaattgaagactgtaagaagtaatttgaatcagctcaatcaatcgctggtaaaaattttatatttctaactttatttcatcaatattacttttaatatcccttcnatttantatgtattattcagaattatgataatgccgctataatatttaggtacaaacttttgtatatttcattcataagttttcatttctttcgggtatgtacctaggaatggaattgctgggtcataaggtacctatgcataaccttttcagcaatcacctcacagttttccaatgtgtgcactattttacttccccaccagcgatgtatgaaagatctaatttctctacggcctcaccagggtggagtgcggtggcgcactctcagctca

SEQ ID NO: 4432 - DNA, 427 bp, Homo sapiens
aaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactctaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgattt

SEQ ID NO: 4433 - DNA, 351 bp, Homo sapiens
aaaaaataacttaagaagcaagaggtccggccctttacttgtataaatacagcagcagaactagagtttcttaagacaacgtggagaagagtctgtgtttagcacctcaatcatcgatcttaacgttggaaacgtttctgatactgatggaagagtcttataagaaggtgaaatacttttcaagttcatccagcttttggcgactttgctaaaggaaagctcaaagtcaaaagttaatccatcttcaaagctggtaaaaatttatcaaactctttctctaggttaggcaaaaatgcatgcatagaacccataaattcagacttttcacagttttcggtacacctgtgcttt

SEQ ID NO: 4434 - DNA, 614 bp, Homo sapiens
cctttatatgtaaataacaaaatagtgattttaattcatatagatgtatttgtttatctaagtatgcttttatactccctgctatatttttgtatcaattaagtgtgcctggcagcatgaagaaagtcagtacaacaatggtttctctctgttgtgtaaaactgaagttggaagtgggtaacccgacaatggcacagcagcttcacaagatcctgagggatcagcctcctcctttcgtgctgcctcactaccctcagtccttggcttctgcctcagagtctaagatggctactttagatccaggcaccaagccctcatcattacatcatctcattccaagaaaaaaaaagaagcaatgacaagtattccctctccctgtaaagacaccccctagaagtccaaagtaacatttctctttccattctttgttacgaatgagactggaaaatacagtgtgtatttgggaggctgtatgcctagctaaaaatcaggaggcttattactaactaagaaggaagaatgtgatactgaaggtcaactggcaggttttgccacagtgtaaaaatcaggatttcatagatatacagaatttttgaataagtgactttacctcg

SEQ ID NO: 4435 - DNA, 560 bp, Homo sapiens
  misc_feature (1)...(560): n = g, a, c or t
ccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggttngccnaaaggaagaagtttaagcggcctccacagaggctgtttgatgctgagaagatcaggtccctggggggtgatgttgcctctgatggtgacttcctcatctttgaggggaaccgttacagccggaagggctttctgttcangagcttngccatgtctgctgtgancacggagggtgtgaagccaacactctctgagctggaaaagtttgaggaccagccanagggcattgacctggaggtggtgactgagagcacagggaaggagcgggagcacaacttncaacctggggacaacgtggaggtctgtgagggtgagctcatcaacctgcagggcaagatcctcancgtggatggcaacaagatcaccatcatgcccaagcatgaggacctc

SEQ ID NO: 4436 - DNA, 144 bp, Homo sapiens
  misc_feature (1)...(144): n = g, a, c or t
aaatcataggggaaaagcagtcctgttctaaatcctcttattcttttggtttgtcacaaagaaggaactaagaagcaggacagaggcaacgtggagaggctgaaaacagtgcagagacgtttgncaatgagtcantagcacaaa

SEQ ID NO: 4437 - DNA, 526 bp, Homo sapiens
aaagagatatcaaaagtccctattttcatgagttccacatcacatattttgtgctttctttgaatagccaaaaaattttcttggggaaaatacgagagtaaaaccagagctaaggagctataagaatttggaatggcttcttgaaatcatgccgctccaagtatgtcataacctcgatcactcaaaaatacataactcccaaaccaagaatttctgagggcaaaagcacaccagcgtgtataggaaaggcaggggaagggatggaagggagagaaagagggaacaatgtagatttcctgttttataccaggaaaactaggccaaactcaatttaaatgaatagctccaaagcagtgcagtcagaaaaagttctcagtgtgacatagacttcagggaaacaacacgtcctgaaagaaacatgattcccctcaagccacaaaggattttctcatcaagtgttttcacctctgcattagatttggacacaagaagaggagagcatttactcaggtaaaaatagttctct

SEQ ID NO: 4438 - DNA, 560 bp, Homo sapiens
  misc_feature (1)...(560): n = g, a, c or t
ccaccagagaaatgcgaatcaaaaccacagtgagataccatctcacaccagttagaatggcaatcattaaaaagtcaggaaacaacaggtgctggagaggatgtggagaaatgggaacactttgacactgttggtgggactgtaaactagttcaaccattgtggaagtcagtgtggcgattcctcagggatctagaactagaaataccatttgacccagccatcccattactgtgtatatacctaaaggattataaatcatgctgctataaagacacatgcacacgtatgtttattgcggnactattcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcaaactatcacaaggacaaaaaaccaaacaccacatgttctgactcataggtgggaattgaacaatgagaacatatggacacaggaagggg

SEQ ID NO: 4439 - DNA, 212 bp, Homo sapiens; identical to SEQ ID NO: 2921

SEQ ID NO: 4440 - DNA, 522 bp, Homo sapiens
  misc_feature (1)...(522): n = g, a, c or t
aaaaataattatttttttaattgacagataacaattgtacatactcatggagtacatagtgatattttgatacctataatatatagtgatcagatcagggtaattggcatagccatcatctnaaacacttatnatttcttcgagttgggaacattcttgacttngggttattgaactttgnaaatnccatgtgattgacctaagttatgtnctatgtcaggtcctgatgattcaaggtcagaagtagtttgatgtcagggagtttaatgctgcccagcatgggtagaataaccttgttgcattacatgaccctatttccctgaccagagcagattgatcagggctggagttgggtcccaagctaagcttgtcatattttctctttcttgggaattgtgatngagnctaaaacagtttaattggtttgagataattacatgacctgaggcannanattgcaaactggtggcccatgggctgaagctggttcataaataagttgattctattttttttgccttt

SEQ ID NO: 4441 - DNA, 352 bp, Homo sapiens
  misc_feature (1)...(352): n = g, a, c or t
aaaatattagcgaagctatcaaggggaaaaaaacacattttggcttaagtaaactacaaaaagccacaaatgctttgcaaactctgtcttaccttttatatgaaaataagcaaaatgtaatgtacatatttttatatttttatttaataagagatgcagacccanatttatttatttatttaattaaatatgttagccctccaactccacatttttttttaataggtatggtcctcttttaatggtctctgatcctttttaatgagtgccatacgccaatgatntgcctgcaggtttgtgagcattcttgggatgtcaggtgacctggtgtgttcctaacatttaccaatgg

SEQ ID NO: 4442 - DNA, 348 bp, Homo sapiens
ccttcagaagttaaacgtgatcacttgtgctgggacagccaatagaggagtctgagatgatcatttccaaggagttcttcacagaggaggtagctttggagctgggctttgaggttgggcagtatttgaaacagtagagacggagcaaagaacccctgggcagaggaaacagtaagtgcaaggcataaagtgaaggtggagggtgttaccgcggggtgcactggttgcattacctcctggtggggtcagtcattcgctttcttttcctcctcaggaccagggctctttgaagatgaagaatgcccacaagggaacacaggcagaagatcagataagccaaagtcacag

SEQ ID NO: 4443 - DNA, 505 bp, Homo sapiens
ccacgttcctggccgaggacccgaaggttaccctgaccatcttcgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggttccacataaacacggtttccttgaaggccgccatgcagagctgtgcttcctggacgtgattcccttttggaagctggacct

SEQ ID NO: 4444 - DNA, 449 bp, Homo sapiens
aaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatacatttgtaactttgtagctatctttgaaatcacttgactttgcaatggtgctaagctgatagattt

SEQ ID NO: 4445 - DNA, 478 bp, Homo sapiens
  misc_feature (1)...(478): n = g, a, c or t
cctgtgaggtgcagagtgcccagaactggactcaggatgcccagggccactctgcctctgccggcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactnncctgcactggagtccagtctcttctgctggcagaaagcaaatgtgacctgtgtcactacgnnactgtggcacacgccttgttcttgg

SEQ ID NO: 4446 - DNA, 375 bp, Homo sapiens
gtcaggacacagcatggacatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 4447 - DNA, 407 bp, Homo sapiens
ctgcttcctgtctgtgacacctgggaagacacagtttgggcctacttccgggtgatggtggacagtctggtagaacaagagatccagacatcagtagtaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttctatactctgggactacagaccaaggaggaagtttctattgaagtttt

SEQ ID NO: 4448 - DNA, 481 bp, Homo sapiens
aaaataattactctcacacataattttttttatcatgtaaattctaaacaaacttctgaaggtataattacacaaattcttagcgatcacaaaagtagatgattgggctactgtgtcatttttctaactgtgttttgtcgataatatgcaaaatttaggaataatgtagaaaaatgatgtatttcaatacagcttacaaatgaaacttttttggcttcacaaagacatacttattatcataactgatacaattttcatactacagtgctcttttgctttataaatactcaagttattttgtgcgctgcttcaaattttacttttgtgcgtcgccttccatccccttagtacatcttatagtagctgtaagttgatcctgtgtttcttgaagctaaaacaaagaattaaaaaaaattacatttagaaatgacctaaatgtccatcagtagatgaatgaatcaacaaaatatatataaaatat

SEQ ID NO: 4449 - DNA, 501 bp, Homo sapiens
  misc_feature (1)...(501): n = g, a, c or t
tgcctcaaatcgtcgtagtgggaacgcanagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaanattttttcacccaacgttgtnaatttgacacttgtggatttgccaggaatgaccaaggtgcctgtaggtgatcaacctaaggatattgagcttcaaatcananagctcattcttcggttcatcagtaatcctaatttccattatcctcnnctgtcactgctgctaatacagatat

SEQ ID NO: 4450 - DNA, 302 bp, Homo sapiens
aaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttattt

SEQ ID NO: 4451 - DNA, 581 bp, Homo sapiens
aaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttac

SEQ ID NO: 4452 - DNA, 467 bp, Homo sapiens
aaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgattc

SEQ ID NO: 4453 - DNA, 519 bp, Homo sapiens
ctgtgggcccccactctccacctgctctcctgctcaggttggggcagccaaagaccttctcttcctggggagagaggttagggagggaccattttttgattatttgagggtgtggttcagttgtaaacagtgtaaattttagaatttgtgttattgtgatggcaatgaccaactgcaaaatatttcccatttgccttgtaataacaagagcatgtactttacgcaattgaagtttttggaccctacttatttactttactttattaagaatagtaacatttgagcagagaagagttctaattttgcatcagagccaaaagtgaaaatgaaaggaactgacccatgaaggaacaggtgtgagctatttacttcattcctgcccatcctggttgatgttgagctcttgccctgcatcccactttcaaatgtggtggatgcctcacctaggaaaggccctcaccacgctggcttgctctgctcactaactgtacttacttctcttaatcccctatgaacact

SEQ ID NO: 4454 - DNA, 332 bp, Homo sapiens
aaatagaaaacagtatattgaaagtggtgggtttgatctttttatttagaaacccacaaaatcagaaacacagtacaaataaaacagaaatcaaactataagctgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttcttt

SEQ ID NO: 4455 - DNA, 237 bp, Homo sapiens
ccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcag

SEQ ID NO: 4456 - DNA, 451 bp, Homo sapiens
ccacacaggcaggcgccttccagtcttacaggtacatgtgaatatagggctctttcctcagctccatatgcaatagtcagcttaaactctagctctgactaatcctctaggagtaggtagtaacattttccactagtctcctgaggatggtttgatgtctctggagttgagtctatctcgagctagcaggttggcccctatgtaacatcttcactgtggaaagtgaagtccacaattccctgggaaaggatggaactgatttatgcagtccatgccccaccttttcttctacctccgccgcaactgaaatcccctttctgtggaattcactgcaaagctatgaagaaaacagaagcaaggacatctgattcctagggaggtctaatttttttaggctaaactactgcaattttctgtgtactgccatcagttatgaaaaagtttttttttt

SEQ ID NO: 4457 - DNA, 329 bp, Homo sapiens
  misc_feature (1)...(329): n = g, a, c or t
cctgaggtctgcggaaggtgggaggaggcagacaccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccanatttttacagaggatacatctatttttatcattatttggggtttgaaaaatttttttttacaccttctaatttctttatttctcaaagcagataattcttctgtgtgaaaatgttttctttttttaatttaaggttt

SEQ ID NO: 4458 - DNA, 517 bp, Homo sapiens
ccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggag

SEQ ID NO: 4459 - DNA, 474 bp, Homo sapiens
aaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttattttttcatttctgtcatgaaatcattccagatacctcttttcttctttccaaacggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtagatttgtgactgtgagagtttccggttt

SEQ ID NO: 4460 - DNA, 625 bp, Homo sapiens
aaatagcaacaattcacttgttcttttctattttatggacttatacatttcaaatatgaccatgttaacaaccaagtatgtacaatatttttaaggacaaaaataacaattatatacagtttgcaaagatcaaattctaaccatggacacctttcatctagtccaatgactgaagcctgtccaacgccagtaactcccagggactaaggccaaatgaagcctcaatgctgtatttacctttttcctttcacatgctttttcttaaagaaacatttacaatttacctgctttgaaactgtcaatagctatattaataatgttttgtgccacaaatcaaagtcctttcctactcaaaagctactgttaattgaaggcaatgttaccattgagatcaaattcagatgtctagatcccagatacctgggtatgaaatatgcaaatctgccaagagaaattagatatttttcttcttttcttttaatataacccactatataatagtgaactaaatatgtttgtttcatagaaacaacttacatttgccaatataaggcaaatggtctatgtacagatacatcaggactgcctaactgacagtgagtgttgctagccaggctccaagcta

SEQ ID NO: 4461 - DNA, 526 bp, Homo sapiens
  misc_feature (1)...(526): n = g, a, c or t
ctgaggactcagagcaggagtaagggcacccctatcctccccatggctttgaaaagaagaaagaggggaaatttggagggatggtcaagttgatgattgaagagacaaagtagtgtaggaaaatctcaatgtttcttgcacagtcatttgttgaaaatgtgtcagcaagtacaagcccatcttaaactggcaatgagacatctgaaatagattatttaggccagggaggcagtattgcaaagaagaacatggctatcaacacttgtttgtctgactcagaggaataaaacatagtaaattttgccttagcgggccacccacattcattgggggaagaaacaattgaggtggggggaaaacagaacagatgaaccttcatggagtttcacaagagtccacatggttgtgtcccttattttcagaaaatgtgaaattggaaaatacgcacttgtgaaagctgaagatgtcacagaaatcttcagaggatttatttagatggncgtatcctccgctgncaactggatga

SEQ ID NO: 4462 - DNA, 392 bp, Homo sapiens
  misc_feature (1)...(392): n = g, a, c or t
aaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttanaaatctacanaagtataggggagccagatagtttgtatggctgtggnggagggaagatgttacaacccattactagactacgaacatatgaacacgaagcaatgtggggcaaagccctagtaacatatgacctcgaaacagcaatcccctcatcaacacgccaggcaggaatcattcagg

SEQ ID NO: 4463 - DNA, 563 bp, Homo sapiens
aaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttca

SEQ ID NO: 4464 - DNA, 174 bp, Homo sapiens
ctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccagg

SEQ ID NO: 4465 - DNA, 239 bp, Homo sapiens
cctcgccagcctcagtcaaatgtaacgttcctaggccaagccacgaattgcccaactgggtggtccggctgccctgctatctcacttgtttgtgtgcttattgtcaactctacctatgaggagtgagctcctaaaagcagagattcggccagcgcaggtagctcacacctgtaatcccagcactttgggaggatgaggcgggcggatcacctgagctcaggagttcaagaccagcctgg

SEQ ID NO: 4466 - DNA, 447 bp, Homo sapiens
ctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttcttttt

SEQ ID NO: 4467 - DNA, 195 bp, Homo sapiens
  misc_feature (1)...(195): n = g, a, c or t
aaaagccgaggcacaggtatagctgggcacctggaagaagctctgccaaatggaatcctccttggcaggagtggtantgctaaggcgagcagagtgggctacangcaggtcctgcaggccctgggtagagctcatcctctgtctgtccattcctcccanaccccancgtggnggagnagacacaggcatagnaaa

SEQ ID NO: 4468 - DNA, 401 bp, Homo sapiens
aaagagttaaaagaaaagaagttaagaaaagaaaaaaacgtattttcttctgttcatttttatgagtacaggcaaagaataaaatatcccatgtacctctacaggatttagagttctggaatgctaaaaggcaacattttcctaacagccacaaactgaccattactgaccaatagagttataaggggaggtgtggctcagctcccaatataaagcaaaatcaacctttattaagtccgtatcagatgacctcctggtattcacataatataggcaacaggattttgaaatgacctacccctcattactattcactgatgctatgtataaaataagtcgactaactcttttctagatacacgttggttggaaacaaaaggttgtctgtatacaattttttt

SEQ ID NO: 4469 - DNA, 456 bp, Homo sapiens
ccaataaataggtcaaaataattcaaaagaattataaatgaaaaaaatataaattaaaaattaaccagaaacatacattttcaaattttggtgaatgtcataataaaggtcaacaaaggggaaagtgaggtaagttgtgtcacaactattatatataaaagaataatatgtaactactagaaaactattagcattataataaaatagtaactgtgttaaaactttaattcaaaaagttagtttcacagtcatttctactatgtaaaaatatacacaataaaaaacaaaaaactagcaagaaatttagacctaaagaagcttcagagatgcctcagaggtctcctcaattcccctagaaattaatctaatgcttttacaaacaaacagcacacacttttatttcagagattacatgaagggtgtgtgccagggacagtctggaaccggcctcctcac

SEQ ID NO: 4470 - DNA, 461 bp, Homo sapiens
ctgccccaggactgagtcaggccccgccttcactttctctttcttctcagtgctgcccttggagccctcgcagcccttcctcttcgagtcactcttcttgccctttgctctcctcccagaccgctctcgacacagatcctgttcaataagtttcatctgcaggtggaatatctgctcctggagtttgcagatggcgtgtttcgttctctcgcgccttgtcaccatgtagcacagatttctaaccctctctaggtcctgccgcagatgggtgaagagcttcaggcggcggtagaggacgtcctgctcctgctgggccaggttgtccacctcgtcggtcttgggggtcagcagcggctggttggcattggctttcctcttcagcttccagtactggtagatgaagtcgaccagtgcctcagccaggtccagccgctcagccacctcagccggctccaccagct

SEQ ID NO: 4471 - DNA, 316 bp, Homo sapiens
ccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacagg

SEQ ID NO: 4472 - DNA, 402 bp, Homo sapiens
  misc_feature (1)...(402): n = g, a, c or t
aaaaattgactttaatactttatgcaaatantgcctgtcccaaattctagcatgcacatggatctaccaacaaaaaaactaagttttcagtgngtgaacataaacttcaaattaaacctctgatgctttagcccatgtatcaattaccaacagattttcttcatcaatgtctgcagaccacattcatgatttctatnagacagaaatngagcagataaactatactgtatatgctgagnacanaatttgtgggaacataatgctgcaaatgaaagctacaaacactctgtaaatagnttanaaaaactagtnatngaaatcaccaaagtnccagctnataacggngttataagagtncactgttaactgaaaatgaaaaaaatnaatgtnttttttgagaca

SEQ ID NO: 4473 - DNA, 450 bp, Homo sapiens
  misc_feature (1)...(450): n = g, a, c or t
aaatttttcatattttttgaaaattaacatatatttattacagtgccaaatctcatgagtccctgtctcataatctaagaccaggctactctgaaagaggacagagttcactgcctaatccaacactggctgtagtgtaaatgcaacacaggtgatttttgccccagttccaaggctacctaactagctatgtgggccttagtcacccttaaaggaagatggttgcaactatgccagttagaacatttttctgctctgcttccacagtggcactcacaagaggaggacttgattttatagcttgtgtacaggagaatataaagttggcttcaaaggaggtaggataggtttggcatttttctcctcataatgtttcctaaagcatgaaaggatccttgatcagaagagtgctcagttctaatttctaaaatttgctggctnaatattttt

SEQ ID NO: 4474 - DNA, 502 bp, Homo sapiens
  misc_feature (1)...(502): n = g, a, c or t
ctgtaaactgagaatgcagagctgaatagaacatgacatagctctgaaagccctgttgtgcctgaaaggatgaggcaggatcatgcatttgtttattgccaggcccctttcccctcanccatttcaattgccagaggaaggaatcagaggagctattctccctccatctttctccttcatcagtttctggttgatacctgagacaggtctaacatgagctaactttcanagtcagaaggtagcaaagaccatctctcattanacaaaagccaacctgccctagcantcccggtggtcacacctggaagccaagaataccanatgtctagttctcccactctaacaccttacatctgaaaaagaggggagagctgagcttcnanttgccccanatgacatatctggacagttgtgccttgagcatcanangaccttcctctccactctggctctctcttctntttctttctcanatccttggctggngggangccataaacac

SEQ ID NO: 4475 - DNA, 227 bp, Homo sapiens
  misc_feature (1)...(227): n = g, a, c or t
ttgcaaagnttctaacagcnacatagagtccatgtgatcagtagtggattcttgtcntgatgccagggtctnaccgcctaaagctggatcaaggcccttgctctncaaaattgccaancagttgncccgaaacttctccagcanctctaccttctgggtcaggtccttcagctctccctgagttncantcaacttctggtgcanctgcttgttgacggnntctaaca

SEQ ID NO: 4476 - DNA, 581 bp, Homo sapiens
ctgtctgctcctggcaccagcgtagcagctcctcctgggtgcctgccgacccggtggctggcatccctgtatctgtcttgtcgttgttcctctgcacaggctccttggctagcacatcatacaggtctcgtacctgattgggggtcactgcccggaggttcaggttggggtagcgggtggctgggtccagcccatactgggccacattgcgatgcatgttttctggggatgtctgtgacagaagctggtacaggctctcacgctcagccaacacctctagggactcagcgccctctgcccaccgcttcaccatccaggctgcatcaaaggctgccaggaagccccgtgccactccagtgcccaggggccagaagggctccaccaggcagtcccccaccagtcccagcagcaggcgggcgccatgcttctcttgcacacgagcagaactctctgcccgcatcatgctcgtgaagtcaaaggcagagacatcaggctgcccatgggcatcctgggcaaactctagtttcccgagcttgccatgggtggcaaagtcagcagtcttgatctcttgacctcatgac

SEQ ID NO: 4477 - DNA, 308 bp, Homo sapiens
aaatgattctttatttcaataaactttaacaaacaatatataatatttcttccttaaaaagctcattcaaagatcataggcagacttcttccccattgtattttagttggggagataaaggcaaaaagaggaaatgtaagctatcttacagtcattctgagaacctctggtttcatgctatactttcccagctaaaagttactaatttacgaagttcagatactgaaacttaaaaatcaagatccatatattagaatgtcctgctgtcacactggtggtggcccattgtgtcggagtctggtaaatgg

SEQ ID NO: 4478 - DNA, 481 bp, Homo sapiens
  misc_feature (1)...(481): n = g, a, c or t
aaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaaagtgccaggctctctanagaaaaatgtgaagagatgctccaggccaatgagaagaattagacaagaaatacacagatgtgccagacttctgagaagcacctgccggcaacagcttccttctttgagcttaggtgagcaggattctggggtttgggatttctagtgatggttatggaaagggtgactgngcctgggacaaagcgaggncccaaggggacagcctgaactccctgntcatagtagtgg

SEQ ID NO: 4479 - DNA, 338 bp, Homo sapiens
  misc_feature (1)...(338): n = g, a, c or t
ctgatgcctcactactagatgcagtgntgggaccttcctcttttggagctgtcccatgtacagtggacccaagctcaggaccttcgtggagctgcttctccaacctgagaaactcaagacccatcctcccgctgtcactttggacaatggaaatctacattttcttttcccttttttttttttttgagacagagtctcgctctgtcacccaggctggagtccagtggcacaatcttggctcactgcaacctntgcttcccgagttcaagcaantntcctgcctnagcctcctgagtagctgggattataggcatgcaccaccacacccagctattttt

SEQ ID NO: 4480 - DNA, 540 bp, Homo sapiens
aaaagttaggtgctctttgtatgcgaggattgggattgttaggggcctgtgttcgtgatgatcaccatcatggagtcatttcttgttgggaattgttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccaccca

SEQ ID NO: 4481 - DNA, 507 bp, Homo sapiens
  misc_feature (1)...(507): n = g, a, c or t
tcanccatttataaagaaacaacntacaangaangctganctgaggaatgcanatgtntacngtaagaaggaacananaatgtaattcancantcctaaggcaaacaattaatnagaaaaatacatttactgtnantgaaaaatacaaatggnaatccatacttnatggaactacnggcttcttccatggggaaaatggacttaacattnanatgttgacaatttcggaangcagnttatattgncatctacaatctgaactgaaactcagaaatccangggatgcatggncaggaaataaaattcttcaacttattttttnttggagaatntaatgagattttataatgcaaactgtatgaagactgcttgatgacttgagcagtgttcagatcacagcatacatattcaaatgattttaatatttggaaagactgtcagagggttgngtccgtgtaaaaaaaaaaattggtaatatgaaacaaaaaaagcnaatgaagaganaaa

SEQ ID NO: 4482 - DNA, 242 bp, Homo sapiens
cctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctgggcaacattgtg

SEQ ID NO: 4483 - DNA, 253 bp, Homo sapiens
  misc_feature (1)...(253): n = g, a, c or t
ctgtacccattgcaggacattctcactggagatcagcttctttttgaatacaagccanaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccag

SEQ ID NO: 4484 - DNA, 445 bp, Homo sapiens
ctgccgccgtggaatccaaaatttcgggagctgtgaccctttcctcatgtaaaacgagtagtcttggacgatctgggcataggaaccaatcagaaacaatcgcttcagcaatcaagaccattgttcatcatgggggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcgtgacttcagttaatggaaagaacaaaactaaaatgctgtatgg

SEQ ID NO: 4485 - DNA, 107 bp, Homo sapiens
  misc_feature (1)...(107): n = g, a, c or t
aaatcacagnttttacctatttgntaggctatanngttttgtaaacttctgttnctattcacatnttntccacttgngagagncaccaaaatccantcagtntctaa

SEQ ID NO: 4486 - DNA, 373 bp, Homo sapiens; identical to SEQ ID NO: 142

SEQ ID NO: 4487 - DNA, 214 bp, Homo sapiens
aaaaagtttatatgaatatccagtcaaaaccaacacggtattgcccttgaaatgttaactagacggatttccaaggagaccacaggactgtatactgtcttggaatgtcctcagaaggctctgtcattgatcaggtaacagtaaaaaccccagagtcctttctttcaaatggaaaagggaaagcagagggacagaagctattcaaacttcgtct

SEQ ID NO: 4488 - DNA, 548 bp, Homo sapiens
  misc_feature (1)...(548): n = g, a, c or t
ccatcaccatgtcacccacaccagcagngggaagtctgttcagccgtcccttgatccccttcacggagatgatatacangnttttggctnctgtgtngtcagcacanttgattacagntnctaccggaagacccaaggaaatccggaatttcgcaccanaggacccaccacgtnctcgcttngncatcttgaacgccngaaaaaanaaaaaaggaagtcgattcaaaggacactgggntatgaactttaacgccccgcccaccctcctnacgtggccggagcaaaaaccggcctcttccgcctctgggcgctgncttattacgtaataagtttacgacgtcgcttttagccctctctgcgaagtgggagttgaagtagaagcgcaagagataggaagtatcttntctacgagcttaagagtagttagggacatggaaacagtgatttgttaacttgctcacgacctcttttgaccacttaatagtgccaggcacttatctgnacactagagaataggaattaaaacacggtttgtgccgtgtgggggt

SEQ ID NO: 4489 - DNA, 567 bp, Homo sapiens
  misc_feature (1)...(567): n = g, a, c or t
gaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttnacatgtcacctaaatgcac

SEQ ID NO: 4490 - DNA, 556 bp, Homo sapiens
aaacatctaaaatacactgaaaatgtgttcttttccaataacatggatgttcacaacagttggtgttacgttagagctaataattatactttagcacgttaacctcagaattctaaggctgagagtcaaacactgctaattcatagaaggcaatagcttgtaataatgaatcataaagctcttctactctttgtagttcagtagataaaaacatctgtctgtagtgaactattttatctgatgggaagaacacccgaggatccgccttcagtatagaatcgaagagaaactgcttcactagctcttttccactagtccgggagtcaccaatcatcagttcaaaatgcttccccactgcatttcgattcatgctcagcacctgatgctgcccatcctgggcaaaagttttatttaataaggcatacagcatggcttccatgatatgaaaatgtaacagtattggaaacagagatgagttctgaatggaaagtcctgttttttccagaacatagaaatctgctttaggcatctttgaaatgatcgaggaaatcttttt

SEQ ID NO: 4491 - DNA, 473 bp, Homo sapiens
  misc_feature (1)...(473): n = g, a, c or t
ccttgcctcanatccaaggtcactcggaagaggccatgtctaccctcaatgacactcatggaggaaatgctgagagaagcattcanatgcatgacacaaggtaagactgccaaaaatcttgttcttgctctcctcattttgntatttgntttatttttaggagttttgagagcaaaatgacaacacccanaaattcagtaaatgggactttcccggcagagccaatgaaaggccctattgctatgcaatctggtccaaaaccactcttcangaggatgtcttcactggtgggccccacncaaagcttcttcatgagggaatctaagactttgggggctgtccagattatgaatgggctcttncacattgccctggggggtcttctgatgatcccagcagggatctatgcacccatctgtgtgactgtgtggnaccctctctggggaggcattatgtatattatttccggatca

SEQ ID NO: 4492 - DNA, 415 bp, Homo sapiens
  misc_feature (1)...(415): n = g, a, c or t
aaatgaatttgacactctacaagacagagatttctttctccagttaaacctcagaaggtaagtcagctagtacaaaaagtattctatatactagtatatcatacctcagactgcagagctcttgttctcttttaacttttcgattctctatgattttatttcttttggttctgatagttcattttgtagtacacgaagcttatttttcatttgtttcatttttgctgtaagttgttcacagggatttttttttcttttttttttttttttgacggagtcttgctctgttgcctaggctggagtgcagtggtgcgatctccactcactgcaagctccgcctcccgggctcacgccattcccccgcctnancctcccgagcagccgggaccacagtcacctgccaccacgcccggcc

SEQ ID NO: 4493 - DNA, 197 bp, Homo sapiens
aaaaatgtctatgaaaattgacactggaaaaaactgtttatctctaggtcttgttttgaaaggattgttgatgagtctacttgcttttcctagttaagacactagcaatggtttctacagtatttctctatatgttgttttcaggttttagaaagggggatgatcttttcaggtatcaaagtggtaaaagcagtatt

SEQ ID NO: 4494 - DNA, 413 bp, Homo sapiens
ctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctcc

SEQ ID NO: 4495 - DNA, 544 bp, Homo sapiens
ctgaattccccaggatagattatgagatgctggaacattactgtaacgctggctttgcataaagatgggtcttgtcccattccttcaccagtaagctcttgtgggctgaacattgcaacaacagagctctcttcggttccaacgtgcgcgtaaatcctgcagacaggagcccaataagacattaggtcaactcagggcatttcgaaaacgctattttctgaacagacggctaagcaagaggcttgcagggcccatctcctcagagttatttatcctcacggagctcagtacaggtctgtgaaaaggtcctcatcataggaagggggacctacacggcccgccatcgccattttgtccttcacaaagccccactgctacttttaagcctcgaggccacgcacaagaccttatccgccagtcgccctggccaggcagctacaacacagaaggcatagtgcgtgctatgctatgttcgcacaatcgctcaaaagaaaataaaagaaaaagcttgtacaaaagagtaacagctataaagacacctcgg

SEQ ID NO: 4496 - DNA, 386 bp, Homo sapiens
ccttttttaagtgacctgtaactcatatcagtgaaaaagaacatgctataaaaagattccacaaagtgagagcattaagctcaaaggtcctgaggtaggtgtgtttgaggagctggtgtgtagctgctgtataagaagtcaacctccttattttcaggtacatttattattattttaaccccaagcagaattgcctagctgggtcctcacctttacacaatagtcataggatttgactgttatcaaaaagtaaatccactctcagaggccatagatttcctattactgaggttcttcaaaagaatatgtaatcaatttatatagtaattcctaaaaatgagattctaaaatatagtagcatgcagatgaagcatagctaatgcttt

SEQ ID NO: 4497 - DNA, 573 bp, Homo sapiens
  misc_feature (1)...(573): n = g, a, c or t
ccttgcctcanatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctccctggggaggcattatgtatattatttccggatcactcctggcagcaacggagaaaaactccaggaagtgtttggtcaaaggaaaaatgataatgaattcattgagcctctttgctgccatttctggaatgattc

SEQ ID NO: 4498 - DNA, 311 bp, Homo sapiens
aaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctga

SEQ ID NO: 4499 - DNA, 437 bp, Homo sapiens
agaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtggaggttgtggggatggggttgcaccactggctttcaggctactttaccacag

SEQ ID NO: 4500 - DNA, 564 bp, Homo sapiens
ccaccagagaaatgcgaatcaaaaccacagtgagataccatctcacaccagttagaatggcaatcattaaaaagtcaggaaacaacaggtgctggagaggatgtggagaaatgggaacactttgacactgttggtgggactgtaaactagttcaaccattgtggaagtcagtgtggcgattcctcagggatctagaactagaaataccatttgacccagccatcccattactgtgtatatacctaaaggattataaatcatgctgctataaagacacatgcacacgtatgtttattgcggtactattcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcaaactatcacaaggacaaaaaaccaaacaccacatgttctgactcataggtgggaattgaacaatgagaacatatggacacagggaaggggaac

SEQ ID NO: 4501 - DNA, 212 bp, Homo sapiens; identical to SEQ ID NO: 2921

SEQ ID NO: 4502 - DNA, 569 bp, Homo sapiens
  misc_feature (1)...(569): n = g, a, c or t
ctgagaggcatctaccttcatggaaacccatttgtctgtgactgttccctgtactccttgctggtcttttggtatcgtaggcactttagctcantgatggattttaagaacnattacacctgtcgcctgtggtctgactccaggcactcgcgtnaggtncttctgntccaggatagctttatgaattgctctgacagcatcatcaatggttcctttcgtgcgcttggctttattcatgaggctcangtcggggaaagactgatggtccactgtgacagcaagacaggtnatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataancaacgcctgttaaatgaaactgnggacgtnacaataaatgtgagcaatttcactgtaagcagatcccatgctcatgaggcatttaacacagcttttaccactcttgctgcttgcgtgacctc

SEQ ID NO: 4503 - DNA, 521 bp, Homo sapiens
aaaaataattatttttttaattgacagataacaattgtacatactcatggagtacatagtgatattttgatacctataatatatagtgatcagatcagggtaattggcatagccatcatctcaaacacttatcatttcttcgagttgggaacattcttgacttggggttattgaactttgaaaatcccatgtgattgacctaagttatgttctatgtcaggtcctgatgattcaaggtcagaagtagtttgatgtcagggagtttaatgctgcccagcatgggtagaataaccttgttgcattacatgaccctatttccctgaccagagcagattgatcagggctggagttgggtcccaagctaagcttgtcatattttctctttcttgggaattgtgatagagtctaaaacagtttaattggtttgagataattacatgacctgaggcagagattgcaaactggtggcccatgggctgaagctggttcataaataagttgattctattttttttgccttt

SEQ ID NO: 4504 - DNA, 553 bp, Homo sapiens
  misc_feature (1)...(553): n = g, a, c or t
ccacgttcctggccgaggacccgaaggttaccctgaccatcttcgttgcccgcctctactacttctgggacccagattaccaggaggcgcttcgcagcctgtgtcanaaaagagacggtccgcgtgccaccatgaagatcatgaattatgacnaatttcagcactgttggagcaagttcgtgtncagccaaanagagctatttgagccttggaataatctgcctaaatattatatattactgcacatcatgctgggggagattctcagacactcgatggatccacccacattcactttcaactttaacaatgaaccttgggtcanangacggcatgagacttacctgtgttatgaggtggagcgcatgcacaatgacacctgggtcctgctgaaccagcgcaggggctttctatgcaaccaggttccacataaacacggtttccttgaaggccgccatgcagagctgtgcttnctggacgtgattcccttttggaagctggacctggaccaggactacagggttacctgcttcacctcctggagcccctgctt

SEQ ID NO: 4505 - DNA, 449 bp, Homo sapiens; identical to SEQ ID NO: 4444

SEQ ID NO: 4506 - DNA, 375 bp, Homo sapiens; identical to SEQ ID NO: 4446

SEQ ID NO: 4507 - DNA, 470 bp, Homo sapiens
ccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagatctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgtttt

SEQ ID NO: 4508 - DNA, 213 bp, Homo sapiens
aaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtatttt

SEQ ID NO: 4509 - DNA, 291 bp, Homo sapiens
  misc_feature (1)...(291): n = g, a, c or t
aaaaagtttctaatattaaagtcagaatattaatacaattaatattaatattaactacagaaaagacaaacagtanagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctca

SEQ ID NO: 4510 - DNA, 564 bp, Homo sapiens
aaacttgatccaacctctttgcatcttacaaagttaaacagctaaaagaagtaaaataagaaggcaatgcttgtggaatgtacagtgcatattggcggcgcacgcctcattacgattcgcctgcttgcttctcctgttcaatcgtttctttggaaggcagtggatttttctcttgcgtctctgtcttcttcagtttcgacttatcgaatttctcgatctcagccatatcgggtttgtcagacatggttgcggaggaaaagctgcagggagcaagccaagagcgagcgtgaggaagagccacccgccccgctgtctctgggctgggaactgcacttctgccctccgacccgcagcctgaaaaaaacccttctcgccctcctactgctgccgttccgcgctcacgagcttcctctttctacagaaaaagaggcgacaccccccgcgcccctcctccccatatttcaaaacgctgtggaccaaagagggcggatgcctctcaaagccgaatcttgcagaataaaggaaattgaccactgcgaattgttaattacagcgtttacctgc

SEQ ID NO: 4511 - DNA, 214 bp, Homo sapiens
  misc_feature (1)...(214): n = g, a, c or t
gctgggcggggagcgtcngaccagaagagaatcacgccaggaaagcgacccggaggatgatgatgttaaaaagccagcattgcagtcttcagttgtagctacctccaaagagcgcacacgtngagaccttatccaggatcaaaatatggatgaaaagggaaagcaaaggaaccggcgaatatttggcttgttgatgggtacccttcaaaaattt

SEQ ID NO: 4512 - DNA, 548 bp, Homo sapiens
  misc_feature (1)...(548): n = g, a, c or t
aaaattttacatccagtttgagatcactttgagaataaaatacctgcctancagctcttttgnaaaatgttactataggaaaaagaaaccaagcatattattatactttctgattcctaacaaaaaacataaaaaacacatgtccagttctttaacattgagagacttgtttgtcacaggttaataggaggcactgctggtggaagaccctaaagaataatgcacaccacagccctcagccttgtaagtcgtaagagttactcaaatagcatgctttttgttgtgtgtgggtctgttgttaagagcaacagaacataagatttttctaatcatcaatattcanaatataatcaagaactcatatctaatgatgacaagactttccattgcacatcanatacatgatatttttagttttgtaccttcacacaaattctgaaggcaacatcatttataaaactcgtaggcaaatgtataacattttttaatagtaaaaactcatgataaatatctcccatgccaaagtattagcatatattacactctgg

SEQ ID NO: 4513 - DNA, 436 bp, Homo sapiens
  misc_feature (1)...(436): n = g, a, c or t
gcatgtcnngatctaagtaggagtgatgtttattcganagctgactttanatcttattcctttatatttttctaaagtcaaattattcanaatttgcagtgctttagttcatcacatgatattcttctgagatgtggtgacacttanattggcaattgctgcccccaaactgagggagcgaataataggaagncacttggagcnatcctggctcaanttcaagcgctggtcccatcactcatttttgacctctcattatttgaataaaggggtcttaattcatattcataagtgatgtgtactgccagatacacacctataatcagcactttggaaggctgangcaggaggatngtttgagcctaggaatttgagggtgcagtgagctatgattgtgccactaaattncagctttggtgacaganccgagacgctg

SEQ ID NO: 4514 - DNA, 354 bp, Homo sapiens
ccaaccaggggcagggcgtacttcagcacgaagtccttgatggccgagtcctgggtggagccctgcttcaaagagggaacaggtgagggggcccaccatctccccaccattgttcttgagtacaatgtttgagggactttgggggagtggcgactttgaagggatcagtcttaggaggcaaaacaccccagggctcgaccccactcaagcacagcccagtcattccctaccgtcttttggggctcctttccctccagtgaaccgtaggtgacttcttgggaaaaggcaaacaccttggccctttccttgggggtgtaggctcactaaccccacaaagagaccactcaaggtagg

SEQ ID NO: 4515 - DNA, 531 bp, Homo sapiens
  misc_feature (1)...(531): n = g, a, c or t
aacgtgaaccactggacaggatatagctgttccancttagggagcccactcgggcanagngactggtcatattnnnaaaccgtntntgntgctgcacatcccatanctgcacctcancactgctggtgcccacagccaagtngntgccctntttgatccnggccacagaggatatatattccccaggctgntncatttgcaaaagctgcangatgtcaccagagcttgcactccacaggnacacactgttgtccagtgccacggccagnacattcccanaactncaatccacaaggttcangtaatagtnatttcggatttcangcgcatccangatacngtctggcngggaaggaatgtaacggcnngtcttncggctggagccaggagtggncttttggctgtnnagtactttcagtctgttctgataaccctctggcgcattttgtggttttccactgagccgaaggatcttggcttnctctacatcaaaaccgttcaggttcaaagcccangctttctgatgtccct

SEQ ID NO: 4516 - DNA, 439 bp, Homo sapiens
ggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggaggtgaggaacccgcaatttgcccctccccagaccctctggatgtggtgtgaagagaagggtgctgtccatgagaagtgtctggttttgttgaggctttagccctggaagcagggtctgagtgatgcaaaatgaacctcaacaggtttggaaggg

SEQ ID NO: 4517 - DNA, 337 bp, Homo sapiens
  misc_feature (1)...(337): n = g, a, c or t
cctcactgagatgntctttgagtgaattcctgaaagaagtnaggaagtgagcccatgccattatctanaggaagagcatcccangcagtgggaactgnaagaacaaagctgtgaggctggagcatgactgcctgtgctngggaccacaaagaggctgtgtggaagcngatggggggcanaggttgtggtgagtgagagatgaggtcanangaaacantgtagagaaaggntgtgcnnagcatacanagccttgaaggtctntctaaggactttggctgantaaaatgggaagccactaggtgattntgangagaggaatgccatgatcttatacttt

SEQ ID NO: 4518 - DNA, 516 bp, Homo sapiens
ctgaggacaaacatgagatgagcatagtcagggacagatgtttgggagaaacaaaaggagggtaagtaggaagcgcagggcaaaggcaggcagagcgagtattgcagcagcctttgctgcgtgctgggaagtttctaacaatgcagggctcttggaaagcactgagattgcagcacttgttttgatagcgaggcaaggagtcacaaagtcaggcaaggagggtcatggaaagcggggtgacagagggagaagtccggggcggtggctctcctctaaagcctgtacctagtcctcatctctctccagcctctttacaatgttcatccatggaaagtgaagcccagagaagttaagtaacttgcttaaggtcacacagcaagttgacaaaaacaaacatacacaaaaaaaataaatcacggccaggcacggtggctcacgcctgtaatcccaacattttggaaggctgaggcaggaagatcaactgaggtcaggaggtggacaccagcatggacctcg

SEQ ID NO: 4519 - DNA, 510 bp, Homo sapiens
  misc_feature (1)...(510): n = g, a, c or t
ctgaggacaaacatgagatgagcatagncagggacagatgtttgggagaaacaaaaggagggtaagtaggaagcgcagggcaaaggcaggcagagcgagtattgcagcagcctttgctgcgtgctgggaagtttctaacaatgcagggctcttggaaagcactgagattgcagcacttgttttgatagcgaggcaaggagtcacaaagtcaggcaaggagggtcatggaaagcggggtgacngagggagaagtccggggcggtggctctcctctaaagcctgtacctagtcctcatctctctccagcctctttacaatgttcatccatggaaagtgaagcccanagaagttaagtaacttgcttaaggtcacacagcaagttgacaaaaacaaacatacacaaaaaaaataaatcacggccaggcacggtggctcacgcctgtaatcccaacattttggaaggctgaggcangaagatcaactgaggtcaggaggtggacaccagcatgg

SEQ ID NO: 4520 - DNA, 301 bp, Homo sapiens
ttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcag

SEQ ID NO: 4521 - DNA, 317 bp, Homo sapiens
  misc_feature (1)...(317): n = g, a, c or t
cagngccctccaccactcaccaggcaaacaaatgtggcttccaagaaggacaaccacccccgtttgctaagcccttcctaggaccaagctgtgggccctgggcttccctgatagtccaagttcaggttgttacttctgagcanaggcaactgaggctcagagaggccaagtggcttgcctgagatgatgtgactactgagcaatgaagctgggcctcatactaccctgcctaggactgcaggcccccccaccacaacgcttcctccccagcccctcaataccccactttggctgccagaggctatgagcagccccag

SEQ ID NO: 4522 - DNA, 430 bp, Homo sapiens
ccagtgaggtagggtttgcaatgagctccacccttcagccatgtcctgcaaccttccccgggcccatagtgagggtgccaccttactcccagcctccaggggctctgcctgctcctgccctgtcccccgcatcctatgaggcatgggcgtgggtgggcacagcatactgtgcgtgtgtgtgtccgtcacaccttgctcgggacggaaagattcccacacaggaataaggacccgtggccctcatgggggaaggacagaggcactacaggtcacctcatcccctctcctgcctccatggcacacgtcaccctccccaggccacttccaagtcactcagagttgtgggacagagtgaagctctctgcatggcgtttccttggctatggtttgcagaggctgcaaactccaatgagctacagtttgggggcag

SEQ ID NO: 4523 - DNA, 418 bp, Homo sapiens
  misc_feature (1)...(418): n = g, a, c or t
aaaatactttantattataaacatccgtgacctacataatancaataatgctttaactgtataaatgagactgtggaaattccattattggctctatttttaagggttacaatgaaattatgtacagtatataaagcttgtcaaactgaacatggtcttaggccattactactatttcattccaatttggattttaatacaattaacttacagatctgaaataaaagcactgcttaatggtttcagatgcattttggtactgaataagtttcaaggaatctttacagataataaatnataatgaagagaacctacgactaaagctgcttacatggataacaggaggaatgacgattgcaaatgttatgttattgacaattctatgaattaaaactcataaccacttctagatttcttt

SEQ ID NO: 4524 - DNA, 140 bp, Homo sapiens
  misc_feature (1)...(140): n = g, a, c or t
ccagtgcttccagaatgtaccatggactagcatcgggggcagggcctgcggtgtctccaggggcatcagctccaacttaggtacctgcagggaatggccctggttggcccggatganaaggccagtgctgggatccccca

SEQ ID NO: 4525 - DNA, 397 bp, Homo sapiens
ctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaagg

SEQ ID NO: 4526 - DNA, 535 bp, Homo sapiens
  misc_feature (1)...(535): n = g, a, c or t
ctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagncatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatgg

SEQ ID NO: 4527 - DNA, 203 bp, Homo sapiens
  misc_feature (1)...(203): n = g, a, c or t
ctgctccacgtgaccacccaggccctcggccaggccgntgagcagatccagngctacgatcatgaagtccttgncgggagcctcatactgctcagggtgctgggtgtacatcatggcctgagccagngtcttctgcaccagggtgacacagcgctggtagacgggctcacagtaaggcangaanccactctgcagggcggtgg

SEQ ID NO: 4528 - DNA, 167 bp, Homo sapiens
aaatcagcagcaagcattaggacatgctattttggccccataagttaggtgtgtagcactacacattagacaccaagtcatcccaaccaatatttatccatatgaacagataaactgaacaaaaacatagttctgataaaacctgcattcacaacctaatgtagttt

SEQ ID NO: 4529 - DNA, 467 bp, Homo sapiens
ccaggctggtcttgaagtcctaacctcaggtggtccacccacctcggcctcccaaagtgctaggattacaggcatgagtcaccatacccggccggttatctgcagttttcaattctcagatttgctacatgaatatttttagcctacagaattcagattagctttgaggaaatgtggtgtgagagacacgtgtaaccagcagaaaatcagcttagactacccaccttagcgttttgttcttattcaaacaggcaaattcttagtaaataagaaagaagtaaagtttgatctcaagaaaatatgagggaaggctgaaaagggccctgggttcagaaagaagggttactaaaaaggagataagccgctggacaacagatctccattttgcagaatgctaagacattgcacttagtacctcctgtttcccatgggttctgatccagaaatgtgccctgggaactgagcag

SEQ ID NO: 4530 - DNA, 309 bp, Homo sapiens
aaaaagtatattaaagcctatgggatgcttttctgtcatattcccctaggtccagttgaacatgagaaaagtcagttttctgattagatttctgggtatggaagagagaaaatatagttttctgtaaagatgtaagtgaaagaatttagactggccttttaacataaactaggggtttccagtttcttggaatgggaggactccgtttgaatatctaattttgttatgcactctgctcttatttggttgtgattactaatagttgagaagtctgtttctgctgttccagtggttagaaaccactgtttt

SEQ ID NO: 4531 - DNA, 314 bp, Homo sapiens
  misc_feature (1)...(314): n = g, a, c or t
atgcanaacaaattatcntgtgactntnacantggatatttagaatgctgaacggnaaaattaaagtataaaanttaatgatcagaatgctgactgatttccataatncatttcnccnntggaaattaangaggaatcactgattncatttaatgaccatacaattcatgtaaatggctaacattatttagcanaatacacattcacctgacttgattagaaaaagttttccattaacttagcaacactgntgaagcagtctnacattatagcacanantggaggtgggaggacnggaagtacatatatcattt

SEQ ID NO: 4532 - DNA, 267 bp, Homo sapiens
  misc_feature (1)...(267): n = g, a, c or t
tcctgtctnanggtgaggacctgaagggtgtgggtcccggggagggtgaggangccattgtanngagatttactgagatggtatcgggatgccccnancaccacgtnnggggattacntntgggtttntgggaacnannagctganttaggggaganaacccnaaagatctcantggggaaaggactangggngcanggtgtttcacagaaacaannaaggggcctngatttcacagaaatcatnaagagggctccttgtgggtaga

SEQ ID NO: 4533 - DNA, 79 bp, Homo sapiens
  misc_feature (1)...(79): n = g, a, c or t
ctctgaatcanagagcagtgagacctaagggtccctgancnnagagggtccctcctgtctnanggtgaggacctgaagg

SEQ ID NO: 4534 - DNA, 397 bp, Homo sapiens
  misc_feature (1)...(397): n = g, a, c or t
aaaaattttctttttttggcccatcggggcttcggatacctgcttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggngtgtgagtgtacctaccgctttggcagagaatgactctgcagttaagctaagggcgtgttcanattgtggaggaaaagnggccgccattttagacttgccgnataactcggnttanggctagtcgtttgtgctaagttaaact

SEQ ID NO: 4535 - DNA, 469 bp, Homo sapiens
  misc_feature (1)...(469): n = g, a, c or t
ccaacaagggnntctacggnnggtaaagataagagggtgagagagataaggctagattgtataaggcttgacagaccatagcaagataagcangaactgtgtccagttaaccatttatccctaacatctaacatagagttcanntagtaaaagccataaaccctttgantcttctggcaagataagtaattagcacagattattgtcactcactgcaactcagccttggagggagtacacaaatcanaaggaggtcaagtgtctgggaaattaaatgacagcacctggaagaacagatcattgttggggtaagaaatggaancccagtgtanaaaaggatagaatgccatggggttagaggtancagaggctgggacagaacttgtctgttctgccccctttcacccctcctgttctttgccttatgtccaacccatcacttgctggggtantcagcctagttgaacag

SEQ ID NO: 4536 - DNA, 372 bp, Homo sapiens
tggggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatattt

SEQ ID NO: 4537 - DNA, 415 bp, Homo sapiens
ccagtaaaggttttgatgccttctctgtgccccccaagaaagagtgattgttcagagtgtgggaggttaccctgttctctgcacagtgttagcacaaaggcaggggtggagttttctggctctctgcccaccaaagtttcatctacaatggcagttgctgggggtggcggggcatattgcattcccatttgctggtggggcaagcaaagccaaacctgcctttgcagacatgtgccagcaaagaaatatcaggagttgccatggtgtcacgggaagctgcagtatggggaagaaatgtgggctggtgcagtcataggggctgccttgctggagctcttcatgagtcaggcatgtccctccagtgcagatgctctggtatgagcttccagggtacctgagactgccctgtaagcag

SEQ ID NO: 4538 - DNA, 133 bp, Homo sapiens
  misc_feature (1)...(133): n = g, a, c or t
ctggtgctgcggcgtgcatgtgcggcccgagagcgtggcttcgggtctaccagatgccttcaaggaaaaggccagaacctgcactgcacggcacagtcactgtgtgtggtgggacccantgtcggctgagagg

SEQ ID NO: 4539 - DNA, 576 bp, Homo sapiens
aaagaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgct

SEQ ID NO: 4540 - DNA, 337 bp, Homo sapiens
ctgcgttacccggaaccgccgggccgaacagcatgacgtccgctttggagaactacatcaaccgtatcctcaagctggccgccgcgggcttatcaggaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaaccttt

SEQ ID NO: 4541 - DNA, 111 bp, Homo sapiens
tgctgctgccctccagccgtctgttgcttccctcccccgctcccatttttcagcttttcttgaaatctggcaagcgccagaaagggaaataacttccatccaccttaattt

SEQ ID NO: 4542 - DNA, 474 bp, Homo sapiens
  misc_feature (1)...(474): n = g, a, c or t
cctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggaaatatctgtacctgtcgcttgcctctacttaccctctgcttagtaaaccacatttaggatggggaacccatgaggaagaacccagaatcagcatgaggaggggttgaggactttgcctaatcgtgcagatggaggcagcctggacaggtaaaaagtctgcccttctgcagaagctcttcccggcgggggacaccaccagcctgtgtgtcatccctgctgcctctggaaaaccctctctgaatcanaggtgctgggtgtgtgtgtgcctgtgtgcagtggctcctgccagcagg

SEQ ID NO: 4543 - DNA, 251 bp, Homo sapiens
ccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcattt

SEQ ID NO: 4544 - DNA, 602 bp, Homo sapiens
aaaattagggtggtggtgcacacctatggtcccagctacttgggtgtcttaggcgggagaatcacctgagcccaggagtttggggttgcaatgaactatgaccacaccactgcactccagcctaggcaacagagcaagaccctatctcttaaaatcagttcatgatggatattgtggcttcagatgtgaaagaaaagatacggggctaaaattctgtattttcagtgtattctggtaaccagctaatccaagcagtaatttttgaaatgtgaagtttagaatatattctaaataaaatacgtgcaacctccagtgggaacctcttattattggggaggtagtagaaaggcgctgggtgttctaaaataggctctcctggcccacggctgactgtcttccttgtgtctctgcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggag

SEQ ID NO: 4545 - DNA, 399 bp, Homo sapiens
cctgaaaataggctattccatttggcaagtaagaggccattgctgatcttagagcaatttccacagaatgagaggcagaagcaagataatagtgactgagaaaaaaactattcagtactctcaggaagcttgctaaattgctaaaattttaatttgcacttattggataaaaatataattttcctaggcatctaaaaattatttttagtatttagtgcaggggaaagcatactgagaatactattttggacaaattttttgataagcactttgaccagttcatcaaaagccttaaaatattcatccgtggccgggcgcggtagctcacacctgtaatcccagcactttgggaggctgaggccgacggatcacaaggtcagaagttcgagaccagtctgg

SEQ ID NO: 4546 - DNA, 205 bp, Homo sapiens
  misc_feature (1)...(205): n = g, a, c or t
aatattcccaaattgtgcttgctcatggcaaaatggatgcaaccanngttattccanaacatgcatntcaagcattcacctgttttcatgaatcctggatgctcancantgtttgaactatttaatagcttcacggcttttcgataattacctcttaagtactcaaaattgcttttaagaaagagagagggtgcggaatttccag

SEQ ID NO: 4547 - DNA, 295 bp, Homo sapiens; identical to SEQ ID NO: 342

SEQ ID NO: 4548 - DNA, 227 bp, Homo sapiens
attagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttgg

SEQ ID NO: 4549 - DNA, 368 bp, Homo sapiens
ctgaatcatgaataacactatataatagagtataaggaacacaagcattagatgtgatccttgccccatacccttagattatgtcagactaaagctgacaattctgccaggctctgaacccctagtgcccccaacccaaatcttggaagcaaagaatatgccctgtcatacaactttgtacaagttgtagtaaaacaaagcttaagttttctcatctttctacagcaaatggtcagttatttaataaacactaaaatgctcctaagaatccattttgagtttgtttaccaaacacattgtgcaagaactgactacacaaaaagttcctttgaaatttggtccacaaattcacttaaggttggaaattt

SEQ ID NO: 4550 - DNA, 401 bp, Homo sapiens
aaactacagaacacccactggaactcatggagatgctggagactttgcaatgattgcatattttgtgttgaagccaagatgtttacagaaaggaagtttaaccatacagcaagtagacgaccttttagactcaattgccagcaataattctgctaaaagaaaagacctaataaaaaagagccttcttcaacttataactcagagttcagcacttgagcaaaagtggcttatacggatgatcataaaggatttaaatgttctttcacagaggactggagttaatattgacaggatgtttaacgtttttatcaatgtcttcataggacctgttcactgttcaaaaaatacacttaatggagatttggcatcagcaaccattcctgaagaaagcagacttatgg

SEQ ID NO: 4551 - DNA, 182 bp, Homo sapiens
ctggagatgttgggctgggaggccctgtggtcactcatactgcaggagagagaagaagggtacaggtgccagcttctccctgcccttaagcgaggtcagctccaccaggctcacgcactccaggacctcagcctgcaggcggcccagcagctcacaggcagcgttcatggttccaccagtgg

SEQ ID NO: 4552 - DNA, 606 bp, Homo sapiens
aaaaaccaaaagaaaattcagaacagttttgtaataggataaattaaaggtatgctaccacatataaaactttgctacagtcagttaagtattatacaacttttcaaactaaaggaaaacaaatcaaaatattaaaagaagatactgtctaatctaaaagtgtactggtttctacaagtgtcaaaaaaagatttgatgtagtgcaactgtctatacttgtggtgcctttgaaaaaagggtgggaaggaggggagagaagaaacttttcttgcttctggaagcaaaagacatattggaattagagaataaacagaccatgcagtgcgtcactccacgctgcagtcattggtgctcatctgccaaccaaacatttccttaagtctcactgtggcaatctccttaggattcaaacccagagttaaggctggtctgctaaaaacgggggcactattgtcattcaaccctttagatctctagatttcctaatgcccgaataaggccaaatacagaataattaattaagcatttctttttccaaaagcaaatcaagtcactctcctttcttgctaatttatactttttcttatggcaatgatttttttctag

SEQ ID NO: 4553 - DNA, 568 bp, Homo sapiens
cctggctaaaatctacccttgggccctgcactcctccccatggctatattgcaaatatcctatactttgcatgtgatcacacaaagagggtttctgttactggcacacaaaaagtttgcctgagatgattctcctccacttccatcagggtcttctggtcattgatttcaacttattctctcttaagaagcccattgagtccccataatctcttggtttctttcttttccaggaccaactgctcacagttcaaaccctcattttgcctctatttacttgtaccttgattggctgatgccctaacagacccaggttcttcagaaagccttcctagtccacctcagaccttggggatccccctttcccatgacccccgatggcacctgattacgtcactgggttccagttaccagaccacagccaaggtccaggatggctgcatcagagtcatccagagccggttaaaaatgacagcctcggctgggcacagtggctaatgcctgtaattccagtactttgggagggaaggtgggtggatcacgaggtcaagagatggaggccatcctgg

SEQ ID NO: 4554 - DNA, 517 bp, Homo sapiens
  misc_feature (1)...(517): n = g, a, c or t
ctgctacagaagctgatatattatggcgggccaaaagcagctttctaaagtgactcccaatgaagggagagtagattaagaggaaaataaccccagagggaagcaagcaagtttgacccccaaagcccccaaagttctaggagctccagactgtctctgttagatcccttctttcttaatcccagtcccccctccctcccagtcccgccagcccaagagggactgactgtagctgacaagcagggcaacagcagaatcagttcaaataagcaatcatgtacaaggcatcgacattcccacacccagcaatggcgcagatccaccccgaccccagcagttcgtaatcactgcctttaacttagcgcttaagtggcaggcactgggctaagcgctttacagacatcacagcttctgaaattcctcacaacaaccctatgaggtaggttctgatatttcagccccattttacagataagaagactgagttgntaacttttaactgagcagttaaaagaca

SEQ ID NO: 4555 - DNA, 399 bp, Homo sapiens
  misc_feature (1)...(399): n = g, a, c or t
ctgaaaataggctattccatttggcnagtangaggccattgctgatcttagagcantttccacanaangagaggcagaagcnngataatagtgactgagaaaaaaactattcantactctnaggaancttgctaaattgctaaaattttaatttgcncttattggataaaaatataattttcctaggcatctaaaaantatttttagnattnagngcaggggaaagcatactganaatactattttggacaaattttttgataagcactttnaccagttnatcaaaagccttaaaatattcntccgtggccgggcgcggtagctcacacctgtaatcncagcactttgggaggctgaggccgacggatcacaaggtcnnnaagttcgagaccagtctgg

SEQ ID NO: 4556 - DNA, 257 bp, Homo sapiens
ccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccag

SEQ ID NO: 4557 - DNA, 503 bp, Homo sapiens
ctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaagtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaagg

SEQ ID NO: 4558 - DNA, 347 bp, Homo sapiens
ccagtggaggggtgggggtatcgatcccgccgggggctggcttggttgctggtgccctgagcccttctctgcccgcctgggtgttgccttcactgatggaggtaggcgtccagccagatgtcaccagacttcttcagggacctgacgatgtccaccagcgcggtgaggaagggcttcacttcgtagctgaggccgtgcttggcacacagcgacttgaccagcggggccacccggctgtagttgtgtctcggcatcctggggaagaggtggtgctcgatctggaagttgaggtgcccgctgaaccagttggtgaaaagtgagggctccacgttgcaggtggctgccag

SEQ ID NO: 4559 - DNA, 392 bp, Homo sapiens
  misc_feature (1)...(392): n = g, a, c or t
cttttttttttttttttttttttttttagggaggaataagtttatttctcctccatccactcaaaatatatnttaacaccagtggcattatgganacagcatttggttagggagtgccaagcattctacagcatttgatggnggaaatagtcatgctttttatttctgctctctaggaatgtaaggngcacagcaggtcagggtactgctgtgtganacaaaaggnccaggtagaggcaattctccanatgcaggcagggcaggngctcactgggcanagngcttntcatacaccttcaggaactcgagcacgtcgtcgggggaccccaagatcaccggcgccctntggtgaatgtctgtgggaatgacgtntaacacggcctccttcccag

SEQ ID NO: 4560 - DNA, 455 bp, Homo sapiens; identical to SEQ ID NO: 4202

SEQ ID NO: 4561 - DNA, 344 bp, Homo sapiens
cctgggcaacatagcaagaccctcgtctctattaaaaatataaaaaatacaccagacgcggtggctcatgcctgtaatcccagcgctttggaaggctgaggcaggtggattgcttgagaccaggagtttgagaccagcctggtcaacacagagaaaccccatctatactaaaaatacaaaaatcagcctggtgcggtggcacacccattagtcctagctactcaagaggctgaagcataagaattgtgtgaacccaggaggcggagcttgcagtgagctgagattgtgccactgcactccagcctgggcaacagaccaagactctgtctcaaaaaaaaaaaaaa

SEQ ID NO: 4562 - DNA, 291 bp, Homo sapiens
ctggcgggggcgagcacctctgcctattcccgggtccccaagcccctcagccccatgcctgtctacacagcaggattgcttgagcattcaccggaagttatgggcctggggacccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccag

SEQ ID NO: 4563 - DNA, 518 bp, Homo sapiens
  misc_feature (1)...(518): n = g, a, c or t
aaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttgaacaatatgggtttgaactgcatggctgcacttatatatggatttttttcaaccatacaggttgaaaatacagtattggcagggggcgaaacctgcgtncatggagggctgatttatcacatacgtgggttctgtagggcccactgngggacttgagtatgcatngggtttttgtntactcaggcgttctggaactatcctccatgtntnccaaaggatggt

SEQ ID NO: 4564 - DNA, 289 bp, Homo sapiens
cctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcag

SEQ ID NO: 4565 - DNA, 572 bp, Homo sapiens
  misc_feature (1)...(572): n = g, a, c or t
tttttttttttttttttttttttattgaacagttttattctgttttanaataaaaactttgctttaatattgtaaggggtactgcaggtatgccatgctgccagttattgctggggcacaaaacgccccagtcagtgattcggagggctgggaaaacncataaactcataatttcagagcaagtagaactagtatttacagttttctttcttgaaattggcccgggacatntccaacagtctacacatgtattgccatggtacttgctctgatgctctgaatgcctcggaactgngttcaatatcatgatttgngggtcctctaaaaggttttgttgttaacatgcaagcaaacagcactgaacaatattgtctaaactatggctgccaagtactggatcttcataatgaaaccaaattacaaaacactgccttgtagagctatacaaaagatataaaatgaaaataaaaaatgtcaaccagccttaaatattccaattctcctacagtgcagtttctatatctttatcactactgaatgttttaaggagaaagttaanaaaacaatcaaaa

SEQ ID NO: 4566 - DNA, 576 bp, Homo sapiens
aaatcaactaaagactcatgagatttatttggttacagtgaataacctggacaaaatgttgagaagagttgttaaaacaagtttacattaaatatactaacaattacgtttggttacatatttgtaagtgatggttatttagaaaaactgcatagaaatccaaaccttaaatattctgcaaatcaaatcattagcttttctcttctctaataaagtagggtgactagttcttggattaatctaactataacattaatgtagcacttgattatcttatggaataattctctatctcatctaagcctcacaacaaccttgtaaagtattatccccatatggaggaagaaacaggcttagaagtggaaaggtagattctctgcttgcacaaccgtattatgtggctaagctattgaacttgaacctagatttgggacttcatttcaaatatgaaattttttgattaaatctttttatcttgtatggaaaaaatatctcattagctgtcagatgttatttaccctgctaacttaaaaatatttcattaaaaaaattcagcttcatagcctttcagtttcc

SEQ ID NO: 4567 - DNA, 384 bp, Homo sapiens
ctgtctggtaaaccagtggcacttcactgccccagggtggctggctccctttctgaatttctgtctcaatgtgatataattgccaccattcaggatggctacccacatctggtatgaacaccatgacttctgtaagccaacggggcttcctcctcagaacagtgcccgtgcaatcttcctccctgtggccttgatcctgggaaaggagccccctcctccctcactcggaggagttcctgaggcagacgggccactggtgacgccaggtgtagcagtagaggaccttcgccgctgccgcaggaggaaatcgtgtgaagctccatccatggcgtagaatacattagccgaggctgggatagtcagctctcgctcccctggtagcag

SEQ ID NO: 4568 - DNA, 355 bp, Homo sapiens
aaactagtattaaaggtagtttaccaaagcattttttgttttcttaccttgaaaacacagaaccgttaattccttggtttaagcagttgctaagttttttaattttaggctcagaggcccataggaggttttaagatttatgtttagtccgataggtgaggtctttgatattttgaattttaactccttttatgatacatcacagtaacctcatttttgaagtctttctttgtactttaatgttctccctgttctaatagttgaagtatgagatgtaactattataaactgttgctgaaaacataaatgtctgtaacttacaaacatgataaataaattaaaaattccatccagg

SEQ ID NO: 4569 - DNA, 119 bp, Homo sapiens
ctgggagatatcgatgcggttgcacagcaggtccgagatgacgtcctgtgcgtgagccaccgcgccctcagggtctcggtcgatgagcaggcggcgcagtgaggcagtgaccaggttgg

SEQ ID NO: 4570 - DNA, 568 bp, Homo sapiens
cctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactct

SEQ ID NO: 4571 - DNA, 332 bp, Homo sapiens; identical to SEQ ID NO: 4096

SEQ ID NO: 4572 - DNA, 351 bp, Homo sapiens
aaattaataacttgaaattacccctgccccccaccccattacatctttttataaacagcaaacattttgctattttatacataggctagcaggcttgtttcaatatgaaagtgctaattcatttacagatttttataatcagttatgtagtgctacaataaatgtccaataatctacataggaacaatgatgaaaatgatgaagactgaataaggctatcagatgaccttatcttatttacatataaagaatagatacccaatggtgaggaagaaacagaaattggacaaatactcataggtgtaaaaattacatctacctttgagttttatactgtaaatgagacatttt

SEQ ID NO: 4573 - DNA, 511 bp, Homo sapiens
  misc_feature (1)...(511): n = g, a, c or t
cctgagtggcctgtttgccacccagaatggggatgttggttgctatggaaacatggatgagtttacccaanaggaactccgggctctggatagtgagggcagggccctcctnacacagnataanatccggtaatagctnatatntccctgctactgagcactgctggtgctactctttgagtgtgaagattctaangcttgccatgtaaacatacatgcaccgtggagaagttnccaaatttgnctttcctggnttagtnctggctgggctactcagtgtgtgaccctggcaaatttttcccccctntgaagcttgagtttncatctctacaatgtggggctggcctantgatccagctcttattaccatagacatctnanaagcancttantgctgaactcanngccccaggttgctgtctttctgggtgttctgngtgaatagcagcaccattacctggtggtaatccttagatatccctctccctgccttatcannagtcagtcccca

SEQ ID NO: 4574 - DNA, 530 bp, Homo sapiens
  misc_feature (1)...(530): n = g, a, c or t
aaattagaggttaataatgttgttttcttctctctcttttttttttttttttttttgagacagagtctagctttgtaccaggctgcagtgcagtagtgccatctcagctcactgcaacctctgcctcccgggttcaagcgattgtcctgcctcagcctcccgagtagctgggattacagccacatgccaccacacccagctaatgtttgtatttttagtagatacggggtttcatcatgttgcccaggatggtcttaatttcctgacctcgtgatccgcccatctcggcctcccaaaatgctgggattacaggcatgagccaccanaaccggacatgctttccttaaaagctaaatattttaggcttgtgtgccattaggctctgttacaactacttaattctgcttttgtaattctatagcacccattgataatacataaacaaatgagcatgaatgtgtctcagtaaaaatttgttcacataaacaggcagtccacccatgaagctatagcttgctgaccccttgttt

SEQ ID NO: 4575 - DNA, 607 bp, Homo sapiens
aaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaataggaggctgagaaactgcatcgacaagaaaggaaaagactccgtcgttcggccggacacctgaagtcaagacacaaaagaggacggtcgtttc

SEQ ID NO: 4576 - DNA, 234 bp, Homo sapiens
attttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtctttt

SEQ ID NO: 4577 - DNA, 582 bp, Homo sapiens; identical to SEQ ID NO: 643
  misc_feature (1)...(582): n = g, a, c or t

SEQ ID NO: 4578 - DNA, 291 bp, Homo sapiens
ccaatggtggcagagtctacatagaactatgcttcgtggtgttctggggaaaacctttcgacttgttggctatactattcaatatggctgtatagctcattgtgcttttgaatacgttggtggtgttgtcatggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatgg

SEQ ID NO: 4579 - DNA, 202 bp, Homo sapiens
aaacctcagcttaactgcagaattctaagccttctttttgatcaaactgagatctatggcaacccttctgctacccgggacttggaaggatagtgaatataaattaggctctggacccccaaggctggtgatgctactgtaacctctacagctctggattcaacctgagggcctgggatatgtgactttacataaaaatgat

SEQ ID NO: 4580 - DNA, 507 bp, Homo sapiens
  misc_feature (1)...(507): n = g, a, c or t
tgcgcctgtagttccagctattcaggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttatgacaccgttattagctggtactttggtgatttctattactagtttttctaagctatttacagagtgtttgtagctttcatttgcagcattatgttcccacaaattctgtactcagtatatacagtatagtttatctgctctatttctgncttatagaaatcatgaatgtggtctgcagacattgatgaagaaaatctgntggtaattgatacatgggctaaagcatcagaggnttaatttgaagtttatgttcacacactgaaaacttantttttttgntggnagatccatgtgcatgctanaatttgggacaggcactatttgcataaa

SEQ ID NO: 4581 - DNA, 511 bp, Homo sapiens
cctcttgattcctaggagtcaataagaaggctttggagtccaggcaggaagtcagggacttgaattcctccacacacttttcgggaggatgtggtgagcgattgtagaggagaaagcgctggtaaccctggcctgtctcattcagcatgattccacctgggcatgagctggaaaagagctcagtcttcatgtcagggcggccttcagttctgagatctgtgctcccttcagtcaggtggtagatccatttccggggcacacagagcccatctttcatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaatgtttggggctgcggactttctcgtcgtgccccacaaaagtaaagcttggggacctggggggagccggaagtatcgcttcg

SEQ ID NO: 4582 - DNA, 131 bp, Homo sapiens
aaaaaccattttcctatgttaggagtgcaagaatagccagcatttccgattttgacatatgttcattttatgcatatttaagaaattatagctgcatatcccttctttcaaaaaatgttgctttttttttt

SEQ ID NO: 4583 - DNA, 365 bp, Homo sapiens
cctatttaagggttcccagcagaatgggccattgtccgcctctccagttgcatgactggagtttgatggccttttgttctttctgagctgtagctggagcttgcttgttggttcacaggaacaagcaaggttcatctaaactgtaggcaaaaacttaaaaacaactagtgagtttagaatttaatggcaaatgtatgataagttttgaaacacaatttctttctctctagtccccatttttggaaaaaacaaacaaaaaaacataaatcatgataggactgagttgtttgcaaaatagattgtagtcttacacttggtctgattatttgcataaagtgcaagaggaataattatttctacatagg

SEQ ID NO: 4584 - DNA, 595 bp, Homo sapiens
aaatttggtgatattattatattttatctgaatgaacagaatttgctgatttgacactgtgtttgagtgtgcattttttgttgaaaaatgacaattctggaatgccgtctccctttccagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagacctc

SEQ ID NO: 4585 - DNA, 342 bp, Homo sapiens
ggcacgatatcggctaactgcaacctctgcctcccgggttcaagtgattctcctgcctcagcctcccgagtagctggggttacagacaccacgcccaactagtttttgtatttttaggagaaacggggtttcaccatgttggctaggctggtcccgaactcctgacctcaggtgatccacccacctcagcctcccaagttgttgggattacaggcatgagccactgcgccctgcctatgatgacctttatattttcatatggattaaagataccgtccagagtgctttcatttcatcttgaatgctcgttttagcatttcttcttggacaggtctagaatac

SEQ ID NO: 4586 - DNA, 461 bp, Homo sapiens
  misc_feature (1)...(461): n = g, a, c or t
ctggagccntctgctcaccanaactcctacttnccggtggcaggagagcnngagagggacagacagatggcagggcatgtccaaaagaagagcatcagcacaaatgaatnctccccttncccacctccaggggngggggcctttggcacctcaatccccgataccctactccttcccacccacatctncttgcacccatctggaacctnggttgatgtgagccggcaacagagaagcaccgtggcgcggcgagggaatgcanacngcacccancggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtngattttttttnttaaaaaaattttttt

SEQ ID NO: 4587 - DNA, 498 bp, Homo sapiens
ggagcagcagatagaagggacagggttgcacttataacaccactatcctcccagccctggttttatcatcatcatcgagaaaaatacaattaatcagcagtgatcaaaggtaagtctaaacattccatttaactaacttaaatgtgacctggtgtgccgtgtcattctataaatgacataacagaataagactcactttctaattcacagcctctggttcaatttcaagtaagcaaatacattttgctttggttttgcttacaatattctgggaaatgcaggctataaataatcactcaactgttttgtgggtcaacagaatcactactactttcagtttcgttgatgccatttatatcatgagctcaagcacacgggcgcttcagaaggcactataaagtttagttttgatgtggtgtgatgttctgatctatcttgaaaggtaaagaaacccacaggattcagcgtcaagccaatccatgcccaggcacatcgcag

SEQ ID NO: 4588 - DNA, 456 bp, Homo sapiens
cctaaaaaagcggcctcggtgggaatgcatttctcttgctccacgtctattttagttgcatatctgtagtgatgacaaatgcctccagccttgtcctctgcaaggctgcactgggctgcatacaggctcctgtctcaggtgtctggtttcctccttgaaaggttggggcagcagagtcagccctgtctatctgggcaaggccctgacacttggaagcatgaaaagccatggttcaggtggagtgagcttccaatgcccttggaaggattttatttcagggccgtggggcttaaaagtcatcactgtacaatccactgggagcaaagatcaagataagatgtgatggatatcataaaagcggaacagaacatcccattgctcagagatgggagaacaactctgaatggagagggctcaggttatatacattcacccttttcatgggaaagtgtgagg

SEQ ID NO: 4589 - DNA, 534 bp, Homo sapiens; identical to SEQ ID NO: 343

SEQ ID NO: 4590 - DNA, 290 bp, Homo sapiens
  misc_feature (1)...(290): n = g, a, c or t
ctgcctgcctgggaggaggggctggcctggatctgtgacagccacccagcagcactgcagggccatggggctcanaaaatgcagaggcatcccccgccctgcccaggcataggattggctgaggcatcctgccttcagccgggtccacacgtgacacgtccacacgtgacaggcccacagacgacaggaccacacaacaggttcacacgtgacaggtccacacgtgactggtgcatgcatgacaggtccacacgtgacagtccacacgtgacaggtccacatgtgacagg

SEQ ID NO: 4591 - DNA, 243 bp, Homo sapiens
ccttcacttggttcatgtaggaacaccaagtccctttcaaagcaccacatcttcctctaatcaatatttcttggagtccctagggaatgtcttacatgcattcaaacaatcaccatttctggagatacactacagggtcaccataaactctgctacccttaggttccatcactatggaagctgagtttcaccagaaggcacttttgtcctccattacgaccagcaaagccagctaagccacag

SEQ ID NO: 4592 - DNA, 413 bp, Homo sapiens
ccacacggtactgctctcggcggactgaagcatttgtcctgcaacctgctgcttcagatggctcttagctacaataagaaatcctaagtccaaaggccaactttctcatacaactggtgcccttgcaggaagcagtgggaggtggggagggatgaggaccactgttgagtaaggacagcagaggtcccttgccatgcctcccttctgcccttgtccgggaacaacatggggagaagccagggatctcatgacatcctttagtctcaaactcgatcccaaggttgccacgacagccttgtccccaccatgcaagtcacctccccaacaagacacataaaaagccacgtctgctctccactaggctcccacaagaaaaacagaccaagatcccccatggggcgtgagtactgcag

SEQ ID NO: 4593 - DNA, 315 bp, Homo sapiens
ctggattagataggagggtctctttcagcttgcacctctgggaagccaacactgacgcccactgggagaggctgaacttggtccaggctaccacttcagcatcagcccatggtggaagcagacttccccaagcccaaagttcagccccctgccccacacccctctgcacacctgccacaatgacggaggtaaaaccaaagaacatccccagcgccatcttctgcagagcagagggaagcagcttgcaccgcagcagtaaagggtcgatcaagcggtccttcagagggaccagaatcagcaccaccacaacattgg

SEQ ID NO: 4594 - DNA, 466 bp, Homo sapiens
ccagtacagttcttcctggatggccgacacagatcctggggaaaggcaatcccggcactgctctgaaaccagagctcctcctccctccccgggcagggtggagctgagaagggctgctctagcgttgggactccacctccatacacctgatattttgatagggcaggtccctgctatgggccactgttctgggcagtatagtatgcttgacagcatccttggcatctatccaccagatcccagagcacccgctactagctgtgacaacatcctccaaacattgcaaaatttcccctgggaggcaagattgcctcagatgggagaatcacgctctagggaaatctgctggtatgagaaccccaactccccactccactgagcctccagatggcgagcaggctgcagctccagcacagacacgaagctccctccagccactgacggtccatggctggggttacccagg

SEQ ID NO: 4595 - DNA, 405 bp, Homo sapiens
aaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggcttttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacag

SEQ ID NO: 4596 - DNA, 388 bp, Homo sapiens
ccaactccagctctatctggtcaatggtctcctgatactccttctcccgggttttgaacaggggctccgtatctttaatcactttctccaggctatcttcctgctgctggagtagaaagggaagcgggggaggccagccaaggagggatgggatgggacgcattccaaagggccaagtcagggagagagagagaggaagtctggttaaagaaactggagaaagaaaagcaaaaggataaaggaagaggggaggcgcaggtagaggatgacagccacatggggggacagagcaaggagaggagcgggggagtgggcgtcaggctggagaggcagagccagagggccctgaggccgggagcagaggttacctctccctgggcctctgcag

SEQ ID NO: 4597 - DNA, 106 bp, Homo sapiens
ccagagtcctgtccaaggcaatggcgtaggctgcgcctcagttcatccgagtccctccccagctcactggtccaggccaagggatgggagaggctttgagtctaga

SEQ ID NO: 4598 - DNA, 337 bp, Homo sapiens
ccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcagg

SEQ ID NO: 4599 - DNA, 431 bp, Homo sapiens
aaaaagtgggataagaacacaaagaggttatatataagaatgtatttcgtagagttgtatgtgaaggcaaaaaaacccaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgcttctatttttggtttatattttt

SEQ ID NO: 4600 - DNA, 364 bp, Homo sapiens
ccagttggcagaggttcattcagtaagtcccgagcagggtgcgaaggacagtcatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcag

SEQ ID NO: 4601 - DNA, 390 bp, Homo sapiens
  misc_feature (1)...(390): n = g, a, c or t
ccagaatataccagaatcatcttgcttcaggcatgtgcttcttgggtttctccgtgtgtcgctgtaccttgtaggtctctgcatgcatccactcagcttgtcctctgaccatacatttgaatcgcaccacacatcagagcatgctgaatcagtgcgtgttttgaatcatcactgcgagcacttgtgttcgagtcaacaggcaccacaatgtatgtgcaattctctanctctgggtgattgggggctactataggtatgtccctaaatgttgngtgtctacacgtattgggtttcgttccaagggtgtgtagtgtttangaaactgggactgcgcantgtttgtgtcngtgtgtggtgtgtggcatcagggcgtcactactttaatatata

SEQ ID NO: 4602 - DNA, 557 bp, Homo sapiens
ctggcagctcacattttacattagagagtggggtccccacattttacattacagagcggggtccctgagctgcaggaggagagcctgcagggctcttgggtagaattgcacttttgcaataagggaaacgggagcaatgtttcagcctcagtttctatttataatactgacacaaaaagaatattgctggatacatagcatggatctagatagagcaactccaggagttctcacggtgacagcccccctcactcacagacaccatgtgatactaatagggcttagacacaaagcactgaattcccaaagcattgaagagaaagacagctctcagtctgagtaaaaccgtattgagagaagaaaagaggttgaaagaatcttaaagacaaattcagattacatgtaacattggtcaaattgaccagaaaatattcttccaaagaagttcttctctaaacaccaaaagtgcacagctactctcagcatgagaaatacaagtattatgagaaagagggcttattctgagcagaatttccatctctgctgctctcccatct

SEQ ID NO: 4603 - DNA, 464 bp, Homo sapiens; identical to SEQ ID NO: 200
  misc_feature (1)...(464): n = g, a, c or t

SEQ ID NO: 4604 - DNA, 304 bp, Homo sapiens
ccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtgg

SEQ ID NO: 4605 - DNA, 525 bp, Homo sapiens
  misc_feature (1)...(525): n = g, a, c or t
ctgagttatgaagctggaattggttctagacgctgggtagatgcaaagcagcctaactcttcaagtaccgacatttctcacctctgattccggctctcctttgagaaggagaccttagcttccccgacttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgntttagtaatatttttgggattatacttcctttctgtaccaatttcttttaattt

SEQ ID NO: 4606 - DNA, 555 bp, Homo sapiens; identical to SEQ ID NO: 641

SEQ ID NO: 4607 - DNA, 350 bp, Homo sapiens
ctgcacagggaaggaagggaagacgggaagaggttagataggaaatacaagagtcaggagactggaagatgttgtgaaatttaagaacacatagagttggagtaaaagtgtaagaaaactagaagggtaagagaccggtcagaaagtaggctatttgaagttaacacttcagaggcagagtagttctgaatggtaacaagaaattgagtgtgcctttgagagtaggttaaaaaacaataggcaactttattgtagctacttctggaacagaagattgtcattaatagttttagaaaactaaaatatatagcatacttatttgtcaattaacaaagaaactatgtattttt

SEQ ID NO: 4608 - DNA, 505 bp, Homo sapiens
aaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttgg

SEQ ID NO: 4609 - DNA, 319 bp, Homo sapiens
aaaaaagcctctgggaattaggaactagaatgaaaatccaactttccagatcagcttcttaaatatcttgtatttcaataaacatacacttcatacacacagatagatttgatatacaagtacaaaaacctgacatgcacattgaagagaatttatcattcatgatgttaatatatacagaaattctaaggaaaattgcaatgttttaatataaactttctttttaatttcagagttgataattcaacactttcagccaaaatttggccaaagggggttaaaacctgatcttatgtctggaatcccaatgtgatcctcc

SEQ ID NO: 4610 - DNA, 373 bp, Homo sapiens; identical to SEQ ID NO: 202
  misc_feature (1)...(373): n = g, a, c or t

SEQ ID NO: 4611 - DNA, 551 bp, Homo sapiens
  misc_feature (1)...(551): n = g, a, c or t
cctgctcctactatgtccttttccttctctcatatatttcagtcgtctggagttctcagaataaggaatccattatcaatgacctatcccatgaacattttttttgagaacctgtgtaagactatatagacatgaatatttgatgacctgacacctcaccgttcaaacctagatttgggttgtataaatatcaactcaaggctgtaagagcctcccatggtctaatgtttcaagagtaaagaagaatagacaaacacccatgttggaatcatctgttgcagaaaagaacacaaagatagttttattaatttagaacaaattttgagaactttacatagacagaaatcttctacctcctttttttctaattttggggaatgtcttccactagtggtcgctaaaaatgtagaaatatcatagggagtgcaaattacattgtctctttacctgccacaatctggcagcactcatcatgtagcaaatgcccaaataatagactacagattatagtgacttcaccctaggttaacattatttctaggtaaggnact

SEQ ID NO: 4612 - DNA, 430 bp, Homo sapiens
ccaccataaagttgttcagatgtctgtctccaatcccgaggatccagtggctgatgcatatcagagcgtgagagctggcgaagtgggagcggagcgccaggaaagcctcagggcttgtactcatcctcacgaaggcccgctttaagagatcagcaggcactttactttctcgttttctaaaagacgtgactgtttcagtacgattagcgcccttatacattagcatgtaagctccaacatcatgttttcctgacatttttgtcagccaatctttatattcacacggcggtgccctgggatcactcaggtaagccgccttctcctcttgggacatggtgttcaaaagaaggtccttcaaggtaacagtattttcaagccactcaattaatcctaacctggaggtcatgggcacaacgctataggtcctcag

SEQ ID NO: 4613 - DNA, 528 bp, Homo sapiens
aaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcatagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggagggaagtcactgg

SEQ ID NO: 4614 - DNA, 432 bp, Homo sapiens
aaaaaatataaacattttctttccattaggaagaaataactttagcctaacacatgaaacataaaagctacctaaatttcctataaatcacctagtgaatagctgtaatctacataataaaaagtaaaaaaaaaacttctcatgaactatgtattagaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttc

SEQ ID NO: 4615 - DNA, 381 bp, Homo sapiens
ccaagcctcatcaataactgtatccaaaaggagacgctgcttggggtgtacccagagaaaacaccaagctttcctggcttcccggccctccctctccccattagtctttggggtgcatacataagtgttgtgtgaagtctcttggggtttagaagatcttgcactcattgatggagaagagcctccttctgtttcgtctcctggcctggttgacggcagttcggacggcgcactcaaacacctgctgtactccccgattgctaagggctgagcactccaggtagcccttggctctgacatcctgggccagtttcttcccttccatggcattgacgcaggaggccctgtggggccccatctcccgctggtcagtctgggtgg

SEQ ID NO: 4616 - DNA, 379 bp, Homo sapiens
ctggctgggccacccaacccgagggagggggcagtgttcttcccagtcgcagtctccagtgatgagcatcccctgttggggccttcggtggctctcctcagcggctaatgcagttctggacatccacaaagcctaggcgttgcctgcgtttccgctgctccgtcatctgctccttgagctcgttgagctgggcagtgaggtgggacaccagcttcatggtggagttgagcttgtcctggagaatccgaatctcattctgctccccctcgccctcattgctgacaagggacatggcccgcatccgggggaaccagtccaggttcttgttctgaaaaacatcaccagtgggttaagcaggcgtgggcccggcctagaaagg

SEQ ID NO: 4617 - DNA, 373 bp, Homo sapiens; identical to SEQ ID NO: 6

SEQ ID NO: 4618 - DNA, 405 bp, Homo sapiens
ggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctggcacgactgcagaggttaaaacaccttttgatttgg

SEQ ID NO: 4619 - DNA, 373 bp, Homo sapiens; identical to SEQ ID NO: 6

SEQ ID NO: 4620 - DNA, 408 bp, Homo sapiens
aaattaaaattgtagaaatatctgagtagattggagagaggaaattaattatatagactgtagactattagttgacattgtattaggtaccacacatgacttctcttagtaattcaataatcttttgatggaagagttacagacctcattttatagatgaggaaataggcttagaatcaagtgacttgcccaagaatatacagaaagcaaataatgggacctgataattgaaaccttaatgtgcgtatactttaagagtttgtatattatactttttcacacactgtgatgagctttttctgttattttgaaataaaggtaacagtatatttactttttccctctttctaccctatagacccaagtcttggattgaggaacaggcaatgggatcattcctcagtgtgg

SEQ ID NO: 4621 - DNA, 303 bp, Homo sapiens
ccaggcgcggtggctcacgcctttaatcccagcactttgggaggctgaggcgggcagatcacgaggtcaggagatcaagaccatcctggctaacatggtgaaaccccacctctacaaaaaatgcaaaaaaaagtagttaatttgttactcagcaaatctctacggtgcctaccagactccagatctgggctgctggacacaggaacatcgttaagcaaatcccggccgtcgtggaactgacagcctggaggggacgcaagagacttgggcattcaacagataacttcagagtcccaactgcag

SEQ ID NO: 4622 - DNA, 248 bp, Homo sapiens
agaacaagtctataaaagtagaaatcacatacaaaaatacagattactctgacatgttggcaaaatagcttatggctggacttgagtttggaagttctgtatgtttgagggcatccgatgtcagagtccaaccggatcctaaccccagctcttgtcactaatctgtaaacaataatttcaagtagtatttagcactttttaactattaagaaattgaagcatcatcatttcctgtgcaacccaacttt

SEQ ID NO: 4623 - DNA, 463 bp, Homo sapiens
  misc_feature (1)...(463): n = g, a, c or t
tgaaanacagtatggaagttcctcagaagaattagaaatgctatatgattcaggattcccacttctggatattaaaaaaaaaaaaaatgaaaccaggatctggaagagatatttgcactccccatttcattaatgcagtattcataatagccaananatggaaacaacctaaatgcccattgatggttgaatgaatttagaaaatttagtatatacgtacaatggaatgttattcagccatagaaaaggaaggaaatactgtcagatgctgcagcttgaaccttgacaacattttgctaagtgaaataagccagccacagaaggacaaatactgcatgatttcaccaatatgaagtatctaacgtagtcaaacttatagaaacagtagaatggtggctgctgtggggagggggaattggggaactgctgttcaaaaggtatagagtttctgtcacgcgagttt

SEQ ID NO: 4624 - DNA, 452 bp, Homo sapiens
ctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagaccggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtagg

SEQ ID NO: 4625 - DNA, 493 bp, Homo sapiens
ccatcagaggaatgcaaatcaaaaccaccatgacataccatctcacgacagttagaatggtgatcattaaaaagtcaagaaacaacaggtgctggagaggatgtggagaaactgaacacttttacactgttggtgggactgtaaactacttcaaccattgtgaaagacagtgtggcgattcctcaaggatctaaaactagaaataccatttgacccagccatcccattactgggtatatactcaaaggattataaatcatgctgctataaagacacatgcacacgtatgtttattgcagcactattcacaatagcaaagacttggaaccaacccaaatgtccaacaatgatagattggattaagaaaatgtggcacatatacaccatggaataataagcagccataaaaaaggatgagttcatgtcctttgtagggatatggatgaagctggaaaccatcattctcagcaaactatcgcaaggtcagaaaacc

SEQ ID NO: 4626 - DNA, 544 bp, Homo sapiens
  misc_feature (1)...(544): n = g, a, c or t
ccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggntttcatttgaaatagactgntgaaagtttt

SEQ ID NO: 4627 - DNA, 387 bp, Homo sapiens
ccttttttaagtgacctgtaactcatatcagtgaaaaagaacatgctataaaaagattccacaaagtgagagcattaagctcaaaggtcctgaggtaggtgtgtttgaggagctggtgtgtagctgctgtataagaagtcaacctccttattttcaggtacatttattattattttaaccccaagcagaattgcctagctgggtccctcacctttacacaatagtcataggatttgactgttatcaaaaagtaaatccactctcagagaccatagatttcctattactgaggttcttcaaaagaatatgtaatcaatttatatagtaattcctaaaaatgagattctaaaatatagtagcatgcagatgaagcatagctaatgcttt

SEQ ID NO: 4628 - DNA, 350 bp, Homo sapiens
aaaatgaacatctctgtgtgccacagttcctaggactggggcaaggacacagtgtcaagtcttgttttgaggatgagtctctgaagagacagaattcctgccagaatgcgcacagaacataagtcagccaagtgtgtcgtgccagggatactttgactttggtttgctgctgctgctgctagggatattgggagggttatcctttccaggttgtaggagagggttgtgggtaaaggtctgtcgtaaaggacccctggctgctagctccaactgattccgcatgcgttgttcacgctctcgcagaaattttctttttgtttcactggaaaggaaagatgatgctcagtttt

SEQ ID NO: 4629 - DNA, 446 bp, Homo sapiens
aaataaggtaagtgaaatatgggctcagaattaaataagattttcaagaaagttcttgtagctgtaaaataggagaatatgaatgtcaaaattttgactgtttctgtgccaaacagaaagtttcacaaatgctttccaaactgcaataaaaagaactttaataataccattaagtctacaaagttactgtcaagttgacagtattcaaatactacaatattttctaaatgtaaattttgtaacatcttgaatactttctaagcccacttttctgtcattacaaaaataaaattccaagaaatttctgctacattaatcttaagagatcaaaataacctatgtagttttctaggttaatgtaattcaagtaaagtggtactaaagaaaacacatcattttaataaaaaccaaacctgcttaagagacataacagagttaagcaaaag

SEQ ID NO: 4630 - DNA, 332 bp, Homo sapiens; identical to SEQ ID NO: 4096

SEQ ID NO: 4631 - DNA, 508 bp, Homo sapiens
ctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctacatatgctagaactctatctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcattt

SEQ ID NO: 4632 - DNA, 207 bp, Homo sapiens
ctcactacgcagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttca

SEQ ID NO: 4633 - DNA, 609 bp, Homo sapiens
  misc_feature (1)...(609): n = g, a, c or t
aaagcaaaaaaaggatttattgaaatcatgtgacaatatatccctaacaccatgaagaagatgacaattatgatttccatagagtattttgcacttgcctaagcacaaaagcaaaaccagagcaaggcaaacaatatacaaacaaaacttgatcctatctaataactttcatgaaacaaccataaatgaattttgttttattaagtcaggcttcaggactactgaattgcattcactaaaatgctatttgaaattttacttactcgccacccaccccactactcttaattcatcgccctctccacaaaaggacaaaaggcaaaaaaggtagtaagcaaaatataaataataagaattcaaaaacagagatcaaagtaaatttttttttcagtctctgcgtctatgctcaaatcaatgttttctgagcatacagggaagcaaggaaaccaattctctagctcttgctctgcctcttattctcctccaccccccaatacatttctgaatattttttaatccatttatcactgagtacttgcatataactagaagcaccgactatattgntatcaactttggagcaattttcatggggaattgnacaaatga

SEQ ID NO: 4634 - DNA, 460 bp, Homo sapiens
  misc_feature (1)...(460): n = g, a, c or t
aaaaacactttatttaataaaagttaaacatacaaaactgaaataatacacatcctaaaaattaccttcttccattaataggaagacccttttctatgcatgtatttggcttaaactcaactcaggataactgtgatgatgttcacttacaccaacaaatgcagacaacctgatctaattaacaaaaattacaaacagctaaatgaacataatatacagggaaattatcgtcagattaatgcacaagaaatacaagaaatttttaatgatgaaatattcagtatccttgttcattaatttagccttgtgtttttacaaaaatagtatctacactgtatacagggctatacatcagctttttgttctcccatataaacatcacacatccatttancggcagtggtaccatgttttggatgtgtgatgtttatatgggagaacaaaacatggtaccactgcc

SEQ ID NO: 4635 - DNA, 607 bp, Homo sapiens
aaaaaagaaataacattcaaaacaacttatatattctgtttctgtctacttagcacattttcacatttctttccccccagaatataaggcatataatcatttataaaaccacattaatactagagtaaaatatagaactatagaaaaatatcactatgttggataatggggagaagtctgtgtaaaacaaccaagtctgagttatgaaatattctccaacagatataaatagatgtaaatataaatatttcttaacttcaggtttatttggtaacgaaataatggcttctaaaaaattgtcaagaagagacagatccaacctttaattggtgtgcaggcacattgcttatagtggacttattaaattccaaatagcagttaattgtataacttaaaactgcatcatagaagtatttaccaatttcttttcaaaacaagtgtgctcactcagatttcctttcataattttgatagcatccaattaatgaggttttgctgtgataatattccagaataaaaaacattcaatgtgtcaaacaaatactttgaaagaacagcttgattaatgtgtagaaaacaggtttactcctagcagctctctgctatg

SEQ ID NO: 4636 - DNA, 427 bp, Homo sapiens
aaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtatttt

SEQ ID NO: 4637 - DNA, 476 bp, Homo sapiens
  misc_feature (1)...(476): n = g, a, c or t
tttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcanaaggctttgcacantnntatatgagtgggtttacnggtanatnatgntatnttttacaactaatnttgnactctcanaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaa

SEQ ID NO: 4638 - DNA, 274 bp, Homo sapiens
ccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgtttt

SEQ ID NO: 4639 - DNA, 332 bp, Homo sapiens; identical to SEQ ID NO: 4096

SEQ ID NO: 4640 - DNA, 567 bp, Homo sapiens
gcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccag

SEQ ID NO: 4641 - DNA, 475 bp, Homo sapiens
aaaatagtttaatgaaaaaataaatatagtgtatgaatgatctaagtatgagaaatagcaaggacaaaatagcaaatatttttgtaggggagaaggaatctgaatgtgtatggaatattaaggagaataagaaattaatttaacaggggctgtggcggggggtgggagaacatgaggaaaaatagctaatacatgctggacttaataccgaggtgatgtgttgataggtgcagcaaaccaccgaggcacacgtttccctatgtaacaaacctgcatatcctgcacatggatcctggaactgggtcagaggtatagggttaatttctcttgctgaggctcagatttctccttcatgcatgtttaatggtccacctaagttcaactggaggagcatctttcttctttgttaaccaaacatgcccaggtagagctgcttctcttttctatggtagctgctgagttctgactgtgtcag

SEQ ID NO: 4642 - DNA, 388 bp, Homo sapiens
aaaaaatgtggcgttaataacattcaagccaagagccaaatcaggaatgcaatcccattcacaattgccacaagaagactaaaatacctaaaaatacagctaaccaaggaaacaaaagatatatataatgagaattacaagatacccctgaaagaaataagagatgtcacaaacaaatggaaaaacattccatgctcatgaataggagcacagctttgtaaataaaggacatagggtgaggaagccgggttgttttaagaagcctgtgtcccctgtgaaaaggcccatggcatatcttgtagaattacaaggagttcattctgtagcaggatgagctgcagacaaaacttctcagacaccgagttggagaaggaagggcttttttcag

SEQ ID NO: 4643 - DNA, 451 bp, Homo sapiens; identical to SEQ ID NO: 3176

SEQ ID NO: 4644 - DNA, 367 bp, Homo sapiens
aaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaa

SEQ ID NO: 4645 - DNA, 367 bp, Homo sapiens
  misc_feature (1)...(367): n = g, a, c or t
aatctgaatgtgtatggaatattaaggagaataagaaattaatttaacaggggctgtggcggggggtgggagaacatgaggaaaaatagctaatacatgctggacttaataccgaggtgatgtgttgataggtgcagcaaaccaccgaggcacacgtttccctatgtaacaaacctgcatatcctgcacatggatcctggaactgggtcagaggtatagggttaatttctcttgctgaggctcanatttctccttcatgcatgtttaatggnccacctaagttcaactggaggagcatctttcttctttgntaaccaaacatgcccaggtagagctgnttctcttttctatggnagctgctgagttc

SEQ ID NO: 4646 - DNA, 475 bp, Homo sapiens
ccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcag

SEQ ID NO: 4647 - DNA, 474 bp, Homo sapiens; identical to SEQ ID NO: 205
  misc_feature (1)...(474): n = g, a, c or t

SEQ ID NO: 4648 - DNA, 231 bp, Homo sapiens
ctggagacactttagaactctttccccatcctccaccatagtgcaaacttcacgcttctctgagcacctccaaggtatgcccttgaagtaaaacagaaaagggaagaaagggggctttttcttttccatttctgaccaaacagaggtctgaaatagcagtgtattatgaaattctcattccctgcaacagtcagccaccacttggaaaatggctatttttgccataaacta

SEQ ID NO: 4649 - DNA, 357 bp, Homo sapiens
ctggaaattgctgctagaggaggaggcttggctgaatgactgaattaatagtacatgtacagggcttacgaaagcactcaaatgtcaaaattttggcttgggagactctacccccatcctctccttttctaaggatctggatccatcaaccatttgtttccactaaaagaaaaccctggctcagaaagtctgcaagtgcagaggaatggaggatgagtaagtcacaccagcaggctggctcagatggggagaaccctgaggttgggtgaatgagtggaaacggaatgactccagtagctggctctactgcgcctttttctgcttgtggggaggctttgcattccagtagaagagcag

SEQ ID NO: 4650 - DNA, 189 bp, Homo sapiens
agaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccagctataaacttataaccccag

SEQ ID NO: 4651 - DNA, 320 bp, Homo sapiens
aaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagttttt

SEQ ID NO: 4652 - DNA, 448 bp, Homo sapiens
ggatgtaggatttctttttagagtgattaaaatgttacaaaattgctggctgggtgcagtggcttatgcccataatcacagcacttcgggaggctgaagtgggaagatccaggagttgaagaccagcctgggcaacatagtgagaaaatgtctccctaaaaggaagaattaacctcatgtggtggtgtgcacctgtagttctagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgcttt

SEQ ID NO: 4653 - DNA, 600 bp, Homo sapiens
  misc_feature (1)...(600): n = g, a, c or t
ctttttttttttttttttttttttttttttacttggttgataanatgttgaanaaaccatggaattatacacagcactatacattattactatanaatgtctggtccctcccatcataaatatggtttaatgaaggtattgaaaaacttcacaatatcgagctgcaattcttttttctttttatacaaatacaagttaattagctctattaagttgcaattttatttttataaagctttgtaaagttatgaacatggaaaccctaanaatcacctaagctttttacataagtaaatttcaagttgacagtctgtccattttgaactatttataattaacaggacacttaacacagtaatatcttanacaaggaagagggcattaattntgcaggcaggtagcaatgaaaatgccaaacctgaacaatcagtcactatttccttatacagtttgagtaaaagaggtngactacagaaagaaaaaaaaaagngaatntaaaatgtatnttccccaaatacaactctacttcaataagtcttgaagattaccgatgacntcaacaaaaatgaatgaactcagggaatgagttctttntcccca

SEQ ID NO: 4654 - DNA, 286 bp, Homo sapiens
aaaaaattacacggagcaatttccagcttatctttttttataaaagtactgcctatatcaaacattttatatcacgttaattccattgaagagctgcctttttctgttaaggtactgattccaattgatgggatacatgcccttaatacagaaagtttccattatttattcaaatatcaaaattaagattattgagaagtttattgctttatggctgggcaagatgctactagcacattttaggtaaataatattctttattaaaaactatgaggtcattctgttt

SEQ ID NO: 4655 - DNA, 297 bp, Homo sapiens
aaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttgttcaaatgattttaattattggaatgcacaatttttttaatatgcaaataaaaagttt

SEQ ID NO: 4656 - DNA, 332 bp, Homo sapiens
  misc_feature (1)...(332): n = g, a, c or t
aaatagaaaacagtatattgaaagtggngggtttgatctttttatttagaaacccacaaaatcagaaacacagtacaaataaaacagaagtcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttcttt

SEQ ID NO: 4657 - DNA, 464 bp, Homo sapiens
  misc_feature (1)...(464): n = g, a, c or t
ctttttttttttttttttttttttttacaaaacagtatattttattttacaatagcaaccaactccccagtttgtttcaattgngacatctanatggcttaanattactttctggnggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgngtctgcataaaagcagatttattcatcacaacttcatttatgtgaataaagcagatgatgataaaatgttctcttattcttgtttaatcagtagtggtagtgatgccanaaactgngaaaggaaggcttttagttactttcttctttccattttccaataatccattccccatccccag

SEQ ID NO: 4658 - DNA, 505 bp, Homo sapiens; identical to SEQ ID NO: 645
  misc_feature (1)...(505): n = g, a, c or t

SEQ ID NO: 4659 - DNA, 387 bp, Homo sapiens
ccatttccaagtaacacccactgcatgcccatcaataaaagagaaccataacaaaatagaaaatttaccatatggctatgattttaagaaaaaaaaaatgcggacacgagcacatgagcaaagtccaatattaaagtaacattccttcttacgggctatgattaggaatctgattagataccagaataaaaatacaaatgctgaactatttaggtcaaagaacctctatagaagcatctgtcttcaaaggcattccagtttgagactcaattttagaataaggcataacaaatatgttaacaaaagacatacacaaagtgatgaaagagggattctataattccccacatactctgaacctaataaaacaaatctagattttttttt

SEQ ID NO: 4660 - DNA, 450 bp, Homo sapiens
ctgtcttgaggaggaagatgaagactgtgaatgaaggacagcagacttgcttctaggaaaataatatatgtaagttgggatgcctcttgcagccagatgtttccgaataagtcgctcagtaccataccagttaaaacctttcgtggcatgtccaatacgtggaagatgagcacttgctttcttcttttttgctgctaaaatatcttcttcaggccctcttctagggctgccatcttaatgccagacaggacattggaacgatcacgatgctgagccacaatcaaggccaacaaatcttgccctttgtttcttgattctttatcatcaacaggaaataaaaggacacctcccaaactcaggtctttcattttcccagccagctcatatattttttttggctcagcggatcgcttttccagagctgtaaataaaccacctctgccccagtgg

SEQ ID NO: 4661 - DNA, 238 bp, Homo sapiens
aaaatatgtttattttgtatgttttacaatgaatacttcagcaaagaaaataattataatttcaaaatgcaatccctggatttgataaatatcctttataatcgattacactaatcaatatctagaaatatacatagacaaagttagctaatgaataaaataagtaaaatgactacataaactcaatttcagggatgagggatcatgcatgatcagttaagtcactctgccacttttt

SEQ ID NO: 4662 - DNA, 196 bp, Homo sapiens
ccaggtgaaggctggggggagtgtggtgatggagtccagcaggggaactctggacaggcttgactcaagccagcttcaggaactcctgcagcgtgttttgttccacagcctccacgaagagctcatagtccccacagtactggtccccgttgacaatctggggtggggtggccttggggttgcctgccaaggctcg

SEQ ID NO: 4663 - DNA, 251 bp, Homo sapiens; identical to SEQ ID NO: 4543

SEQ ID NO: 4664 - DNA, 338 bp, Homo sapiens
aaaagaacttccccatcagcttctgcaaggttatttttacatagtctcatgcttatttgtatggggaagttctttttcctggaaaagatttaactaagcacaaaactaaaatccagagcagggataagggaagaatgcaggtgttcttagtggaagtatcagcatcagggaatctttctcttaaacactggaactggtagagttgaagaacttctttttctcaatacttccatcattctttgtatccattcatcagggaggaaagtttctttgaaaatagttattcagttataagtaatacaggattattttgattatatacttgttgtttaatgttt

SEQ ID NO: 4665 - DNA, 293 bp, Homo sapiens
aaaagacatacacaaatctagtacatcaataaccggggatttttcttttttgctatactattttcacaaccacgggtgtgcttgctaggcaatataaccatcacagaagcaaacgttaggcagaatactggtaagaaaaaacaaagcaagaaaagagctaccagatatacagacaggcttggttccacattcactactgcattttcaagcgccaagtattaactgcacatttttgttcagctagaaaggagggatttttttttttgtttttttctttttttttggtttgtttt

SEQ ID NO: 4666 - DNA, 468 bp, Homo sapiens
ccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagagg

SEQ ID NO: 4667 - DNA, 408 bp, Homo sapiens
ctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgttggaaacaacgtggaggtagatgagtctttgttccaagaaatggatgacttggagctggaggatgatgaagatgatccagactataatcctgctgacccagagagtgactcag

SEQ ID NO: 4668 - DNA, 557 bp, Homo sapiens
ccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaag

SEQ ID NO: 4669 - DNA, 247 bp, Homo sapiens
cctcttccatgtcctggagttgaatgagttcaaagattggcaataaaggaaaaaagaaagcattacgggtatgacgggaacaagctttggagtttatcgaacagtcacaccaagtttctctagcacacggacacccttttcttggtactcttgtcgggtcatccaaaagttgtctttgtctttcatgatatccgctagaactgcaccacccaggaataccatgtgctttctgcggggtgggtcttca

SEQ ID NO: 4670 - DNA, 228 bp, Homo sapiens; identical to SEQ ID NO: 3993

SEQ ID NO: 4671 - DNA, 473 bp, Homo sapiens
ccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacag

SEQ ID NO: 4672 - DNA, 317 bp, Homo sapiens
ctaagcttgttgtggtcacctattatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaatttt

SEQ ID NO: 4673 - DNA, 453 bp, Homo sapiens
ggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaattt

SEQ ID NO: 4674 - DNA, 606 bp, Homo sapiens
aaaaatataaagatgcagtatcatttctgatataaagttacttaaaaaaatccaaggtcttagggaattcacaaatcataactagaagtaacttttattaatttaatgtacacataattaccaaattttaatacattaaaaatgtgtaaatgcccacagactgtacaaaaattaacaccccattttgttaaaagttcccaaccacctcccaccataaatatacaaaaacctatttttagatatgtcaaaattgcatgcatgaatattttctaaagcttgaattttgctcttcactggataatgttatctatagctgtttctgtaacagactacataaacattgatatattatttaccatgcctttgaaactgtgcaggactttcataaacatggggaacaaaataaatagagtaaaaactgcaacagttttgtttagatgcaagtgcaattgggaaagctttcgaatttcaggattataaaactactataaaagtatttattctgttgttggcttagccacttgtattcaagcattatttgcagcattgctttacagcagttggtgctagaagatacaaaacatatagttaccactatttatactt

SEQ ID NO: 4675 - DNA, 171 bp, Homo sapiens
aaatgattttttttttcaaatagaaaaactaaagaactgaactatcacaggaatttttcttcactgcagaagctgagatgttccagtaggagaagtaggagatatcttcacttgattggaaaataaacaccgtaactcaaggctctgctgagtacataaaaaatctggtga

SEQ ID NO: 4676 - DNA, 590 bp, Homo sapiens
ctaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgta

SEQ ID NO: 4677 - DNA, 525 bp, Homo sapiens
  misc_feature (1)...(525): n = g, a, c or t
gaaagacagcgcaactttgaatgctttcttacttgttttgtgacccaatttatgtggnagattgttatttcattaggatttagtaaaatttttttttctgattctaaacttattgtgaaaattganctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaactnggtctttgttaggcttgtcaaattgccttcatggaaaaataatctacaaaagtatggtttaattgattgtcttacatgataattttccctggtaacaacttagtaagtgatatatcttttttcctaaattgcttaaatactgngaaattgctctgacaaattggaagtgtaccattggcatatttgtcttcctttttatgcatgatggtaaaataaaagcatgttgntctgctaaaaaaaaa

SEQ ID NO: 4678 - DNA, 262 bp, Homo sapiens
aagcgatgctgccaggttcagactggttactacttaaaggtgaagaactctctctctctattggagtcagatggctgcccgggaccacgtcaggaatattttcttcagtagtcaccacttctgttatactagaaagttcttctgtatgttccacttttcctggattgtcttcggtatgcatgcctggaactgttgctggagacaacggctcttcacagaccacctccttttctaaggaaaatggctggtatgacgtgatgag

SEQ ID NO: 4679 - DNA, 601 bp, Homo sapiens
  misc_feature (1)...(601): n = g, a, c or t
aaagtgcaatttattgaaaggtttaagcaaatcaggataaaggatctttctaataaatgactaacattaaagagatgctatattgatatatttagataaatctttcaaaaatcataattgatttctatagatgccaaatttacttctgttgtaacaatgacctgcccccctcaaaccccaaacttaattgctgaggattaagaagatcctctaattggcaagagctttttctgatgttaatatttttgtctgtttcaatacatctaactaaaaagaactatgggtctagagtagttgctttagcagccctgagttctataaccacaatggtattcctgttagaacttaagagaatgttgtgaacgttccccattctatttgaggagaaaacaaagaactcagttgctttctgatttagcaaagtaactatgctttgggctatagtgttaatgtctaagataaaggtagcaaaaattggagttatctaagaatcagaaaatgcttcagagaaatgaactgtaagaggaatgtttctaggagctgtctgatggggtagaagggattgcaacacaaaggccatttactgntgngattgaatatt

SEQ ID NO: 4680 - DNA, 361 bp, Homo sapiens
aaaagtctttatttcctctgaaaacttactggtaaagtatacaatttatgaataatcatatattcatgctttttgaaatatatctgaataaaagacaaattattcaatatcaatagcagtaaataacttatttgcaagaaaattattacaattcctactgtaaagaatcaccaaccactatttagcaattaaatttcaacacattttttttggaactctttaggactttagacaaaggccaccaaggctgacaatccaggtaactatggcagtgacagaagtcaatcattaatactgccattattttagacaaagggctgacaatctcagaaactagttctagaaattatcatcaatgtgg

SEQ ID NO: 4681 - DNA, 598 bp, Homo sapiens
  misc_feature (1)...(598): n = g, a, c or t
caagctttttttttttttttttttttttttttgcgattgtaaaattttattactgggctgtttacatgatactttctttcttattaaatataacctgacaatctttattaaatgaaaatatttttgtatcatcaacaacaacaaaagaactaggatgaanaatttcccacattcttaatatttatagggnttctctccagtatacattctcatgtgtgctcaaaaggctgngtgaaggctttcccaaatgtcttacatttatanactttcaccccactctgactcctttcatatattcacnctctanaggacagttggaanattttcccacttttattttttnttganacagngtctcattctgtcgcacaggctggaatgcagtggcgtgatctcagctcactgcaacctntgtctccaggttcaagtgattctcctgccttancctcctgagtagctgggattagaggcatgcnctaccatgcctggntcattttttggnaatttttantaganatggggntacnccatgttgaccacnctggnctcgaatttctgacctcaaatgatctgcccgccttgcaccttggnctccaaa

SEQ ID NO: 4682 - DNA, 391 bp, Homo sapiens
ctgctgttagtgtagcaacctcgcttttcatctgtttagcaatggaggaatgaatagcaccacacagtcctcgatctgaggacacaccaataaggaggtgtttcttcttgtcttcaggccccttgatatcagctttttcatacagagctaaagatcccaatccatatattcgagctggtttcagctctctctcagctcgggcatattttgctgccgctaccattttcatagacttggtaattttctggatgtttttgatggactttagtctcctggtgatatctttcaaagttgccatatttcgaacttgaatccattgcggctgcaaggtccaggccgacagcccaacgacacccgcgcgagagaacatggtagccacagccctgctgaa

SEQ ID NO: 4683 - DNA, 577 bp, Homo sapiens
  misc_feature (1)...(577): n = g, a, c or t
ctctagtcccagctacctgggaggctgaggcaggagaattgcttgaacccaggaggcagaggttgcagtgagccaagatcatgctactgcactacagcctggcaacaaagcgagactctgtctaaaatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggntgntgngatgccattacatctgtatatctgg

SEQ ID NO: 4684 - DNA, 252 bp, Homo sapiens
ctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattgg

SEQ ID NO: 4685 - DNA, 552 bp, Homo sapiens
ccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgagaaaatttcaaacacatgaaagtagagaaaatagcataatgaacccagtatgctgtcagccatcctcagcaatcatcagtgactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgag

SEQ ID NO: 4686 - DNA, 281 bp, Homo sapiens
  misc_feature (1)...(281): n = g, a, c or t
ctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattattttaagaaaaacatgtcatgtaggttgnctaaaaataaaatgcattt

SEQ ID NO: 4687 - DNA, 292 bp, Homo sapiens
aaaaaaacaatatttgcttctataacaaaaggaaacaaatctaagaatcattcctgtactacagaagggttaaggcaaaggtagccttttgggccttttaatgaacatgacccctatagaaaagtcaaggaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaag

SEQ ID NO: 4688 - DNA, 308 bp, Homo sapiens
ccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcattt

SEQ ID NO: 4689 - DNA, 237 bp, Homo sapiens; identical to SEQ ID NO: 206

SEQ ID NO: 4690 - DNA, 328 bp, Homo sapiens
ccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacactgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcag

SEQ ID NO: 4691 - DNA, 407 bp, Homo sapiens
aaaaatgttcattaagctccaatgattgtttgctgctatccttatctacagtcatgctgagtaaagctatagctaaatggaagttaaattgtattcacgaggtgttaatgtttacatcttattatctgcagtctctcagagaaagcaaaagtaactacaaatagcgctatgccagaaactggtttcttgaccaacaatgtcgcttcagcatgcaatgaactggttcattctaaagtggtcacggctgttgatgacaagaggctttgtatttttatatggcacatcttttggtccatgtgaaaacaagttttttgaatgttaactattttctgacactttggagttactgttgctcttcccatttccattaggtcgatatatggttcatggcaatactgtacaagttt

SEQ ID NO: 4692 - DNA, 124 bp, Homo sapiens
gacttgttcaagaataactgatatgccttcactcagaagaaaagaaatgaatgtgaaagaaagccaagcatcacttgcacttaaatcattaccacggaagatatattagcttcaactttagttt

SEQ ID NO: 4693 - DNA, 381 bp, Homo sapiens
aaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaaggaaaataaggaaatagaaataccgacgagaaaggagagtccttgaaagagacccaaggaaaccctgaattcatacccacgtcaaatatgcacatatcctgagatgatgccactttgatgaatgtgcattagtctgatttatcatgtaccttaagagagccagatggggtatgtttttgtgctgtgatatggtatttatacaggtacaaatataagg

SEQ ID NO: 4694 - DNA, 342 bp, Homo sapiens
ctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttgg

SEQ ID NO: 4695 - DNA, 544 bp, Homo sapiens
  misc_feature (1)...(544): n = g, a, c or t
aaaagattgtagatgacattggaatctaatttccgtatttgggtgctttcctagtattgtaagaatatgcttaattaatgagtcgcaatgaataatctgtttgtcttgatttgctttctgaaaggtgatgagggttttgggaaatggactttgttcaggcttttgccctttgtggctgtgacatattaagatgttggcagtaaaattgagagccaccagaagatgttaactgtgtatatgggcgctgccagataggaaatccaaatgagtagactatagtgttattgttagctactatggggtgagacgtagacagataaccatatgtaaggcagctccctaaatgctgaaacaaagaaccgtctcttgacttactcctgatgtctcatggtacatggtagctgccccaaaagcttgcaattaattgaaacttctcatttgttaggtggcaggtaggtangttttgaacttggtagtgatattcagacgaggagcaagattccacntggcagttctgtgatgcttaagtaaatgatgtgatcat

SEQ ID NO: 4696 - DNA, 208 bp, Homo sapiens
ctggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttattt

SEQ ID NO: 4697 - DNA, 249 bp, Homo sapiens
aaaaaaaaccgaaacttaagaactgaacaaggattacaaccacattccaataaagaaaattttccttcaacaaagcatattgttttgtttatatacaatatgtgaccaccaagagttttaatttagttgtaccaaaggcaaaacattatacttaaaattaaattacagatgcatgaagaataaaagtttaatgtatcaaagataatttgttatttaatgcactcaatgtcagtatttggggcaattttt

SEQ ID NO: 4698 - DNA, 159 bp, Homo sapiens
gtgtgagcagtttatttattcaaaagtctttgtctgctgaagtcagcatacccctgctgaactgagtgctccaatgtggcaactaggagtgggtgctcgtgctggagaggtcatttcgtattatttcatttactgctgtggcagcagggccgggggtgg

SEQ ID NO: 4699 - DNA, 372 bp, Homo sapiens
cctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttagg

SEQ ID NO: 4700 - DNA, 511 bp, Homo sapiens
aaaagaagcagaggtcaccatctccgagttcattctcatgtaactgaatgaaaacaatgagctgaaaataattctaagtttttttattgtttgacaggttcaacgttacagggtctgacaagtgtgtttttctgaaaaacacagaggtcagcagcatggaatgtgagaagaatttatactggatatgtaacaaaccttacaaataataaggaaacgtgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggatgaccaataaccatgcccaagaatgagaagaatgactatgcaacctttggatgcactttacattatttctggattcaaa

SEQ ID NO: 4701 - DNA, 543 bp, Homo sapiens
  misc_feature (1)...(543): n = g, a, c or t
ctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgntaaaattgtgcaaaataaaataaacattt

SEQ ID NO: 4702 - DNA, 554 bp, Homo sapiens
ctgtatttttttgcattcattcattttccattctgcaacctccatcacattagcagagtaaccagtaagttgttttctattttctaaagtatttttttctatcactatatgtatcacttctgagtcttacaggtatagagctgagtttagagagttgctaaaattcacctattggaccaaactaaggttggtacttggctgtttgttccccatctgagcctaagtctccagctcagacacatctctttatgggcacaactgggaacaacaaaatggcaacagttctacagctcataatataaccagtctgaagggttcccctactcacagaccccttcatttactgggagttaagcctcactgctaaataatatattttgaaactggaaaactgggcatgctgccttccacaatacaccactatactcatgattgcaggagggtggcttggggactaggggcaatgacacgggaaggatacaatcattgcccttacttatctttgatcttcttcccatcctcacactgaataatcacttgttcctaccttccct

SEQ ID NO: 4703 - DNA, 289 bp, Homo sapiens
  misc_feature (1)...(289): n = g, a, c or t
ctgggcaggcngtgggtctgcatcccaggagagggacccgaaactgggagacttggagattttatcagggctgtggaggacctgcctttcttctcctccagagatagatgactcattatccagcaacacagaggtcagcaccgacctcaccagcagcaggctcacaggagtggcaggggcattgggagagtgggaggcagcacagggtcagctctttcacgaaaacagagaaacggggcagctctagagtgggagtaggggcacagagaacaggaaggaaaggcggccg

SEQ ID NO: 4704 - DNA, 228 bp, Homo sapiens
  misc_feature (1)...(228): n = g, a, c or t
cgaggtaaaaaaaaaggggggtgctttgatgttagggctcttggtaggggtaaaaggagggcaatttctagatcaaataataagaaggtaatagctactaagaagaattttatggagaaagggacgcgggcgggggatatagggtcgaagccgcactcgtaaggggtggatttttctatgtanccgttgagttgtggtngtcaaaatgtaataattattantagtaag

SEQ ID NO: 4705 - DNA, 445 bp, Homo sapiens
cgacaccgtaactatccgcactagaaagttcatgaccaaccgactacttcagaggaaacaaatggtcattgatgtccttcaccccgggaagacgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgccggcaaaaagtgagctggagattggatcacagccgaaggagtaaaggtgctgcaatgatgttagctgtgg

SEQ ID NO: 4706 - DNA, 348 bp, Homo sapiens
aaacatggttagttgctagtacaaggaatcgtttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttccatgattagccgtgtaactcctgcaatgaatgtttatgtgattgaagcaaatgtgaatcgtattatttt

SEQ ID NO: 4707 - DNA, 465 bp, Homo sapiens
ccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatgg

SEQ ID NO: 4708 - DNA, 367 bp, Homo sapiens; identical to SEQ ID NO: 3183

SEQ ID NO: 4709 - DNA, 501 bp, Homo sapiens
aaaatacataaaattttctaaaacgtaaaatggaaaggtttaatacacaggaaaaacactgcacaccttaactaaacaaactagaaagaaaatatatttatatacagaactaagatgagtccattcattatttttacaaatattcacatagatggtttagagataagtagttaagtgtgtctcattaattaatggatgctttctagcctctgtcttcattaattttatttcctattcaacaaaaaataatgctttcaggatatattacatatagagcaatatcatttttatcagtaatttgtctgaaaaagagaaaaacttaaaagcagaaccctacaaagcaaagcaaactacaaagcaaagagtaatcacagtgtttgcaaaatagaaatgtgtgactttaactttatagcaggctgcctaattaatccagacagtagagaaagcagactgaggcaggaagtaagaggtgggactaaactgttaagaagataataattt

SEQ ID NO: 4710 - DNA, 468 bp, Homo sapiens
aaactcttcagtttacagagaaggatgctgaggacctagatgagaagttacctgcaaaaggcaaaagggttacttagtgtcagaaccaaggcaatgacttctctctcccagatctcctagctactggtcctgggccattttttttttaaataatcccaactttctttaaaagacaagcatttcagtaagctagttattttcatgggttgctcatccatttttttcagtgatctaaaaatgtagggagatggctactactgaagttgtctgtctacttgggataatagcaaattaattgaagacaatgggaaagtaagttataaaaaatactgggaaatctgtttctcttctgagcaagcattcagggcaggtataaacatcaaacatagtgacattgtcaaaacctcttccatttgaacattgattaattcatcaaataaatggtatagtaaaaaaaaaaaaaaaaaa

SEQ ID NO: 4711 - DNA, 417 bp, Homo sapiens; identical to SEQ ID NO: 3179

SEQ ID NO: 4712 - DNA, 437 bp, Homo sapiens
  misc_feature (1)...(437): n = g, a, c or t
aaaactcattaataagataccaaattcaagagattatagttacattgtaaaacgtaatcttcttttaataaaagctaataatgactgatgaattacaaatgcacttatttattggtgattacaaacaatacttaagaacttaagcagcttgagtagtagtttaagctagacagagcaaagaaaattcttgtttaatatatatatatttttaattccagtaatattttcttaaattcctgttaaaaatataatcaatattaaagtcagcaaaatgcctttgactgacgcctggattattttaccacttaacctggttacacagtgatttttttttttttctgtcagatgtaactgacaaccagtttagtctttctttaagataaatgaagtgataactcacattgcagcatcttgnggaaaatattcaaactacattt

SEQ ID NO: 4713 - DNA, 303 bp, Homo sapiens; identical to SEQ ID NO: 3177

SEQ ID NO: 4714 - DNA, 451 bp, Homo sapiens; identical to SEQ ID NO: 3176

SEQ ID NO: 4715 - DNA, 525 bp, Homo sapiens
  misc_feature (1)...(525): n = g, a, c or t
ctggtggcttcctgatttccgcccacagaaggtatgttcacactgagagagctctcccgccaaggggaggaatcacctgctttaatacatgttgttctcttctgtgctagtgtggtcatccactctgtataaacttatgtgcaacattaagacaaaaaaagggagttgagttgataagatgacttgggaggctctcatagttgtaataactatggaagacagaagaacatgctatcatctttatttttagcactcatatctggacctattactaaaaaagcttcttcattccttccaaccactagattataatggctaaaaagtcttttccttaaatctgatgggtgtaaaaataaaaagtaacagcatttctctagggctctgtttttattttgttttgttcttcctttatagacacnacaaaaacaaggattaactttccaaatactcatggtgcacaagaaggttatntatgcncagtatttctaatttattcaaattcaatttgaatttggtctgaagcta

SEQ ID NO: 4716 - DNA, 507 bp, Homo sapiens
ctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcata

SEQ ID NO: 4717 - DNA, 403 bp, Homo sapiens
  misc_feature (1)...(403): n = g, a, c or t
attttaattaatcttttgttttttttttttttttttttagactcaagatatcaatgaaatatgcatatcttatttggagtgtatgattttatagcctccatcttttagttcagttttaagaaaaacagactaaatgatccctgtaatgtttgaatatgttactagctggagttccagaaaatattctggcatgcctttgaactttganagctcatttcgngggtgctctgatttaatgtcaactatgcaaaagccaagtaaatgcaagcactgaatacacaaaggccaaataaatacaagacaggacagaaaataaaatacatgcttaccagtaagaatgataagccttctccaaagaaagggaaaaattccctcatccaagcctcaaggtccaaacctcgca

SEQ ID NO: 4718 - DNA, 372 bp, Homo sapiens
  misc_feature (1)...(372): n = g, a, c or t
ttttttttttttttttttttttttngggttaaatacaggcttttttttttaatctgnaattgatttacatttgattttaaaaanacactgnttacatcaggtcaccacaaagcagatttacatacaaccttcaattgcggaaaaacaaagtttntttttgatccaaacncaaagaaaaacttctttgggtttttttttaatgatcttttccttgatcataaaaaaagtaaaaaatgcagtacttttanaaggtaaagctagtaagtttacanaagtgcaaaacnccaaaacacttgaagcaaaaacttttttttttttttttaaaaaaaaggtntgacttcttgttttctgntcttggcanaaattttaatt

SEQ ID NO: 4719 - DNA, 292 bp, Homo sapiens
  misc_feature (1)...(292): n = g, a, c or t
aagcactttacagtctttgtggcagcagaatatacttgtccatggttcatatcaatgctaaaattccggcagggaaaaaaatgatatgttaagcacccaaatcttcacatggagggggagggggtgggaaaagaaggaaaaaaagggaaaaacaaccaaaataatttaagtaaatgacagattggaaaacagggtttataaaaattattctcttgagtttataaattgttaaactcaatntatagctatgttaaactncgtaagaaccactatactgaaaacaccatttaag

SEQ ID NO: 4720 - DNA, 379 bp, Homo sapiens
ctgatggtcatctttgtttacaagccattacaggtttgaacaaattcaaaattgcctattattaagcctccgcaggagctactgggcataagcaaacctaagattttataacccagcaattatcctatagaaaatagtccagattattatattctgccacacctttattcatacttgactccaaaaagttctcaattattcacagggataatctagaaaataaatattagttttgctttcaaagacattactggaatgagcaggaacctgcatctttgttatattaattaacttattatttagttttcctgtctgcttagaaattggctgtttaggttgaaaaatgatttaagaagcataaactataacacaacaattt

SEQ ID NO: 4721 - DNA, 458 bp, Homo sapiens
gttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttatttttt

SEQ ID NO: 4722 - DNA, 428 bp, Homo sapiens
  misc_feature (1)...(428): n = g, a, c or t
aaatgtttttgaaaattgcaattcctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggttttttttttttttttttactactaagcttttncaaaagaagtntctgttttattgnatanaacaagtacagcattttactacatagtatacaagtttttaatgagcattta

SEQ ID NO: 4723 - DNA, 262 bp, Homo sapiens
aaatgctttaatgaaagttatgaatgggatttaacatgggaactatgcatatgcaatatcatatttttcatatcaatgaaaaattccataaaaatagctatattaaatttcatatgtaaatatttaacaaatatgtttgtattcttctatttttatacaatgaatattaatacatattgcatttatttattttaatgacatttatttaagttcaattgtacaaaacctaatttgttgtcaaaagtatcaagcaataaatttt

SEQ ID NO: 4724 - DNA, 625 bp, Homo sapiens
  misc_feature (1)...(625): n = g, a, c or t
ctgagttacaaggactaaaagtgaaaagcattctaaaagtccatgaacactgttgttcacacccttcttcagaacacactaaacttgtctgacacatttctcttcatacatagcaagcaacagcacccaataaaagcctgagaagaaatgctgctgtgtaaatactgcaactattcctgaaaaaagaattatgggatatatactccaaagctgcccattcccataatttgtattgcataggtcacataatcacacacatatatatacacatgtgtgtatatatatgcacatgcaagaatatattaagacgacaatgaagtctagtcacagagcaatttacaggctcaatatatttttttacactttgcttgaaagaaaatttcaatattttacagtctttcagtaggcattatatacactgcactttatgaaatctaaaaggtattgaaataaatttttccaacattttggtaacaaaacaaacaacgtttctccaaatacttgtgctatctacatgatgtttgctctgataatcactaatcacaaaaaactgactcaatggaataattagaaaaattgnctaacaccatgcatgggtttcaatcatttttaatatcctatccta

SEQ ID NO: 4725 - DNA, 428 bp, Homo sapiens; identical to SEQ ID NO: 351
  misc_feature (1)...(428): n = g, a, c or t

SEQ ID NO: 4726 - DNA, 582 bp, Homo sapiens
  misc_feature (1)...(582): n = g, a, c or t
ctggttctagtcaattctgaaccaccaccccccgccccccgcaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaaganaatggctgatgtctctttcttggaatatgtgaaataaatttagcagtttaactaaatacaaatatatgcattgngtaatccactcnanaattaaacagacnaaaggtatgcttgctttggaatgatttt

SEQ ID NO: 4727 - DNA, 424 bp, Homo sapiens
  misc_feature (1)...(424): n = g, a, c or t
attatccaggcntnaggcnacatctgtctagtgttgncttcatcaagaacagactatatactaattcccactanaagctgtccatgccatacanaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgttnttantagatgacatttatttcaataaaagttgcaaatngggcttaatcttaaaattggnggtcatttcaatggttgacatatttggctatttattaaccncctctt

SEQ ID NO: 4728 - DNA, 265 bp, Homo sapiens
ctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcattttt

SEQ ID NO: 4729 - DNA, 410 bp, Homo sapiens
  misc_feature (1)...(410): n = g, a, c or t
gtcctactgtgcctggctccagttnttttttttttttttttttttttttganacagggtctcattatgtcacccaggctggagtgtantgcaatcacagctcactgcagcctcgacctcctgggctcaagngatcctcccaccttagcttcctgagtagctgggatttcagcccactttntgctgaaagaactgccagcaggtaggaccccanaggcccccaaatgaaagcttgaatttcccctactggctctgcgttttgctganatctgtaggaaaggatgcttcacaaactgaggtanataatgctatgctgncgttggtatacatcatgaatttttatgtaaattgctntgcaaagcaaattgatatgtttgataaatttatgtttttaggnaaataaaaactttt

SEQ ID NO: 4730 - DNA, 539 bp, Homo sapiens
  misc_feature (1)...(539): n = g, a, c or t
gtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgntttcatgttgnttatttcctgnctgngaaatggngntttttttttttgntgntggntttttttttttttttttaacttgggac

SEQ ID NO: 4731 - DNA, 398 bp, Homo sapiens
cgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaa

SEQ ID NO: 4732 - DNA, 627 bp, Homo sapiens
ccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaa

SEQ ID NO: 4733 - DNA, 410 bp, Homo sapiens
aaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatacttt

SEQ ID NO: 4734 - DNA, 516 bp, Homo sapiens
aaagaaggtagataaatttattgccacttgaaaactaaatataactcagatgagtcagacaaaaaaaatcattgacattaaaattattattatttgaccaggtttgtcttttgaagatttctctcacaggcacttctgcaacaaatttgtataatttaatataaatattttgtgattattcttaaaggccaagcaatgggcatttatgatggctaatcataaatacacaataatatatattacatagtatatattaattgacaggttgcattttttctttgagcttatacacttttggaaaaagtctaccttttataaatatcaagttggatattcttgtctgttgcatttgctaaataagagtcaatagttaagaatctgtttcttttatatatgtcggattgtatccatttggaatacagaatcccctgcataaaactagcatgttttgctgaagtacttgttaacttgactctaaaatattttttattttcctaatatatagcatttattttt

SEQ ID NO: 4735 - DNA, 483 bp, Homo sapiens
aaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtcttt

SEQ ID NO: 4736 - DNA, 376 bp, Homo sapiens
  misc_feature (1)...(376): n = g, a, c or t
cttttttttttttttttttttttttttttctttttttttacaaacctcaaggttgttttatttaaaccaaataatctgagcaagacatatntacnttaaaaacaaatgaacacattaaaatttcactattttacaattaaattntagcaacatatacaaatactgagtgactacagtacatgccgaggtaananaagtacattctggganaatatnactgacgctcaaaccatttttatttccaatatgtatttcaatacatgtttgtttccacttttcccagtgccacacacacacacacacaaaaacaaaacaaancaaaaaaaancagncncaagttggattacattggaattggngccacagttaacttttt

SEQ ID NO: 4737 - DNA, 222 bp, Homo sapiens
  misc_feature (1)...(222): n = g, a, c or t
acagaaataaattaaactcttcatcaacaaagacctgtttttgtgactgccttgagttttatcagaattattggcctantaatccttcanaaacaccgtaattctaaataaacctcttcccatacacctttcccccataagatgtgtcttcaacactataaagcatttgtattgtgatttgattaagtatatatttggttgtncccaatgaagagcaaattt

SEQ ID NO: 4738 - DNA, 542 bp, Homo sapiens
aaaaaacaataaaatagtaattggggaaaaaacccttcactctattggtgtctttgtctggaaaactttcccagaatcactaaaattccaggtcaacaggtagtacctgaattattcaagtatactgtaatttgcttccaaatctgttagctgaagagagaaactaaaattttatccaagttaattcagtgcaaatcaaagcttcaagttgaaaatctgagagaaaaaataacgttcgaactgcaggaaatgcttctggaactgaaaaattaaaaaatcacattatgaagaaatctttgcaagtgttcttggtatatgaaatgctgagttaagaaatgggacccttttaagttgcagtgagggttctattatgaagactatttgcaatgtgggcaaaagggaaacagagagggaagagctgaaggttgtatttgtggaaggaaattcaagttaagcaaaaactgcttttattcaattctagaaaaatttggtgagatatatcatacattaggggataaaacagattatggagataaatttac

SEQ ID NO: 4739 - DNA, 417 bp, Homo sapiens
ccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtctataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatattt

SEQ ID NO: 4740 - DNA, 355 bp, Homo sapiens
  misc_feature (1)...(355): n = g, a, c or t
aaaaaaaagtncgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcannactagatttttaaggaantgnacattataatattggagctcagtactgcatgaagagacttcattaaaactaanaaaacatttatttggggagaaattttaggcatttaagaacttgtatttttctatttt

SEQ ID NO: 4741 - DNA, 342 bp, Homo sapiens
ccacttgtgtgggtcctcacaagcaaagagagcactaaacttgacattgggagtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagacca

SEQ ID NO: 4742 - DNA, 236 bp, Homo sapiens; identical to SEQ ID NO: 3153

SEQ ID NO: 4743 - DNA, 303 bp, Homo sapiens
aaaaacaggacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgattttt

SEQ ID NO: 4744 - DNA, 596 bp, Homo sapiens
  misc_feature (1)...(596): n = g, a, c or t
aaaaaataagtatacttgctagtactatcttcactcttttttttttcagaagccaatgttctctaaatctgcagcttcattccacagctttacagaatcataatctcttgaatatatttccaatgttattaaaaaataaaaaatcatacaagatatatttagcacattaaaacttaagaggttacagtataactgtccagacctccaggtaccactgaatacttttccagtacaaagaggccaatatgttagaataattaattctctgtatttacttttattaaaaagaggtttttggtagtaagaacaaataatctctcatttgttgcctgaaatcctaaaataggatcattggtttctaggcttgctacttgctgcttancaacctgtcctacttgcctgccttcctttctgttgtaaagtacagtggacatgggagcaggctgacgatagatgaatactcgacgaaggcactcacaaagggctgcatacgagtaatttggagcacaggcaaaaaattttttgnctctctttgatgcttggacatagcctaaagcattgaaaggtngcgatgtgctcccacatatcatcttgtt

SEQ ID NO: 4745 - DNA, 228 bp, Homo sapiens; identical to SEQ ID NO: 3151

SEQ ID NO: 4746 - DNA, 328 bp, Homo sapiens; identical to SEQ ID NO: 2874

SEQ ID NO: 4747 - DNA, 491 bp, Homo sapiens
aaaatagctttaaatgcattcttcacaagtaattcagcatatatttttatatcatgtttacttatgcttaagaattaaagcaagtatatttattactctgatggaaatatgggaaatctctcattcatgcaatatacagggataatattcaagcgaagggaaaattcccgctttttatttttgtaaatgtatccatatataatcatcgacatgacagatgaggaaacccatgaagtttcccactagtcagatatacattttcacttcatcagaagcacctgatatctacagctaatttataattagatactgtttcaatgaaaccaaaatgagccctacaagttcctataaacaaaagcttccaatgtactaggacagtcagtaattaatgcatcattcagaggattatggctgttccttaagaagtgcaagttcaaacctgtcaacaccagaggtaatcattttatattaatttatacgtaataccattt

SEQ ID NO: 4748 - DNA, 196 bp, Homo sapiens
  misc_feature (1)...(196): n = g, a, c or t
aaaatggttgaaaagaattcaaagaataataatattttgggacatgttaaaattatgtgaaattcaaatttcagcatccataaataaagttttattgaaacacagccaaaaaaaaaaaaaaaaaaaaaaaaaaaaaaaaaaaaaaaaaaaaaaaaaaaaaaaaaaaaaaaaaaaaaaaaaaacnaaaaaaaaaaag

SEQ ID NO: 4749 - DNA, 594 bp, Homo sapiens
  misc_feature (1)...(594): n = g, a, c or t
ctgctgacagttctttggtggaaaagtaagttgcgtacttacccaagctgcccaaatgattatcaagccaagtttgtttttcaaaaataggttttaagatacaccaaagaaactatacaatacaaaaatttaacaatgaagttaaagtatatagcaaaagccaaatatgacaacacacatgtataatgtagaaaagaatcctttcagtcctagaaaactaaaatggggagaacttactgaagggtaacatacataaaatgagtactaatagcaaggaataatcctaaacattttcccaataaactgactaagcctcaaaaggacagcttaggaaaatgattaacatgcagtttttcttttttcctagccaattcagttctacttagataaatctggttgccaatcaatacatatataaattaatttttttctgctcaattactaccattttttctttttcaccttttccccaattttctctancaacacttttcctttggtttgatcagttgaactcaaaaggtttggtacctaanatgagtatcaactgttattgcaatagcacttgggaaatgcaatcctanaaaggcgaat

SEQ ID NO: 4750 - DNA, 625 bp, Homo sapiens
  misc_feature (1)...(625): n = g, a, c or t
ctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacaganatgt

SEQ ID NO: 4751 - DNA, 414 bp, Homo sapiens; identical to SEQ ID NO: 3146

SEQ ID NO: 4752 - DNA, 373 bp, Homo sapiens
aaagtttatttcctttgtggatacaacattatttttacaaaaatgcaaattgggaggaaaaactaaggctagagaatatatcttctacttcttggcaaagcatgtttactattggtcaatgttattatttgactctatattgccaaagggataatcggggagaaggtcataggaattttcatccttctttaatagcagacattaaagatgtctcctattataaggagttatgtgaggtcagctaaaactaattatttgaggtcatacaaatgactcaaaattcttagagaaaccatgggtttggagaggaatcctcatatatatttcagaagaggagaaaaaataagatagaaataagatcttgtattttttt

SEQ ID NO: 4753 - DNA, 368 bp, Homo sapiens
aaaagatttacatgttcatatacaatttataaagttaaaaattctctgtacaaaatcttacatgtacagagtttatataagccccattcttatggctgtatcaccacacagatttgcttaaaactataatactacaaacactcgggttcttcatattcaatcttggcacccatatagcaatacactattctgaaatgtaaattacaaaggaaataaaatgtaatcatgcagacattttttaatataagaaaatgcgataaaatatactacaccagatcaacatttatcaattccatagatactgagttttcaacttactgcactgttttcatataagtacatgcaaaactagcagattatggattttt

SEQ ID NO: 4754 - DNA, 356 bp, Homo sapiens
ctggtgttcagcctctcaacagcaaaccatgagactacataactatcaggttttcacttcactttcttctcttctgtctaaataatcacaatgcctttaggcttataaaaagcatctaatcattacagtgtcttatcctttttaatgttctttccttttattaaactgtggcaagactgaatgtttaggaaaggtagcaatgttttggaggtaattttatttttgtataaatttatgattagaatattaagtcattgattgttaaagtaattatctaaatagaagatgttggattacaaaagaaaatgggagttaacatgattgcatgtcaaaatgtgggaaattgctggagttgg

SEQ ID NO: 4755 - DNA, 548 bp, Homo sapiens
  misc_feature (1)...(548): n = g, a, c or t
aaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggncatcttaattcatattagtgacacggaacagcacctccactatttgtatgttcaaataagctttcagactaatagcttttttggngtctaaaatgtaagcaaaaaattcctgctgaaacattccagtcctttcatttagtataaaagaaatactgaacaagccagtgggatngaattgaaagaactaatcatgaggactctgtcctgacacaggtcctcaaagc

SEQ ID NO: 4756 - DNA, 385 bp, Homo sapiens; identical to SEQ ID NO: 3139

SEQ ID NO: 4757 - DNA, 547 bp, Homo sapiens
  misc_feature (1)...(547): n = g, a, c or t
gtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgngtttgtcattagcctgagtagaaagg

SEQ ID NO: 4758 - DNA, 268 bp, Homo sapiens; identical to SEQ ID NO: 3137

SEQ ID NO: 4759 - DNA, 283 bp, Homo sapiens
aaaccaatccaatatacagacctttgaaagtaaaagatcaactgcacagatattttttaactaaagaatgtgtcagtaaatctatgtaaatatccaaattgacacaaattttctaaagagttaaaattattaaatttcaaattattattttatatacttttgatcaaaatataatatttgcttcaccataagttgaagatattaagaaaacataatctaaggtttattacaaaaaataatggcctctgatagatatacagagaataatatattcttaaatttt

SEQ ID NO: 4760 - DNA, 592 bp, Homo sapiens
  misc_feature (1)...(592): n = g, a, c or t
aaaaatccatgttcaacccaaacccactccccaaccctaactataggagatgaccctttaggaagctgaaaaggtttttataaagtcacaaaatgcatctcaatgcaagtttatataatatcaaaattatctcactgattttaatgtgtaagttatataatttatttcacccaccttgtattattctagaaaataagtcagcttttatatttaacaaatatgtgcaaaaatcataaacatagcttatagaaatataaacagatatctaattacaaagtttccgatctacttcgctaaaaggcccaagtcccctttttcttttatttataactttattttaagcagtctctccctgtcaaacttacctgtatgttttcgagaatgagtgataagagaactagagacagcaaatgccttcccacaggtatcacatacataaggcttttctccagtatacctacggacatgataggtcagtgtgctggcttgagcaaatctctgtccacacctatcacagacatatggnttctctccactatgcttccttgcatgaatcttgagattgctagaagttgcaaactgtaagttgcat

SEQ ID NO: 4761 - DNA, 139 bp, Homo sapiens
  misc_feature (1)...(139): n = g, a, c or t
aaaactcttctaactgccatagcaccagcctccacaaaatacttcagacacatatcatcaattccaccagtggttagaataacattggcaccagctttttttttttttttttttttttttttttcngnggaaatttttt

SEQ ID NO: 4762 - DNA, 181 bp, Homo sapiens; identical to SEQ ID NO: 3134

SEQ ID NO: 4763 - DNA, 408 bp, Homo sapiens
  misc_feature (1)...(408): n = g, a, c or t
ctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttanatagaagtttcaaagaagataaaaatgcttgaagagcctgagagtaaaaagattatgctgcaaagctatgatataaactgctcttgcagtccaaagggatacctgattaaagaagtttcttattt

SEQ ID NO: 4764 - DNA, 330 bp, Homo sapiens
  misc_feature (1)...(330): n = g, a, c or t
ttttttttttttttttttttttttttttacaagcnccaaactanaaccaaatttatttatcanaattattgagttggatgaaacagaaaataagccaacagaacacttaaaaatacaagtttattttctccatnttgntaagtctaattatgatttatttcaaaatcatgaaaagcanagcctagcataccaaatgctaggtcaaatttgctctggaaacttactttctanattatttttnggacttacttaaaaaataattaatttccattaatatagcnctaatagcctccaaattatactgcanaattcctatntgtaacctttttt

SEQ ID NO: 4765 - DNA, 336 bp, Homo sapiens
  misc_feature (1)...(336): n = g, a, c or t
ctgctatctancaagaaaaccaaggtcccttaatatagtctaaatataatgtgtggcttattatagagaaatctttagcaacgtaagtttaaccagtaagtgtcacaactgatcaacagtacttaaaaggaaacaaacaaaaatcacactagccacaaatttccaccatatacacatgaaattaattttaatctgttttgactccttgacactaactgatcattaatgaaatatgatatggaaagatcacagagtagaaaacaagcaaagattagtttatacaacagtgactatatacatcagagggaaaacatgctagctaatgcaacattaagg

SEQ ID NO: 4766 - DNA, 524 bp, Homo sapiens
  misc_feature (1)...(524): n = g, a, c or t
aaatttgaggtggtcttaagaataacaaatgaacagaattccaaatttttgaaataggtgaactgctgcagttacgggtatacatttaggaaaactgtatagctcttacaagaccagcaatgtaactttattttgtacatttttgaattgaaaatataaacaataattaaaaaataaaaagaaaatacagcataataaaaaacatacgcttctcaattaaatgtactggatacatataaattttaagggaagaagcaaaaaaggaaaatgattgatatttaagtgcagactgactacctagacaaaaaaaaaaagacttaaaaaaatatcataaaacctctagttcttctatgactaatatccatatggttggagtatcgtcactatggaagtgattttgttatgtttgcatatgttacactttactggtaatttacatgatggcttttaaggccctgggagacatggtttttggaaacaagattggataaaaatcactgctaanacgcaatacaccttatttt

SEQ ID NO: 4767 - DNA, 238 bp, Homo sapiens
gctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtcttttt

SEQ ID NO: 4768 - DNA, 431 bp, Homo sapiens
ttaaatgctatgtgttaatatttcacttgcttgtattagaaaggcaaaatgtaagactttggtatgtgtgacatatgctttatttggctttattttacaagcacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatatttt

SEQ ID NO: 4769 - DNA, 623 bp, Homo sapiens
cggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggtt

SEQ ID NO: 4770 - DNA, 410 bp, Homo sapiens
aaagtatttacccaaagaactcataaaaaggtcaatttggtaaaaggacattttgacccaagagcatctaatatttaagcttattttattggataagcatatctcttgtccatcacaagttatagaaaagttatatacgactaaaagaaaaagttatctactgtaattataggaagttgtcacaacaggaattcagctcaagaacttcttgcaattactgctacaacgtctataaatgggaaaagcaagcattaaaatagattaataaaatataaaattaagactggaaaatccagagacaagctgtatccttagaagaataaatagttaaaattattcagtaagctgacgtatttaaccattactgggcctgtaaaaaatgcattaaaattacattacaaatagttttt

SEQ ID NO: 4771 - DNA, 481 bp, Homo sapiens
ctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggttt

SEQ ID NO: 4772 - DNA, 596 bp, Homo sapiens
  misc_feature (1)...(596): n = g, a, c or t
aaaggttttgtatgtgtgtatgtatgtgtaaatagcaataaaagaaagattcaaaagtttgctaagttttttctttttaagccctttaagtaatgatataactagaaactacgtttcatctcaaaggaaaaaccacaggtgatatattctcatgcttcaggttaaaaacctctcttaaaaggctaggtttgcgaaagccttcctaaaattatgcttctgttgttactatcaatttgatattcagccagaaaaattaaaaataattattaatcccaaagcatactttcaaaatttctactaagaattatattaaatcaaaccaaactacaattttagagagatcaaactgagtaggagagagcatggtatgaaaatttactctccctttcatctaagccacacactataggtctcaataactatacaattactcttgtaattgactgatttctttacacctaaggatcattataacctgccatattagtttaatttaacataaaatcgtaatacagaaatttggtcacagtaggggatatctagatttcttctgcattgaaaagaatggtttccatttatctgngtttacaaaaaat

SEQ ID NO: 4773 - DNA, 386 bp, Homo sapiens
cgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaattt

SEQ ID NO: 4774 - DNA, 497 bp, Homo sapiens
gtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatacttttt

SEQ ID NO: 4775 - DNA, 539 bp, Homo sapiens
aaaatactggcactttaagaaaacgataatctcgaaaaccacaaaattgccaaattgttccctaaactcctaagcagataaacatgactaatgaatgagtttgttttgtaaagaaaaatcattcaaataaattgaataattcatactgagatgcaaagtttgtcttctttcttcctatctacttggatttataaaggggcaaaccgtaatataggaaaatataccctattttgaatgtggcatctttgtttgaaaagctggcccaattaattaaaaatacttgtaatggaaagtctcgtttcctgagcagtccatatttagataaatgggaaaagacatctatagccagcattttcatagtcttcactgagactaatgtcaacaaaaaatttaatgtggcagtcttgtattttaagctcacgcttttggggatacattctcaggtcttctttaatgtgggaactgcaaaatataactgccattacatggtaatgggagttaaagaatagagtcctcatgtaaaggttagaacatacttt

SEQ ID NO: 4776 - DNA, 544 bp, Homo sapiens
  misc_feature (1)...(544): n = g, a, c or t
ccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcatgttaccctttgtcagttattgngaatatgtgtattttaagcaataagattcag

SEQ ID NO: 4777 - DNA, 585 bp, Homo sapiens; identical to SEQ ID NO: 207

SEQ ID NO: 4778 - DNA, 253 bp, Homo sapiens
ctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatcttaaaaaaaaa

SEQ ID NO: 4779 - DNA, 144 bp, Homo sapiens
aaatatcggccaccactttcatgaggctgaatgggattcagcaattaggagcgttgcagggaagtgtggcagggcagaggtgggacaaattgcagatccctgtggggtcccttggttaggtgacaattagtctataaaacacag

SEQ ID NO: 4780 - DNA, 173 bp, Homo sapiens
ctgtggaggggacactgtctttgaggcatcactggttccacaaaaggtaggggaaggtcttgagggaccaccccatgccctcattaatcaaccagaagcttggcccggagcagcagcggggattccagtagctgtgggcatacaggatgctagggcggccacaacccaggcag

SEQ ID NO: 4781 - DNA, 534 bp, Homo sapiens
  misc_feature (1)...(534): n = g, a, c or t
aaaacaaatacaagttattgattcactcttctcaacttgacagtctacctgtggtataactgtcaggtaaaaacatacatctttacaacttggtggtcccaagttaaaaaaaaaaaaaaaaaccaacaacaaaaaaaaaaacaccatttcacagacaggaaataaacaacatgaaaacagctcaagaaatacactaacgagcaaaaatatntgaatatatggggaaagaggaacgtgttgttttgacttaactgaagaaaccaagaggaaactggtctacgtatgaaaatgtgcatcctggaaagtcaggngtcaagattttcgagtagggatctatatgacttgaatctccccctatttcctgaataaaagtgacatctttcagtatttatacttcatggntcanacacctacctcatttggctctattccttactcactctagcctttacttaaatgagtctgaaaaacttggggatntngcataagaagaaaaataatcncncntaatattcccctttntgnagctacttt

SEQ ID NO: 4782 - DNA, 463 bp, Homo sapiens
ccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccag

SEQ ID NO: 4783 - DNA, 106 bp, Homo sapiens
ctgtttgtgtatggggactgtgacggaaacagcaataattacctgaccaaggaggagtgcctcaagaaatgtgccactgtcacagagaatgccacgggtgacctgg

SEQ ID NO: 4784 - DNA, 386 bp, Homo sapiens
cagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcag

SEQ ID NO: 4785 - DNA, 213 bp, Homo sapiens
ctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaatttt

SEQ ID NO: 4786 - DNA, 393 bp, Homo sapiens
  misc_feature (1)...(393): n = g, a, c or t
cctgtccctgcagacatgagagacagcaggtctcatgggggtgacaagcttttttttttttttcttaaagaattttcaaaatcaaattccagaatgattttacggagatntcccaggaaaattaaggcttctnttaaacactaaaaaggcatgtaattgcttgttagcaaaatggatatgacacatctctgatacttttttnattattggttgggctgancagncaaaanacctggtcgncgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattt

SEQ ID NO: 4787 - DNA, 244 bp, Homo sapiens
  misc_feature (1)...(244): n = g, a, c or t
aaacacaaantagatatagatgctaatggtggctaatctggtatgtttcttatagcaaactgttgttcatgcaacacttgtgctcaaaggggaaggcacaggatttcctacaatgagccaccttataaagagttctttttgtacaaattaatttatgtcacatttaatttagtgtgcataacctcaaaactgaggtactattccaatttataaaaaccacttgcataacttttatgcaagtttt

SEQ ID NO: 4788 - DNA, 358 bp, Homo sapiens
agaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcggacagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcag

SEQ ID NO: 4789 - DNA, 452 bp, Homo sapiens
cctatctggttggcctttttgaagacaccaacctgtgtgctatccatgccaaacgtgtaacaattatgccaaaagacatccagctagcacgccgcatacgtggagaacgtgcttaagaatccactatgatgggaaacattccattctcaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggattttttt

SEQ ID NO: 4790 - DNA, 548 bp, Homo sapiens
  misc_feature (1)...(548): n = g, a, c or t
ctggtagtgtttcggatcttcagggaatagggcctttcattgggggcgtcgaaagaaccattttgccccttctgatgatagtgctgtcccctgaggtggtcttcctggggtgtctccatcctctcttcaccaccctccaataactgtgaagaaggaatcagagcgcatcacggtccactgcaagcactccaactcgacaccaatgtttccattttgttttcagaagatccagcctcaacttatgtttgtaaaacaagacgtgatgcttttgtgtgtgtgtgacctctgggggaggaaagatctatgaaaattcccaaggctacatcttcggaatatatcaggactacatctcatgattctatcataagtatcccaatttccaccctatattagggagagagagtcactgttgatgacagtgatatgctgtgtgtgaatcttgctggattatattttgngtctatgtatacatgtatagataggactgntctgnattaaatgttctcttgntttcttcagataccaactcacccactgaatgattccta

SEQ ID NO: 4791 - DNA, 237 bp, Homo sapiens
  misc_feature (1)...(237): n = g, a, c or t
ccttcccatcagcacagntcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagagg

SEQ ID NO: 4792 - DNA, 224 bp, Homo sapiens
aaaatgaatcaattttattccaattcttcaaaatttatacgtaatatgttgtttccaaaatgtaagtcaccctttatataatagttttattatttcatctttctttgatagttttttttttcatcttttctttatggttcttcagtagaagccagaatcttgagttgcccagttaggagcctctgacctgctattctgattaagtttcttctcaatattcatgg

SEQ ID NO: 4793 - DNA, 623 bp, Homo sapiens
  misc_feature (1)...(623): n = g, a, c or t
aaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaagcaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgnaatatatcctgtttgnatttttttccaagtgtataatgntggtgtggagttttcatgacagaatatacacattttgnaaatctgnacttttttcaaatattgaatgcct

SEQ ID NO: 4794 - DNA, 201 bp, Homo sapiens
aaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagttt

SEQ ID NO: 4795 - DNA, 507 bp, Homo sapiens
tgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcag

SEQ ID NO: 4796 - DNA, 509 bp, Homo sapiens
ctgcatcttgtccacgggagagaagtagtgcatgccaatcaccttctcaggtcttttgctgacagcagcgatttcactgattgggagagcagatgtgttactggcaaagatacagtgatctggaatcaccgcttctacttcctttagcactctgtgtttaagactaaggtcctcaaacacagcttcaatcaccatgtcggccttttcaaaaccttggtaatcaagctgcccagtcaagttgctgaagatggaatccctttcaaatgatgttagagctttcttcttcactttgtcattcaatcctttgaacacttgttgctgtcctcggtctagcgcagtgagggtggcatctttaagtatagtctttagccccttatccacggagacttgggcgatgcctgctcccatcagccctgcaccaagaatagccagatgcttaacatccttctgtggagctccaaatttattcttcttgcacaggacctgaccatggtagagtcccatcaagg

SEQ ID NO: 4797 - DNA, 374 bp, Homo sapiens
ttttaacaagaagcagtttattacacaaaacgaaacctgagataatagaaaataacacttgcagtaataaaggaagcagccttgcactccacctccacactccagagtataattaaaagactcctatcagacatttctatcaccaataatgccaacctctgtatacagcagcaggctgggccccaaatcagaagattcatgttgcttgctttctctatagggaaagtgaagctttcggtaagtatcatgtggctattcctggttctactttcccttgtggaaatgtaatacctggtttacactgctcttttgtgagtacgtatatggtgataggaataaaggagaaagtctggaaagcaccaagcacaaagcag

SEQ ID NO: 4798 - DNA, 251 bp, Homo sapiens
  misc_feature (1)...(251): n = g, a, c or t
ccatcttacctgcttatgtctcctacacaaagctaaatattctagcagtgatgtaatgaaaaattacatcttactgttgatntatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattt

SEQ ID NO: 4799 - DNA, 354 bp, Homo sapiens
  misc_feature (1)...(354): n = g, a, c or t
gtacaagctttttttttttttttttttttttttttttctttttaggattgaataacaaggctttaatggctcaattttnttatgattatacaaacatataaatcttgaaaaggtaacnccatttagtaaaatccataaaaataacagttttgccacagngcananaaaagttcattcagtttgattccccatgccctcgacaagcagntttntgattanagctggaanacacaggctgggtacagnggcgaccccgtagtcccagctactggggaggctgaggnggaaggatcacttgagcccaggagtttccgaacagtctgggcaacataccaanaccctgtctnttttttt

SEQ ID NO: 4800 - DNA, 529 bp, Homo sapiens
ctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaagg

SEQ ID NO: 4801 - DNA, 368 bp, Homo sapiens
gtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatattt

SEQ ID NO: 4802 - DNA, 388 bp, Homo sapiens
aaacaaatgtagactttattttgtactgtacaaagtgctaatgtcagtagatccattaaaatatagaatatttaagaaagatcattaataaaagtaatggtcattcaatttaatgttacagtttacagcgttttactgctagtgttttaagtcagcatgagcagtatcaaagtacttatgtagctagtttctaaaactttacagaaaacccagtacaattccaagtgcttatagccaatataagcatatttcatattagaaatagttatccatatgttaacaagaaactatggtcctcaaatatgccaattttagagtctaataactactgatagtaactatgtaaatattttggaataaacagttatttatgcaagccacacttcag

SEQ ID NO: 4803 - DNA, 334 bp, Homo sapiens
  misc_feature (1)...(334): n = g, a, c or t
caagcttttttttttttttttttttttttttttttctattcggttcagtctaatcctttttgtagtcactcataggccanacttagggctaggatgatgattaataanagggatgacataactnttagnggcaggttagttgtttgtagggctcatggtaggggtaaaaggagggcaatttntanatcaaataataanaaggngatagctactaanaanaattttatgganaaagggacncggncgggggatntagggtcnaagccncnctcgnaaggggtggatttttntatgtanccnttgagttgtggtantcaaaatgtaataattatta

SEQ ID NO: 4804 - DNA, 449 bp, Homo sapiens
aaaccaaagcctcagattttcatacaaacgacacgaccaaacttctaaagtattggtattacatcttaaaattgtcccgtatccttaaaaaaaaaaaaagtgtacactcacgtgccttacaggatattaaaccaaaaagctagaattaacaaacatgccaaatgttttcactttgaatcgtagacacagctcctatatttgagttttacagaaaggcatgtttctcaacatgcatccgaagttttcaatgtatttgtggtataagagcaacatttaacataagtgaaactgcattaacctaaatacgcttactgcttaggtacactcctacaacataactaacttgaggaaagctaaaaattgttttaacagttatggtcaatactgaactttgttattatgtcctagatgaatgtttcagtgttcaaaattactgagcttgaagtttt

SEQ ID NO: 4805 - DNA, 532 bp, Homo sapiens
aaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatgacttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttat

SEQ ID NO: 4806 - DNA, 416 bp, Homo sapiens
  misc_feature (1)...(416): n = g, a, c or t
atccactgtccatacccttggattggttgaagagcctttggtcatactgaacttcattggaagtccgaggattaggaacaccgagagcaataacttcactgatatcccgattttcatttctctgaagtttcgacctcttatcaggagctgccctggaaagattccggtcatgctgtctctcttttcgcctgtcatgccggatttcatccctctcacgtgcctccccatcctctttttccacatgagttttgatcccagctcttctttccctggctttctgggccatttctctaagtttctcttcatgnttttccttttctttctgagccattnttctctctacttgggcacgcatttccacagcttnacgagccttccgatcagcaatgtanagggcttntgccaatttggcgaaa

SEQ ID NO: 4807 - DNA, 483 bp, Homo sapiens
  misc_feature (1)...(483): n = g, a, c or t
aaattctctggatgagcaagaaggggttaaaagtggaatgtatgttgtaatagaagttaaagttgcaactcaagaaggaaaagaaataacctgtcgaagttatctgatgacaaattacgaaagtgttcccccatccccacagtataaaaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgnttttagactataaaaagaaactgggataaggagttagacaattt

SEQ ID NO: 4808 - DNA, 507 bp, Homo sapiens
ccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcc

SEQ ID NO: 4809 - DNA, 445 bp, Homo sapiens
aaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttcttt

SEQ ID NO: 4810 - DNA, 443 bp, Homo sapiens; identical to SEQ ID NO: 563

SEQ ID NO: 4811 - DNA, 563 bp, Homo sapiens; identical to SEQ ID NO: 352

SEQ ID NO: 4812 - DNA, 359 bp, Homo sapiens
cgtggagaacgtgcttaagaatccactatgatgggaaacatttcattctcaaaaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggattttttt

SEQ ID NO: 4813 - DNA, 434 bp, Homo sapiens
aaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaagg

SEQ ID NO: 4814 - DNA, 629 bp, Homo sapiens
  misc_feature (1)...(629): n = g, a, c or t
ccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggngacatgttctgagaaatgcttacacaaa

SEQ ID NO: 4815 - DNA, 269 bp, Homo sapiens
ccttcatgccccgaggactagcagacaaacaaggacctgaggaatgtgatgcagttgctcttttaagtctcatcaactcctgcgatcacttcgtggttgatcgaaagaaagtcacagaagtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacag

SEQ ID NO: 4816 - DNA, 348 bp, Homo sapiens
ccttgggtctaactgtgctttagtaaagtctgaattgtccaataattttctcatttcataaacacccttatctctttatatatagctatatgcctttatgtgtatatatacatgacttttttttttccttctcaaaaataaaatagccatccccatagagggaggttctcagcagcattcacagcggttgcagcaggagccatgccttctattaatgttagagacatgcaggacgaaggaaaatgactctccacctgctccctttaatatacagcagggagagagtttctaaagggagggaagtgataaggctgagcatgagatggctaaccagggtttttgtggttt

SEQ ID NO: 4817 - DNA, 327 bp, Homo sapiens
  misc_feature (1)...(327): n = g, a, c or t
caacagtcttacttgcctgtacaatatanagacatatgaatagtcataacagttttcaacttgttcttgtttctgntaaactatattcctagaaacatanntttgaacaacttggtctttgttaggcttgtcaaattgccttcatggaaaaataatctacaaaagtatggtttaattgattgtcttacatgataattttccctggtaacaactnantaagtgatatatcttttttcctaaattgcttaaatactgtgaaattgctctgacaaattggaagtgtnccattggcatatttgncttnctttttatgcatgatggtaaaat

SEQ ID NO: 4818 - DNA, 552 bp, Homo sapiens
ccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctttctatgttggcagataatctccccttatagcttccactcacttattcttgcattcagagtcacaatgatcatcttacccatgtggtttttgagaaagaaagatcaattctttgtttgcagtaggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcag

SEQ ID NO: 4819 - DNA, 393 bp, Homo sapiens
  misc_feature (1)...(393): n = g, a, c or t
aaaataattactctcacacataattttttttatcatgtaaatnctaaacaaacttctgaaggtataattacacaaattcttagcgatcacaaaagtanatgattgggctaatgngtcatttttctaactgngttntgtcgataatatgcaaaatttaggaatantgtanaaaaatgatgtatttnaatacagcttacaaatgaaacttttttggcttcacaangacatacttattatcataactgatacnattttcatactacantgctcttttgcttnataaatactcaagtnattntgngcgctgcntnaaattttacttttgngcgtcgccttccatccccttagtncatcttatagnagctgtaagttgatcctgtgtntcttgaagct

SEQ ID NO: 4820 - DNA, 254 bp, Homo sapiens
  misc_feature (1)...(254): n = g, a, c or t
tttttttttttttttttttttgtttaactttattactgttgcaccatttatacaattacatataatttcaatgcatccattgtacatttttttgttttttttttgtttttttttttccattttccaatgagtggtgtgttggtgtctgtgacacanaatggaananaaactggaactgcaatgaacncanactttttttttttttttttnatttccactgnccaataaacanaactacaggngcncccaaccac

SEQ ID NO: 4821 - DNA, 236 bp, Homo sapiens
ctgatggtttggaaatgagagaactacagtggtgaagagaccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcattt

SEQ ID NO: 4822 - DNA, 294 bp, Homo sapiens
ctgctcgaacactgagcttgtgtaaaagttgaaccatgaggccacaaaagcggtcaaaggttctgggaattcgggtctggggattcacttcaatcagaacattcttctgtgtatggatataaacctgtagcaagccagctcggttcaggggactatccatcagcatcagcaaactctggtgggtgatatctggccgcgcttccccagggtcccgtccattcttcaacaatatagacttgtgcttgtcacagttgagtagctcatatgtcttccctaccttgactgtctccagac

SEQ ID NO: 4823 - DNA, 222 bp, Homo sapiens
  misc_feature (1)...(222): n = g, a, c or t
gtacaagcttttttttttttttttttttttttttggngattttagcttattttattaatagcttatttccttacaaatatttccccacacgtttatttagtcgcaggcttcatgcatacaaaatgcacactgctatgatcatcgtaaccatcagcaagcaggcattgtcatcagcgcttctttatttctgnggtttctcagtctcttttattttctttcttt

SEQ ID NO: 4824 - DNA, 592 bp, Homo sapiens
  misc_feature (1)...(592): n = g, a, c or t
cctcagaatttcatacaaacaccaagaccaaaatcctaagtattggtattgcgtctcaaatttttcccattaacttaaaaaaaaaaagcttaaacttacgtgccttacaggttattaaatgaaactagaattaacaaacatgccaaaatgtttcacttttaatagtagacacagctcctatattgttttacaaaaaaataaaagcatgtctttcaacatgcatccaaaacagtgttcaatttaacgtggcaaagggcaacatttaacataattcaactgcttttacctaaatacgcttactgcttaagtacatcctataactaacttgagaaaagctggaacttaagtttaacagttatagtttactcagcttcactgttacatcctagatgagtattgtattcaaaaatactgggccttaagtcttcataacaatcctgatttccacttagagtaagcataaatcacaagcttgtattgcagaaactgttaaactgaagttttcttaaagaaaaaaaaaaaaaaaaaaggttgaccaagagtcagtgatcaggatcgatcaattacattcccnatccaccactcatactgg

SEQ ID NO: 4825 - DNA, 542 bp, Homo sapiens
  misc_feature (1)...(542): n = g, a, c or t
ctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcancacagtgtttaaggatgacnacgatgtggtcattggaaaggtgttcatgcagga

SEQ ID NO: 4826 - DNA, 447 bp, Homo sapiens
  misc_feature (1)...(447): n = g, a, c or t
gtacaagctttttttttttttttttttttttttatctggaaggttctcaggtctttatttgctctctcacattccaggaattgacttatttaattaatccatcaacctctcatagcaaatatttgagaaaacaaatgtatattcagattcttattttcagtagggaagtaanaagttgcagctcagtgcacataaagttgagacagagatggagacatccagccccacctttntggaacaagaaagatgactggggaggaaacacaggtcagcatgggaacaggggtcacagnggacacgggggngggctgtctntccacctcctcacattaggctaacagggacgcanacacattcaggtgcctttgcanaaaganatgccanaggctcttgaagtcacaaaggggaggagtgaanaaatcctgcatctcagtccctcacaagaca

SEQ ID NO: 4827 - DNA, 417 bp, Homo sapiens
ccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatattt

SEQ ID NO: 4828 - DNA, 332 bp, Homo sapiens
ctgcgtggagtgacgggaggagggaatcactgtgtgtgcgagagtgcttcagactcaatttccaaaataattttcacccctctaagcatgtaaatatacaaagatggatccttcatagaaattaaagaatcaatttgagctcatttcgaatacagaacaagtatggcacagatggaagtcctgccacgtttcctttaatgatgctgactcttgtatcacacaggccagcatgaagtttcttactcagactttacaggcattttccgtaattcaatcagtcctgctcccagcacaacacaggaggtgattcgagaataatcgtgagaatcagg

SEQ ID NO: 4829 - DNA, 304 bp, Homo sapiens
aaaaaagcaatttggaaggtaatttgataggctttccaacttaaccaaattttttattgtaattcttggatagtatttttgtctttttcaattcatttgtctttttcagtatagtttttgttaaggcaaatgtcttcccttaatatccaaatattgctaataaacggtagaagatgctttggaaattaaaattatctcgctgttggttagacttaacactgttaatcttcagccaaatatcacatatggatcaaattattttcttttttgttgtttaccctatcctcaacaacatttttagttt

SEQ ID NO: 4830 - DNA, 442 bp, Homo sapiens
  misc_feature (1)...(442): n = g, a, c or t
aaataattatcaggatatagaaacaaatatccattcagataaaacattactgcttaaaagtggctaagaaatattttgcatgtaataaatatatttcatgtttaggttaacaggcaccatcttgagagcagtttgtttttttttttagctaataaataaattacattcaagaaaacaaggtgtttatatctgagtatatcattaaatgtttttcttcatatagcacccaaacttcaaactgtctanaaagtatctcctaaaatataactcataccttaagtaataaaaataaaggccaagaaaaaaaatcaatttaagacaaaatttacagtttatattcttaattccccattcaataaaatatcgattgccaatttaataaaagtaaatgaactgtatatatgcaatctgttagcactgaaaatctgaaatatatattttt

SEQ ID NO: 4831 - DNA, 265 bp, Homo sapiens
  misc_feature (1)...(265): n = g, a, c or t
aaatttanatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgcttt

SEQ ID NO: 4832 - DNA, 522 bp, Homo sapiens
cgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacag

SEQ ID NO: 4833 - DNA, 429 bp, Homo sapiens
aaaatatttacacttaaagacaaaacatttccacaattattacaattggtttcactaaatcagaagtgactacacattatctctacttttataccagaaaacaaaatgaagaaatcaacaaaatataattactaaaactccactgtggatcaggataaaatgtgtccaatattaactcacactttcccaataagtataaaaatgaatataacattgcttggacaacttgtttcaacagcgaatcgtctattactatttgttcaataacatatataaattcaaaactggcaggtatgaaaaaaggttactttgttttttgcagatactgtacttgtaaaataaagccaaataaagcatatgtcacacataccaaagtcttacattttgcctttctaatacaagcaagtgaaatattaacacatagcattt

SEQ ID NO: 4834 - DNA, 490 bp, Homo sapiens
ctgacaaaaagtgtcagagccagaggccaacctctgctagatgaagcagcagcacatgactccatttctatctgataaggagacagagaagaggcatctcgaacagatgaaaaaccaaaggctggtgtcctaaaaaaaacagattggcttcaaagaaaacactaaggaagacccacagagctgtattaattttagtaaaaataatcatatgccaacaggggaattgaaccactttctaaatcatagtatgaactcatctcttcagatacttggtaagtggtcaaagcttgtttttataattactttcactgtcttgggcaaaaagtctttcttatctttggtccttaggtgtggtatcagtttcttccatttttttatgtgttacaaaacaatctttttttacttgacatcaacaaccaaggtgcagtataaacacgaagttgctgatattgttgcttttatacacataaaataccaacatctcccatac

SEQ ID NO: 4835 - DNA, 254 bp, Homo sapiens
aaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagttt

SEQ ID NO: 4836 - DNA, 407 bp, Homo sapiens
gatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttctttgcactgggaaaataagcaaatgttt

SEQ ID NO: 4837 - DNA, 404 bp, Homo sapiens
ctgtccgaggagctagtagggcaaactgctccctgagctgggccgatcttttgacatccttctccgagaaacaatattctttttcagttattacaaagaactgctgttgtgatgactagttatttgcttgagcagttccatattacataatcctgtgccacaaaacaccctgtacactagtggctgggatattattcatttccactaggcagctatctcactgttgaaatttatatccaaaagaatatttaattttggcttatttttcttataaaatagggaactcgtcttatcatttttaagtcctcacctcagtgtggtacttcaaactacttcaaattattactataattaaatgcttcattttatataataattaataaaaaaggtggcatatgcttttt

SEQ ID NO: 4838 - DNA, 517 bp, Homo sapiens
aaacctaacccatgttagctgcaactccactacagtcttgatcacttagctcaggaaacaaacacccagcaacaaccctcgtatctcattaataccaatctgtggccctcactgactcagtggtactttttataaaaatatctgaagaagtggcaaacggttacaacggatgtcaggtcgaagcaattccaaaagctgagaaaacgcttcatccgctgcttgtcttctccccctattgctacagttctgccaccaaagggggaaaattacgtgaatatgattgttgtgaccaagccttggcaaaagtcaataaataacagaacctgtcaagggcagagcaattttatgggcaacctcttctagttgcaaatgtgggggttgggaaaagtgggagagaggcatgtgtgcaagaaagagataagggtccttttgggaagggtttggtgacccagccccagctcaatgccagcagactaggacccgctaaaacccattattcagacggaaaggggagaag

SEQ ID NO: 4839 - DNA, 277 bp, Homo sapiens
aaatacttaatttgaacagctctaagatattgtcacttaggtcatctaaaagcttttagagatttgaacataagttcatttcctattaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcag

SEQ ID NO: 4840 - DNA, 489 bp, Homo sapiens
aaatgacttcagctaacttaccccaagagaaaaatctggcattgatctcttggttagcattattaccaatatcaactagcactattaaaatcaaagttgaaatggtacattcatttgccaaaaaaaaaaaaagaaaaaaaaggcttaaaggcaaagaaggtgaatcaacgtgcaaattagcatctggcccaattgcaaaattcatttcctggatgtgagggattgaaccatgcacacttgcaagcaagatgaagggcaaacagatgacatcaaatcaaaattaaccccacaaagaatccagaagacctcagatggtaaaggacagaggtctacgtctactgctgttagtgctcaggtatccatcctgttttccctaatctcccgattctgatccaagagtctttgagacctatgtcctaggccatcctttcatctagaaatggaaaccatggctgtggcaccaggcatggtcaaccctgcagtgattca

SEQ ID NO: 4841 - DNA, 499 bp, Homo sapiens
ctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagattt

SEQ ID NO: 4842 - DNA, 514 bp, Homo sapiens
aaaagcagagaaggcatccatagactatttccttgcttacaagctcagtgaacatactgaattcacttataaaaagaattttctcaattttagttgcttttcaaaaaattcttattccttttatttgtaattctttgacattgttgctgcttcacagttttggtaattggacagtttggtctttattatgatattaacatttttacctgtcctgaaacaaggaaatacaatcaaagaaacagaagattggtggaccttgaaccacattatgatatcagatgacccagagtcatggttactaagttgcttaaatttttagtaacaaagatgtattagaaagtgacaggtcaattcaataatggtttttttggatacatttaattatataatccccttaagttgtgcttagtcagcagtatttaatctgttgtctattatatatctaactggtctgttatgtttattatatatttatatattgcttattcatatcttattggagtaactcattttt

SEQ ID NO: 4843 - DNA, 345 bp, Homo sapiens
  misc_feature (1)...(345): n = g, a, c or t
aaatattntggtcatattttataataaaatattttggcaaaaataaaatataaggtttantttattttctattaatggtagatctggagagtattttacatttctaaatagtatctacttaatttgactgctttcacatttgtttctgaaaacactgctattcgcttttcagaattttgagattaaaagcacctaaaaataagataaaataaaatttaagtaaaatatttgtttgatgctcgaaagttgacaaattcacaaacttactttaagtgtcttacatgatatatgccaccacagaaactttattgcctgctaagacttatttgactaaatctaatcttt

SEQ ID NO: 4844 - DNA, 251 bp, Homo sapiens; identical to SEQ ID NO: 4543

SEQ ID NO: 4845 - DNA, 621 bp, Homo sapiens
  misc_feature (1)...(621): n = g, a, c or t
ctcaggcagaacacaaatagaaatttaatgatgtgctcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctngntgattttgcacagtgagctctgcggaaggggtcaggctcaactgctgatgtgtntcacacgt

SEQ ID NO: 4846 - DNA, 501 bp, Homo sapiens; identical to SEQ ID NO: 4709

SEQ ID NO: 4847 - DNA, 437 bp, Homo sapiens
  misc_feature (1)...(437): n = g, a, c or t
aaaatacataaaattttctaaaacgtaaaatggaaaggtttaatacacaggaaaaacactgcacaccttaactaaacaaactagaaagaaaatatatttatatacagaactaagatgagtccattcattatttttacaaatattcacatagatggtttagagataagtagttaagtgtgtctcattaattaatggatgctttctagcctctgtcttcattaattttatttcctattcaacaaaaaataatgctttcaggatatattacatatagagcaatatcatttttatcagtaatttgtctgaaaaagagaaaaacttaaaagcagaaccctacaaagcaaagcaaactacaaagcaaagagtnatcacagtgtttgcaaaatagaaatgtgtgactttnactttatagcaggctgcctaattaatccanacag

SEQ ID NO: 4848 - DNA, 270 bp, Homo sapiens
  misc_feature (1)...(270): n = g, a, c or t
ttgacaaatgtataaccatctccacaaaggcaatgtanaaaattntcatcaccccttaaagtccttttacacttttttttgagactgcctcagtantaaccactgctaaatttatcananaactgcacacctggattgtattttgacagaacttccttccaacccaattgcttttaataatttttttatgataaatntttacccaaaatgttatagaatttatttacaaagaaatttcgtaagttgnattnctcctactggtgtggtatt

SEQ ID NO: 4849 - DNA, 592 bp, Homo sapiens
ctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtcttttttttttatctctcttgatgtcagattttatagtctttt

SEQ ID NO: 4850 - DNA, 379 bp, Homo sapiens
aaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacattttttttttttaattttgtaaaggtgaaaaaagcttttatgagctcatgtagcaatcagattttcctgtggattgataataaatgaatatgatatatagttaaaa

SEQ ID NO: 4851 - DNA, 501 bp, Homo sapiens
  misc_feature (1)...(501): n = g, a, c or t
aaaatacataaaattttctaaaacgtaaaatggaaaggtttaatacacaggaaaaacactgcacaccttaactaaacaaactagaaagaaaatatatttatatacagaactaagatgagtccattcattattnttacaaatattcacatagatggtttagagataagtagttaagtgtgtctcattaattaatggatgctttctagcctctgtcttcattaattttatttcctattcaacaaaaaataatgctttcaggatatattacatatagagcaatatcatttttatcagtaatttgtctgaaaaagaggaaaacttaaaagcagaaccctacaaagcaaagcaaactacaaagcaaagagtaatcacagtgtttgcaaaatagaaatgtgtgactttaactttatagcaggctgcctaattaatccagacagtagagaaagcagactgaggcaggaagtaagaggtgggactaaactgttaagaagataataattt

SEQ ID NO: 4852 - DNA, 421 bp, Homo sapiens
  misc_feature (1)...(421): n = g, a, c or t
aaattctttaattaaggcattggtcccaacggtgcacatagattaagggattttgcttccttctgaactagatcatttgttagaggcttcagaaaaagaaaattagcttgaaatctagtctgggaaattgggggcagggaatgaaaaagttggtctcttgtttctccacgatacacaggcttcccatctaaagtcatgcttaactaaaagggaaaaaaatgaaccaagcaaaagtatatagagtagccgtgacatttgcattattttctagactttacatttgcctgcaacaggtataacatgaaactccagagggaatttggattgataggaatgttcacataaacaccancagtggctaactgttacacaacattcaaagtattcgagagaactgcctggagacagagagcgagggtcc

SEQ ID NO: 4853 - DNA, 501 bp, Homo sapiens
  misc_feature (1)...(501): n = g, a, c or t
cggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctnaaaactgagggaggagatcgagggaaagggatccttcacttactttgcaccgagtaatgaggcttgggacaacttggattctgatatccgtagaggtttggagagcaacgtgaatgttgaattactga

SEQ ID NO: 4854 - DNA, 477 bp, Homo sapiens
ccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttccctttt

SEQ ID NO: 4855 - DNA, 476 bp, Homo sapiens
ccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagtagaatccgcaaacttttcaatctctctaaagaagatgatgtccgtcagtatgttgtaagaaagcccttaaataaagaaggtaagaaacctaggaccaaagcacccaagattcagcgtcttgttactccacgtgtcctgcagcacaaacggcggcgt

SEQ ID NO: 4856 - DNA, 432 bp, Homo sapiens
ctgttcccagctaaaggaattcagactctaaggattctaggagccgaaaagcaaagggtcgctggacgaagatgcagacactttgcctcaggtgacttgaatgggactgctgatgcctgtggtccccaagggacggaaaccacaaggaacagttctcctgactctgtcttattcctcctttatccgtagaacctaacgtagaggctggcatgttgcagctactcagtaaattacgtgagtgaattaatgaatgaccgcggctcattcattggaggttggtctccaacttgtctctcaacacccaggagacctacagggaaagctccccagggacttaaagccccaagaagagatggtttatccctggctgaaaacatgagccaatgcctgagagtcacctgtgtgtgaagtcggctcctgtcagggaatcag

SEQ ID NO: 4857 - DNA, 369 bp, Homo sapiens
aaaaatattaaattcaagttacatggaaattttatgcataaaaatcatattgtataatcagaatgaatcttcagtggtcatttctgaaaaacaaatactaactttagttaaaaagttaaacttttacttctctttttcaaagtattttcaaaacttcactattcaaattaaataggatattttaataatttacttcaaagatattatataattctgatcccaagagatcttcttgtggtgtttataaataaatctactaacagaaaagagtaagaaaagccaatctaggaaagaaaatcgttgaattaagtgagagtcaaagtgctaattcaatctatggggttttttcctccccatcatttcttttca

SEQ ID NO: 4858 - DNA, 379 bp, Homo sapiens
aaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcac

SEQ ID NO: 4859 - DNA, 374 bp, Homo sapiens
ctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgagg

SEQ ID NO: 4860 - DNA, 125 bp, Homo sapiens
gctttatgatattttatttgatattattcagtaatacaggttttgtggcaaatatgcatttctaaaagtgcataatgaaacattttatttttctagctcttgaatttgtcatagaaataagccat

SEQ ID NO: 4861 - DNA, 484 bp, Homo sapiens
  misc_feature (1)...(484): n = g, a, c or t
ccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatatttttcaaatgtgataaaatagcacaangtggctggtga

SEQ ID NO: 4862 - DNA, 235 bp, Homo sapiens
  misc_feature (1)...(235): n = g, a, c or t
tcaaaggnattntgntgactttaatattgattatatttttaacaggaatttaagaaaatattactggaattaaaaanatntatatattaaacaagaattttctttgctntgtctancttaaactactactcaanctgcttaagttnttaagtattgtttgtnatcaccaataaataantgcatttntanttcatcagtcattattagcttttnttaaaagaagattacgttttac

SEQ ID NO: 4863 - DNA, 417 bp, Homo sapiens
  misc_feature (1)...(417): n = g, a, c or t
aaatattnattttcaaaacccctaaaacactggagtatgcttcacctagaaacagattacaggacgaatagctataatgaataagcaatacaatttgtatttgggatgcaattgtgttgtaaagtttcaaataatcaatttataaatttgttgcttttacttttacaaaaatattcatttaacccataacatgagttgcaaaattatctccagacttctacagatgattataaactgtaattgtgtttcagttacacagcaggtgaaaaatttaactgaaccgttacttcaaaatacaatgcattaaaaataattgttacaatataggcaccaataaaaagaattttcttggcatacaacaccacaacaactttctcaagtatctgtattatgtaaattaaaaagaggatgtaatgg

SEQ ID NO: 4864 - DNA, 238 bp, Homo sapiens; identical to SEQ ID NO: 4661

SEQ ID NO: 4865 - DNA, 145 bp, Homo sapiens
tttgatgccatttctaagacctacagctacctgacccccgacctctggaaggagactgtattcaccaagtctccctatcaggagttcactgaccacctcgtcaagacccacaccagagtctccgtgcagcggactcaggctccag

SEQ ID NO: 4866 - DNA, 250 bp, Homo sapiens
ccaggagagtgacaccatggagggtacaattgccagctcccccgtgtctgtgcagcattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacgaaaaaaaaaaaaaaaaaaaaaaaaaaag

SEQ ID NO: 4867 - DNA, 423 bp, Homo sapiens
aaaacactctgatctgaggccaatggcatcaaaatacaaattgctgaagtgggagaggaagtgaagggctgtttgttagggggactacagtggagattctggtgagtgtgggtgggctcgccagtgaccccaatattttctttgtgtaacaaccagagtaagcattaggatgcccaggctgccctctactggcagtttctgggaaggaccacaacagcagcacccaacctgcaacccacaacagccgagacaggagagagagaagaaagcaagagagagagaggagaggaagagagagaggagaggaagagatagaggaggggaagagatagaggacaggaagagagagaggaggggaagagagacaggaagggaagggagaggagaggaagagagagaggagaggaagagagaggaggggag

SEQ ID NO: 4868 - DNA, 529 bp, Homo sapiens
ccaatcaataagggactttcctctctgccattaagagcaacgatgctgaccacatactctgtgcctggagtgaggttggtgagggtgatggaattccgagagtggggcacccgatcttctcgaggtctcccactgaagtgctcgggatgatggcggatcctgtagccagtgatggtggctcgaggagcaatccagtgcacagtaaaagagttggcagtaatatcagaaaagtcaatgccagttggggaatcaagacctgttttctgtcttcctctaagaggtgtgctctcatgttgttcgtagacactggagacactcactacatattctgtaccaggcaggagatttgttaagaccactgcattgtctgaaggagaaattgacaactctgcaacatcttcctcatttttcacaggtgagtaacgcaccaggaagttggttaaatcaatggatgggggtggagcccaggtgacacgcatggtgtctggaccaatgttggtgaatcgcaggtcagtgggaggaggaacag

SEQ ID NO: 4869 - DNA, 282 bp, Homo sapiens
ctgcgtccaaatttacttgacaaagctataaacacaaggccctttctgaagtcctgctgattgagtttccccttccttttgtcggtggagaggaatgtaaaggctaagcgggtgtactcggactgtgtgcctctgggcttgctggcggtggcacttaaaggaactcattcattctctggatggggcaacactcctcacccgggatcccccaagggctttcccacacggagaccttcccgaacacagagacatctgatcttggcttgcccaagctggcccagg

SEQ ID NO: 4870 - DNA, 427 bp, Homo sapiens
ctgggggagggagcagacagtgagtgggaactggctggcccggggctccttcttgctcactcaccagtcttgctcttcacctctaagccaatgttgaccccttcatctataaagtccacaactctccggaagtcatcctcacggaactgtcgagaagttaaggctggggccccaagccgcaggccgcccggtgtgatggcacttcggtctccaggacaggtgttcttgttggcagtgatggatacaagctctagcacccgctcagcccgagctccatccaggcccttgggccgcaggtccaccagcaccaggtggttgtcagtaccacctgataccagtgagtagcctcgctctagcagggcatctgccatggcccgagcattcttcagaacctgcagggagtactcccggaacatgggggtgcagg

SEQ ID NO: 4871 - DNA, 524 bp, Homo sapiens; identical to SEQ ID NO: 209

SEQ ID NO: 4872 - DNA, 552 bp, Homo sapiens
ccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttgggtttgttattctaccctgtgtagcccctagatggaagaggaaagagtgggatgagatacagtgtctcttaggagagatagaaacctgttcactctggagtttggaaaggggaaggatggtgggagtttatgagaaaacatttttctgttagatctccatttaccccatatcataagtctacccctttttttcttcatttggggttcctcgtctggattccctccattccctctcctcttttcttccatgagctcttctgcagctttgctttctttggtctgcagaagatcctcaggaacgggaacgtcgggaacgcagggagaggatggaacgggagaccaatggaaatgaggatgaggaagggcggcagaagatccg

SEQ ID NO: 4873 - DNA, 132 bp, Homo sapiens
ctgcccttccatgtcgtcacaggcataccgggcgtggacccactgcttggtgcccttgccgaagtagtagcacttccgttggaaattgatccacttttcagggcacgtgttgcacacaaagccgctggacac

SEQ ID NO: 4874 - DNA, 436 bp, Homo sapiens; identical to SEQ ID NO: 208

SEQ ID NO: 4875 - DNA, 452 bp, Homo sapiens
ccattaaaagttatttacaacagtgggagaaaaaaagacaagaagttgtttcacattacagacctccccccaccccaaagcctaatacttgcttaccaagtcaaaaaagagacacagttgattcacaggctggaggtttgaacttgagtaagacatttataaaaacctagacggggcagtgtcctccccagcccaggtgccactaggcacagcacaagagactaaaaacaacaggggaaggctggacactcaaggtttgggagtataagcaccccacttctggctcagggatttggggagtagggtaaacaaaacctacttggaaaagaattggggaagaaaaccaacaactgccttatgcaggggtggggacagggaaggaggtagggccagggacaggagcatttcacatcactaacctaacttgggaagctgtaagggaccatcttcaa

SEQ ID NO: 4876 - DNA, 396 bp, Homo sapiens
ctgcgctgcacagcctgggcagcaggctgagtatgggctcctcactcccacctcctggccttcaaggccctacttgttgccccagacagccatctttgagaacacaggtcttgggaggaagcggctggacttcatgtaggcagagatcttctccaagccctcaaagcgggagatgaagtccttcagatttgggaaggcgtccaagcacttgggctcaaatatacggtggaggtcaaggacatcatagacgagaaaatctacaaaagtgatcttgtttcctgcaaaccatggccgcttccccagaaactctgagtagagctttagcttttcagggagttcctccaagtactttggcttcagtttctcaaattctggattgtagcagatcatgcccag

SEQ ID NO: 4877 - DNA, 484 bp, Homo sapiens
ctgccagagtagtggctttaatgaccttagaaagggtacatcattctacaacatcctgcccctccccatcactctcctattctttcagaagagtgttggaatccacgacctcttctgtaggtactggaaggggcccgaagaattcccgcatatatccagaaaagccagaagtttggggacccattcttaaacttcctagaatgtccccttaggaatgagcatcggcacttggaggtgaaactcttgaagggtttttatttagaaatcagattgtcagcatgtggtggcatcttcttaaacttagataacgggtccagagttgcctggctagttagtgtcaggttcattagactagatgcatctctcctgacttgccagagtctctaggtgtggttgtacattctgaatgcactgttttgagtattcagcacctgttgtgcatgtgtctctgcagcaagcgatccccctccaagaccatcccagg

SEQ ID NO: 4878 - DNA, 636 bp, Homo sapiens
  misc_feature (1)...(636): n = g, a, c or t
attttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgnttatctagcatagcacaaacgtttttccagtct

SEQ ID NO: 4879 - DNA, 323 bp, Homo sapiens
cgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaattt

SEQ ID NO: 4880 - DNA, 264 bp, Homo sapiens
ctgtgggcccggagggcctcggcgaagctgagatagaagaagccatcctcggacatcacgtctcccagaagctgcacggccggccggctcaggttcccctccccgagaagatattccaagagcgtgtgcctttcaaacttcttcatcgcctttctgcagcccagtgccttgaggtctttgagggcctggttgagagccatctggtagatgccttcgggcgagtggcccttttcctggggacgcaaggcgtagcccagcttctcg

SEQ ID NO: 4881 - DNA, 384 bp, Homo sapiens
  misc_feature (1)...(384): n = g, a, c or t
gtctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccantgccttntgaccttctnaagctttccgaatcctcccagttgaggcantagctgtgtcctctgagggtggatgggaatcttgggagaagcccaagcaagggagccctcagaggtggtgtttggaccaaagca

SEQ ID NO: 4882 - DNA, 340 bp, Homo sapiens; identical to SEQ ID NO: 354
  misc_feature (1)...(340): n = g, a, c or t

SEQ ID NO: 4883 - DNA, 606 bp, Homo sapiens
ctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttc

SEQ ID NO: 4884 - DNA, 579 bp, Homo sapiens; identical to SEQ ID NO: 210
  misc_feature (1)...(579): n = g, a, c or t

SEQ ID NO: 4885 - DNA, 285 bp, Homo sapiens
ctgttaatcgagtagcgctttgaagaaatgtaatggcttttcttaagtctccttctgacactttaacaagataagctattccctcatcactaattttgacattttccttcttggcaatgtctagtaatcgctgctgttgaattttatctgacagaggcttgaagcggaattttgaacatctagaggtcaggggttcaattattcgactgacatagttacagataagacagaatcgggtggctttcgactccttctccatggtacgtcttaaagctgcctgagcag

SEQ ID NO: 4886 - DNA, 345 bp, Homo sapiens
ctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagttt

SEQ ID NO: 4887 - DNA, 86 bp, Homo sapiens
aaatgctttccctgagtattctatgaagtctggggatcttcgaatgctattaatcttagacagtaaattttataaagaaattcttt

SEQ ID NO: 4888 - DNA, 355 bp, Homo sapiens
ccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaatgtcaagttgtctctcagtaattgcattattagcgtgctgtctttgtatgactcttcacttaatgtatcaagttcagc

SEQ ID NO: 4889 - DNA, 86 bp, Homo sapiens
aaagaatttctttataaaatttactgtctaagattaatagcattcgaagatccccagacttcatagaatactcagggaaagcattt

SEQ ID NO: 4890 - DNA, 568 bp, Homo sapiens
  misc_feature (1)...(568): n = g, a, c or t
ccatgagtgacaggtggcctcttggtgggagaggtggggcagggggaaggcagctcccactagaccagggcagtatttaggggaaggaggcagattggagcagttggctgccaacacctggcctcactcagggagaggggccttgggcctggaagatatctgggtgaggtacccacaccatctgctgcaacctctgtgtatccattatgggctcacgccattcacaggcatgaattgagcacctagtatgtgggaaaacaggggaaacagagatggcacagacatggtctccatccttcgggggctccagtctagttgggggagatcagagaagttccatttgccactctaggccaagctaggtaagcggcagagccatgaagcattgtgggagcttggaggagggagtgagcccttgcagtcagggagaaggagtcagcctggggagacttccagaaagtagccctttgaccctgaggaggtggggatcagtcgtgatgaaagtaatagccattcagtagccccttgtaattcaccctgagccaatgcctggaggcagganaaagta

SEQ ID NO: 4891 - DNA, 198 bp, Homo sapiens
cctcggcctcgggcagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcag

SEQ ID NO: 4892 - DNA, 545 bp, Homo sapiens
  misc_feature (1)...(545): n = g, a, c or t
cctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggcgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgngtttttttttttttttggtagatgcatgacttgngtgtgatgaganaat

SEQ ID NO: 4893 - DNA, 556 bp, Homo sapiens; identical to SEQ ID NO: 211

SEQ ID NO: 4894 - DNA, 272 bp, Homo sapiens
aaatcttttctcccgtgtccctcttcttcaagcaactgaattatctgtataaaatggaaacatatctggttcccatttcaaacgatagtacagataccaaagaggagactgccagaaaaggagagtacaaagtgacctcttagagaggcccaggcacttgctgaaaatttaggggaagggtatgagatttctaaatgattgataatcacacaggtgacaactacaacacaaaaaaaccattgacaggaaaaatgaacatagttctccttttt

SEQ ID NO: 4895 - DNA, 310 bp, Homo sapiens
ctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgagtctgcagatgtggatcctgactcctgagagaagtagctcaccgtgacgaagctgcgtttgcttttatcgatttgcaaatcaaagaagggggacatattgggagaaggccccccaaaatctgg

SEQ ID NO: 4896 - DNA, 601 bp, Homo sapiens
  misc_feature (1)...(601): n = g, a, c or t
ccatcagcacgagggcactgaccagcacggcatacaaggtggccttccctagcaagatctcatagaggatggtggcagacaggaccccttgctggtaagactctgttgacaagaacagagcatgtaggcacctgtgcacaggtggctctggcctccctcacgcccctgtgtccgtggattctccatgccctggttcgagagcagagacggcgaaagatagagagaaaaaggagagactcacttaccggaggtgaagccacagtctgaaagaaaacaggggaagaaaaatggatgagagaatgctgctttgtaaggacattgagccttacatcacagactcacaggccacaaacacatgcatatcagatagtacaaagttagcctcctttgatagccctggttctgtctccctcatgctgctccagtgccagcgaagtggtcactatgatcttaggaaaccaggaccccagaagagaatgggatgcacaccactcagatgctgagctgtatggctggtcctcagggagacttgaaggcttagctctaaggngtcaggatctgaaggaagaatgagcntgaggtgctccattcagcctctatg

SEQ ID NO: 4897 - DNA, 526 bp, Homo sapiens
  misc_feature (1)...(526): n = g, a, c or t
ccaacatggggaaaccccatctctactaaaaatacaaaaattagccgggcgtggtggagcacctgcagtcctagctactcaggaggctgaggctggagaatcgcttgagcccggaaggtggaggtgcagtgagccaagatggcgccactgcactccagcctgggcaacaaccacaactgaaaaaaaaatctactgaggccagagtgagttggggcggggagcatggagagggggtcaggcttagccccaacaactcagaatttcacttccttgtacggccctcactttctccacctggccccggggcaggtctgagggtctgaagtctgttgatctgaaggtcctaggcaaatccagtcacttgggagccggagatatttaacatcacggcccggtcccctttcccaggggactcatttcctancactctctccactgtccttgccccacccctgggggaaaaaatgtatttttcttttgtgaatacttcctgaaacttgcgggcatagaaaccacaaactgctca

SEQ ID NO: 4898 - DNA, 561 bp, Homo sapiens; identical to SEQ ID NO: 356

SEQ ID NO: 4899 - DNA, 635 bp, Homo sapiens
  misc_feature (1)...(635): n = g, a, c or t
ccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctanctgctacaaagaanacatgttttanacaaatactcatgtgtatgggcaaaaaactcgaggactgtntttgtgactaattg

SEQ ID NO: 4900 - DNA, 353 bp, Homo sapiens; identical to SEQ ID NO: 212

SEQ ID NO: 4901 - DNA, 305 bp, Homo sapiens
acaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtgaggttctgtatgccacccgt

SEQ ID NO: 4902 - DNA, 602 bp, Homo sapiens
  misc_feature (1)...(602): n = g, a, c or t
ctgtatctgtcatttggtgccactaacttaggccagattaaacagaaagcaacctctgccacaaagcatctccctaggaagagatcacaacataaactaaagcactaactctcaagatcctgttgtcacgatgattcagttcatatattatctctgacttttctgagatgatctaataagttctaagcaaaaataaatatttaatctttgattaaataacattattacttagtctagggtgactgggttacgtaggatggcttgaaagagataagccttggtggacatcttaaaaatttaactgaagtaaagagcaactggtttagttcccttcccctggagtgttgtggtgttgagaagacaaaactttgggaacaatcacagaggggctagatagacaatgcaaaattgctgctggagagactgagtgagtagatgttaaataactaagtgcgtgctggatgaataatgttctggatccaagaaagacatacacaggtaaaaaatgaattcatgccttttgngttgttcaaaacttgnactttatttttctcaaatatttttacttatgctttttgncattatccacagtgttttttttt

SEQ ID NO: 4903 - DNA, 566 bp, Homo sapiens
aaaaaaagaaaatacaaccatgggaaagaaatcttaaatgaaaaacgcatctcattgtaggcatttttgcctcatattttactgggccatgtttgtttcctggtactcatgtatttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggttttttttttttctcctttt

SEQ ID NO: 4904 - DNA, 304 bp, Homo sapiens
aaaaacaagttccccagagaagctggcacttcctttgccctccaaaaaggacctgaaaagtcccaatccaaactttagaaaattagttatgagatgcaataaatgatgatcaaagcagtcagagggagaaggatgaatgtgtcttccatttagctagagactgtagcatagcctctttaggtgttggtggatcagtaaaaacgactgaagtaccagaagtgcttggaaggataggggtacaaagtaatgaccataataccttgtctaaatcagtagcagggcttcatggctaggaaactttttt

SEQ ID NO: 4905 - DNA, 592 bp, Homo sapiens
  misc_feature (1)...(592): n = g, a, c or t
aaaagcaaaaatgcaattctgtagatgaaaacagttatctcagagggtcaaccacacaatgtcatacagagacgctggtcttaagccatttttttccatattcatataatttcaaaacatgagaagtatcctacttgctgagaagtgccaaatgaccctaatattcaagatatcttagaaatgctatcctttagttaacatacccttaaattttgtaacattgattttaccctggatttagtccatacacgtcaatgtacagacttatcaaagtacaatgctggaacaactagtgtttgtatttttggaatctagaaaataaaaacaatatagccatgatttcaaataggtgagtttccttatataacatttattcatatttattgnataagcatcatgattttttcttccaattaagttttagtgacttcctaaagacatttttaacaacattcctcaaaaataaacttacttagttttcagttttagttactagtgcctgcctataaaaggaccttaaatgatttaaccctaaagccagattcattcctatatatacccagtcagttgtctgcaaagaagtcctaagact

SEQ ID NO: 4906 - DNA, 440 bp, Homo sapiens
  misc_feature (1)...(440): n = g, a, c or t
ctgccgctcatccaccatcagtgactttgtgctgttatcattcatgtgcaccttgacgacgagcttcttaaccttggcctccttcagtttttccagcgccagcttaattttatcagccttggcttgggcttcttcctcttcctgagagagaggttcaggaggtggtggtggcagtggaaggtctaacacaggatcggctggtggaggtggtaagtcatcctcatattggctgataccagtggcagcaacatttgttccataaccaagagaggctgcaccactgaaaattgatgcttgtanagatgctgaatgatgttgattctgcaaggactctttctgtgcctggattgncctctgctcancctcacttatgtctgctaccagatctgccatgagagcatctaaatcttggtcttccagtgcatttaaggactcattta

SEQ ID NO: 4907 - DNA, 282 bp, Homo sapiens
ctggtgctgcttgcaggaagggcagtaccaggggttttccttctccagggtctccacagtggtgaagagctcaatgcactcctgcagccgcacgggagccttcttcatcacgtacccgacgcagtcatgcttcacgtagccctcagcctctacctcgtcatagtaacgcttcttcatctctggctcccagtcgatagcaatgtacggctgggcatggacttcttcaggggaggttgtgcggtcgctggtcccattggagttcaccgtctgcagggtgaacag

SEQ ID NO: 4908 - DNA, 300 bp, Homo sapiens
gctgtgtgaacgtgtatgtacctaggatatgttaaatatatagctggcaccttagttgcatgaccacatggaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccagg

SEQ ID NO: 4909 - DNA, 549 bp, Homo sapiens
ctgtgaacatctgttctttcttcctcttctgtctactgcatgcaggcccggaagctgagcgttagtcaaaggtacaggaagggaaaagagaagagggcaaggcccatcccccaagaaaggaagggctctgatgcagagggagcaggagctgaggtggagacggccactgcctctctcaccctctgttccatccctctgctcaagaaaaccaggcttagcagagtgagacagacgctttttattggtctggctggcgtgcctagtggaaagctcaggcagagcttcctatcttgccctggctcccatcttccctctcctgggagttcatcacacatcccgagagggaagagtgtcctgggcagaggtggcaggcaaagccgggtaaaaactccagggctgggaagcaaatggggctcagggtgatgcagaaaatgtgatgttgccaggccatccaaataaagcatccatcggggcagaggagaagctgtttccctgcagacactcctctgcccccaccaggaatgggaggggcaggaggaagagcttccc

SEQ ID NO: 4910 - DNA, 513 bp, Homo sapiens; identical to SEQ ID NO: 213

SEQ ID NO: 4911 - DNA, 468 bp, Homo sapiens
ctggctgtgatttttgctacaggccacagtcaggagcacatgatagtagcattggcacaggccacggtggaccgtttttcagtgtacagttccagcaaaacctggtattctccctgaggaatagtaaattcaggattattgacaggcccagcatagtaaatctgctctcctttccttcttccacagaaagaaaacttgggcagagccgcctcacagatgggataggagaaattcaaaacagatgagccttgagacatgagagctaggtcaagaaaaagctctttgatgtcctctctcagaataattccaaatctaatgttgatatttgattttaattgcttggaacacttttcaacagaaaagccaaaatcttgtaatggatcgcaactctggtagagcacttccaagccgctgtcgctacagaccacgtgtgtgggccaggctttcccaccgccgcctccactgcag

SEQ ID NO: 4912 - DNA, 575 bp, Homo sapiens
ccatggagacagggccgttttcttccctgggagtttgctcagaaccaggcactgctggggaccatggatggggaggaggggcacagggcccagtgcagatgaaggttgcacaaacaccccaaactgagagcccggcctcctggcaggcgagtaagcgagcaggcgcctcgacagcacagcctgtgctttcccctcagatcaatctgctactcccttttccttaggagggagaggagcaggcagataagcctggtgtccaccaccctctctgccccacctgtagaggaagggctcaagggacaggagagcagagagggagtgtgacgctggcctcagagcccgtgcagggtcgaggagaggctctcctcggtggggagtcaggggaagatcggtttcctgttgaatctgggctgggtgtgtcttagctgatcttctgtatcagcttctcgtcagacaggcagtagaggctgttgatggacaagtctgagatgaagtgctcgcaggcttttcgagtgatctgcttgcatcctcgaaggtcgatcaaggtgacgttggcaatgcgccgtaggtagatc

SEQ ID NO: 4913 - DNA, 555 bp, Homo sapiens
ctggctgggcccaagagctccatctgtttccccaaagtacaggcagcttctaggccattgagtggggcatgatattggatgcttggctcaggaaacaaccccagccaacccaaggggcagtgggacatgttggcctcaggttagaaattattgctcaaagcagaaacagttgtgtcctagagagggtctgttaaaccctctttccatgtgtatctctatgtagcaattgatgggccctgcggtcaggatccctggtttctccagctccatgaatgcctccctgtgaggccctggacagtttctccctcttcttctcctggcttcagtttccccgtatgtacattgagacagtaagactggatgattctcaggttccctctggctttccattctggcatcccagagtggaggctctgggagggcagaaccctgttcctgcctcagtttccccacctgtgggtctgcgtatagggctgggtatggaggtactgagtaatggagtgctgcgtgaacatcccagtctccctgtggatagctgtgctgtgagatccaact

SEQ ID NO: 4914 - DNA, 490 bp, Homo sapiens
ctgcaactcggggacatacaggtgcactctgcaggacccggatgggcagagaaacctaagtggcaaggtgatcttgagagtgacaggatgccctgcatagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtcagttacactggaggagagaagaatgagcctacgctgaagatggcatcctgtgaagtccttcacctcactgaaaacatctggaaggggatcccaccccattttctgtgggcagg

SEQ ID NO: 4915 - DNA, 418 bp, Homo sapiens
ctgagtttttatccaattgaaatagtaatttaagtcactgccttccatcagttcttttccccaagctgctaacttggcaataattcttgctgccatatgaacagtgaagggatcctggcgattcaacattggcagaaagtagggccacgcagtgttcttgctacatcttgcatagtcaaagaaaatgctaacacgctgatgattttcctgcagcatatcatccaccatagttagtatatactgaacggtctgttctttgcagatatgagtcatcagatttataaatgttttagcacactggctgccttcagtttgaagcatctcttgcttctcttcagggcttcgtttcatttcaaacctctgaataaactcacaatcttcagcagaaatcatctgtccctgaagataggattgccag

SEQ ID NO: 4916 - DNA, 202 bp, Homo sapiens; identical to SEQ ID NO: 358
  misc_feature (1)...(202): n = g, a, c or t

SEQ ID NO: 4917 - DNA, 538 bp, Homo sapiens
  misc_feature (1)...(538): n = g, a, c or t
ctgtacacatgaaaattgaattgtttcaaaaggagcaatgatagcaagagaaagttcttggcattttaagaaaagtncatatacatagcaagaaatgaaagtaaatcaaaatacatagctttgtacatgttagaaatatccaatgtgccaccaacacaacaaccgccctattaaaaagtcctcaggtctggagacatctgtatttttctttgtataactacattcgcattacccaaccacatatctctcccatggtctgttacccattaggaagcttttaaccagaatttttggcaatatgcttttcttcaaataaaacaagccttcaaataaatcattatgtctgacaactgaattgggtaaagtctttctgaaatatgtgtaatctttagaaaattcttcttttttccttcataaatcagcagtgctccatcttcaaataaatcatgatcagtcacaatcttaactcatgtgctcatatgttctcttcatccaacattttgttgataccatcacatagtttttgtaagtggggttt

SEQ ID NO: 4918 - DNA, 322 bp, Homo sapiens
  misc_feature (1)...(322): n = g, a, c or t
ctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtggggcanaaaaaaaaaaaaaaaaaaaaaaaaaa

SEQ ID NO: 4919 - DNA, 520 bp, Homo sapiens
aaaagatagagccacatggacagaaagatcaatattgccctttatagtggctgctgcggttgtagctccgagactatattggagggggtgaggaaggacaagggggccagcaggtgggggacagcggcagacccctcccccaccccgatgctttggtccaaacaccacctctgagggctcccttgcttgggcttctcccaagattcccatccaccctcagaggacacagctactgcctcaactgggaggattcggaaagcttcagaaggtcagaaggcattggtagagggttccgggggaggctgggactacctccccccggagtgtttgaaaagccaggctggttcaggttagatactgaggtggggatgccagagctccatgctgaggaacagggtagagggtgtgggcttctagcacccaggggtctgcccccggcagtggggccgccagtagaaacgcagtcgcttctggtaggtgtccaggttgcgcttcaggcagaaggccacctccttgtcac

SEQ ID NO: 4920 - DNA, 284 bp, Homo sapiens
ccaggaatcgcttaatcctgaaagtcttgtgagaagacatggcgagcagcggagtcaagaacacaccacgatggcggagaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaagg

SEQ ID NO: 4921 - DNA, 453 bp, Homo sapiens
ctgccatgttgagaggtgccttgtggagaggctcatgtggcgaggaactgagactggcttctatccaacaaccagtgaggaactaaggccctaaagtcctatagtccacaaggaactaaatcctaccaacaactacatgagtgagcctggaatctgattttccccagtggggacttaaggtacctacaacctggctgttatgggctaaactgcatcctgcccaaatttatatgtttgagtcttaactcccagcacttcagaacatggttttgtttggagacatagtcattaaagaggtaatgaagttaaaatgaggtcattaggatgagtcctaatccaataggactggtgttcttatatgaagaggaaatttgaacacagacacatatacaggaaagaccatgcgaagaagacacagagaggaaacggccatctacaatccaaggagagagg

SEQ ID NO: 4922 - DNA, 343 bp, Homo sapiens
ccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccag

SEQ ID NO: 4923 - DNA, 538 bp, Homo sapiens; identical to SEQ ID NO: 214

SEQ ID NO: 4924 - DNA, 562 bp, Homo sapiens
  misc_feature (1)...(562): n = g, a, c or t
ccatgagtgacaggtggcctcttgntgggagaggtggggcagggggaaggcagctcccactagaccagggcagtatttaggggaaggaggcagattggagcagttggctgccaacacctggcctcactcagggagaggggccttgggcctggatgatatctgggtgaggtacccacaccatctgctgcaacctctgtgtatccattatgggctcacgccattcacaggcatgaattgagcacctagtatgtgggaaaacaggggaaacagagatggcacagacatggtctccatccttcgggggctccagtctagttgggggagatcagagaagttccatttgccactctaggccaagctaggtaagcggcagagccatgaagcattgtgggagcttggaggagggagtgagcccttgcagtcagggagaaggagtcagcctggggagacttccagaaagtagtcctttgaccctgaggaggtggggatcagtcgtgatgaaagtaatagccattcagtagccccttgtaattcaccctgagccaatgcctggaggcaggag

SEQ ID NO: 4925 - DNA, 639 bp, Homo sapiens
  misc_feature (1)...(639): n = g, a, c or t
aaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgncttgngatctgngtncaattttagtca

SEQ ID NO: 4926 - DNA, 526 bp, Homo sapiens
  misc_feature (1)...(526): n = g, a, c or t
ccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgcgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgngtttcttggttttatttcagccaaacatgtctgcttttgatttttttttt

SEQ ID NO: 4927 - DNA, 236 bp, Homo sapiens
ctgggccgctaagtaagggcctccaaagacttccatacccaaaccctggagcctgtgagggtgacctgatgcagcaaagaaggactctgcagacgggagtgagttaagggtcttgcgaggtcattctggacttggggtgggccttaaattcaatgaccagggttcttataaagagagcggccacaggaagacggaggagagactggaagatgcagccgcagcaagggacacggtgg

SEQ ID NO: 4928 - DNA, 463 bp, Homo sapiens; identical to SEQ ID NO: 359
  misc_feature (1)...(463): n = g, a, c or t

SEQ ID NO: 4929 - DNA, 596 bp, Homo sapiens
  misc_feature (1)...(596): n = g, a, c or t
ccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtntgact

SEQ ID NO: 4930 - DNA, 139 bp, Homo sapiens
gtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttt

SEQ ID NO: 4931 - DNA, 578 bp, Homo sapiens
aaattttctttttgtttcactggaaaggaaagatgatgctcagttttgccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttggggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgag

SEQ ID NO: 4932 - DNA, 483 bp, Homo sapiens
  misc_feature (1)...(483): n = g, a, c or t
cctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcctcagtgagttctcccgccctcttggtgaggtcaatgtctgctttcctcaacaccacatgagcatatcttcggcccacacccttaatggcagtgatggcaaaggctattttccgccgcccatcgatgttggtgttgagtactcgcaaaatatgctggaacttttcagggatcactanagacatggctgcagcacaagc

SEQ ID NO: 4933 - DNA, 557 bp, Homo sapiens
cgtgactaagatggaggcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctgg

SEQ ID NO: 4934 - DNA, 588 bp, Homo sapiens; identical to SEQ ID NO: 215

SEQ ID NO: 4935 - DNA, 392 bp, Homo sapiens
ctgcgctgcacagcctgggcagcaggctgagtatgggctcctcactcccacctcctggccttcaaggccctacttgttgccccagacagccatctttgagaacacaggtcttgggaggaagcggctggacttcatgtaggcagagatcttctccaagccctcaaagcgggagatgaagtccttcagatttgggaaggcgtccaagcagttgggctcaaatatacggtggaggtcaaggacatcatagacgagaaaatctacaaaagtgatcttgtttcctgcaaaccatggccgcttccccagaaactctgagtagagctttagcttttcagggagttcctccaagtactttggcttcagtttctcaaattctggattgtagcagatcatgc

SEQ ID NO: 4936 - DNA, 587 bp, Homo sapiens
aaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttatt

SEQ ID NO: 4937 - DNA, 551 bp, Homo sapiens
  misc_feature (1)...(551): n = g, a, c or t
ccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagcgtagcatcaaaccccatgcaatcatcatcctccccaatacannatggaatggagctttctggtgtgcta

SEQ ID NO: 4938 - DNA, 490 bp, Homo sapiens
aaatgaaatgcaatataaaatactaatacacttttcttccaaaagtggaaatgcttaagtaccctatactagaaaaaaaaaaattaggctgtttattcaattccacaatgtataatacagcagttttatgtcccttattgctgacagcttcgataaaaactattaacaagtagttccaagcacagaaatagatgtacagtatgagcacgatttttctttatattaatttttaatgtcctatcatgtggattaaatgcataaagggcaaataaaaatgaggaatcttccctaagtaatcaaaacatatgtcttattgagaagaaaattttagaagctgattaaaatccttcagcactagctttgcaattaattctggagaaataccttgacacatcttatagtatttgagtttccttataactttaccttccttcaaacagaagctacctatgtgcaaataaactggttgttctgtcaggacttctaaaag

SEQ ID NO: 4939 - DNA, 92 bp, Homo sapiens
cggccgcagaagcgagatgacgaagggaacgtcatcgtttggaaagcgtcgcaataagacgcacacgttgtgccgccgctgtggctctaagg

SEQ ID NO: 4940 - DNA, 567 bp, Homo sapiens
ctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactga

SEQ ID NO: 4941 - DNA, 387 bp, Homo sapiens
  misc_feature (1)...(387): n = g, a, c or t
ctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccancagctcatggagaaaaaggggngctactgggccatggtgcaggctcctgcagatgctccagaatgaaagccttctcagacctgcgcactccatctccctcccttttcttctctctgtggtggagaaccacag

SEQ ID NO: 4942 - DNA, 297 bp, Homo sapiens
cctggttccatcctgggcactacagttgacatcagcgccatattcaaggaggtgtcgcacaatgttgagccagcccctagcacaagcttcatgcagggcgcagtaacctgcgttgtcccgatgatttacatcacaaatcttgttctctaagcagtacaggaccacttcctcatagccaagcctggctgcccgctgcagaagggtctcgccagcgttcttattgacaataagtctccgtgcttccggcggcatagggcgagactgggtggtctcctgaggggaacttgagcatggtag

SEQ ID NO: 4943 - DNA, 401 bp, Homo sapiens
  misc_feature (1)...(401): n = g, a, c or t
aaatcgtttgttttgaaaagtatatccttgaaaagtattttgatatagatgggaagattttcatagactggcatctatttttccacctactgtttaatgaagtaaactgttgaatgatgtaaactgttaaatgaagtaaacagttaaaactgatgacataaaagacaagcaaagcgaaggaaacatgttataaaagataagtattacagcattcttaagtatggtactttataaaatgaaaaccgggatgctgtcttctgagatatcaacatatttataaggagcacatgctatgtgacatacttcaggatgccaagaattttaattaaaactcaacttctataaagtgaatataaagctaataagaggaatatttttccacctctggcctanaccaccag

SEQ ID NO: 4944 - DNA, 497 bp, Homo sapiens
ccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaggctactggcatggcaagagcccagcttcctgacggagcgcaacatttctccactgcactgtgctagcagctcagcagggcctctaacctgtgatgtcacactcaagagg

SEQ ID NO: 4945 - DNA, 580 bp, Homo sapiens; identical to SEQ ID NO: 216

SEQ ID NO: 4946 - DNA, 478 bp, Homo sapiens; identical to SEQ ID NO: 647

SEQ ID NO: 4947 - DNA, 461 bp, Homo sapiens
cctactatgtgccaaggaggggtaaggcagctagctctcacagacacaccccacagtgaaaatcacacacacacacacacaccccggcatctgtgctcactcacaggcagactgctcactttcttgcacctttcttgccatcacctcggccacacccacattcctccaataggcttgggaaccagcatggaagggtcaagtgtcatagaagaaaccccctagcctaccctactcccagacttcatgccagaggtttaactccacttcccttctgtttgcctgcctagatgctctccccttctccatccacaagcggtcagggcgacaggtaggcagactcctgagaaccagaagtccagaggctttgggtgtgtggagtgattccagtgccttcagattccttcaggctcctgggggtcccctctgccagccaccctatgttcagatcgtccatctgatgg

SEQ ID NO: 4948 - DNA, 479 bp, Homo sapiens
ctgtgagggtgtgactactgatgatgcttcaaaggaagaggaagcagcaatattttaggactgggtaccagcagagaaggcagggaggagggagcgggggatcaggctggagggcgcgagttcaccatgaggctgaggaacgattctctctcgtggggtccaagactagcccaggaaacagggagtcgcagggggactggagaggagacctgggccagcgggaggcagtgttctccagagggtcagatgcgtctctgattcaggccagaatacaggtcccgctggcctttccggatgggctcatagtctgggttgggaacaggtggtggcctctccttgttttgtcccctttgcctgccgccagcacccgctcctcgtgtcacaggcttggccttggcctttctattcttgctccagtagtaaaccagcagcagcaagcccccagtgatgcagatgtccactatgacaattgtggacct

SEQ ID NO: 4949 - DNA, 634 bp, Homo sapiens
  misc_feature (1)...(634): n = g, a, c or t
aaacaaaatatttaatgtctatacagtaaaattattcaaacttcaaaccagtattgaaagcagttggaaaccagctaatagtttcttaatctcagatttcgagatgaatgtaaactgcattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgccttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattggtttcttcatccttgnggngcttattcat

SEQ ID NO: 4950 - DNA, 306 bp, Homo sapiens; identical to SEQ ID NO: 484

SEQ ID NO: 4951 - DNA, 428 bp, Homo sapiens
ctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatgg

SEQ ID NO: 4952 - DNA, 280 bp, Homo sapiens
  misc_feature (1)...(280): n = g, a, c or t
ctgtgctattggtcatagagctgcttatgtcctcttccagtttgtcaatgatcatagcaaaggctttgaagatggcattagtgggtccagccaaagngataattctctcaggacaattcccttctgagatgttgatacgtgcaccactctcctcgcgcatcttcttaactgattctcctttctttccgatgatactgccaacttcctttccatgcataagtagccggatggtgagagtgacatttaatccaccttcaatcacaccggtgtccatgtcgag

SEQ ID NO: 4953 - DNA, 349 bp, Homo sapiens
  misc_feature (1)...(349): n = g, a, c or t
gacctcgtgatccacccaccttccctcccaaagnactggaattacaggcattagccactgtgccnanccgaggctgncatttttaaccggctctggatgactctgatgcagccatcctggaccttggctgtggtctggtaactggaacccaatgacgtaatcaggngccatcgggggtcatgggaaagggggatccccaaggtctgaggtggactaggaaggctttctgaagaacctgggtctgttagggcatcanccaatcaaggtacaagtaaatagaggcaaaatgagggtttgaactgtgancagttggtcctggaaaagaaagaaaccaagagattatggggac

SEQ ID NO: 4954 - DNA, 426 bp, Homo sapiens; identical to SEQ ID NO: 218
  misc_feature (1)...(426): n = g, a, c or t

SEQ ID NO: 4955 - DNA, 253 bp, Homo sapiens; identical to SEQ ID NO: 362
  misc_feature (1)...(253): n = g, a, c or t

SEQ ID NO: 4956 - DNA, 291 bp, Homo sapiens
aaaggagcatctcagttacgtgtggcggacaaaaaaaaaggagcagactgtgacagaccattcccatcggccaagtggtcgaacccgacatccaagacccagcgagcagccaagctcagcgcaacctccgggcttctcgctctgactccaaaagggtgagtacgtcgccctcgcgcacggggccttttacattgcggatgatggatcggctcgtgtcgtccatgaattccacgcgcacctgcgtgcactgtccctgagaaccggtcctgcccaggaccttggtgaccctgg

SEQ ID NO: 4957 - DNA, 278 bp, Homo sapiens
  misc_feature (1)...(278): n = g, a, c or t
cctctagctgtgctgctcaagagactggatcagggtagctacaagtggccgggccttgcctttgggattctacctgttcctaatttggtgtggggtgcggggtccctggccccttttccacactcctcctccgacagcanctccctgggcagnggcctggtctcaccgtgtgcagccttgtggtttatgcttaaatgtacattttcctgctggtaaaaggagaaactgagaggtgtcctgcagaccggctgaccactccttttggagacggcaggagg

SEQ ID NO: 4958 - DNA, 566 bp, Homo sapiens
agagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacggtaacagagctgtcagttccccaaaatgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaag

SEQ ID NO: 4959 - DNA, 498 bp, Homo sapiens
cctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaatt

SEQ ID NO: 4960 - DNA, 189 bp, Homo sapiens
  misc_feature (1)...(189): n = g, a, c or t
tttttttttttttttttacactcaggttctaattttaatagggaaggaaaaagttacagctcagtgcaccatgaagttgaggcanagatggagacacctcagccccacctctntggaacaggaaagatgattggggagggagcacaggtcagncgtgggaagagggtcatggtggacatgggggtgggg

SEQ ID NO: 4961 - DNA, 396 bp, Homo sapiens; identical to SEQ ID NO: 217
  misc_feature (1)...(396): n = g, a, c or t

SEQ ID NO: 4962 - DNA, 145 bp, Homo sapiens
ctgcttcagcctgcccaacataccaagatggcaaccagacgataagaaactaccagagccggagccccagcccctttccctgccatccctgcaaaatgcctcgtctttggatgccaccagctcttcaaaggactccaggtcccag

SEQ ID NO: 4963 - DNA, 275 bp, Homo sapiens
ccttgggaagggggccaagaaaaaaagaacggccactctcctttctgtccttcccttgtgtggaggacagtgattgaaacaggggagttaaaaagccaggaagaaaagaaatcaattgcacatctctagttcgcaagcgtcaaagtcacaacaagtctatacacaacaactctctatctgtagatatgaaattccatcatgatagcacagcgcctgcttgcccctaaatgttcctttcttctgctaatcatgtcagttactatggatgggctgtg

SEQ ID NO: 4964 - DNA, 193 bp, Homo sapiens
aaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaaccctttcacag

SEQ ID NO: 4965 - DNA, 394 bp, Homo sapiens
  misc_feature (1)...(394): n = g, a, c or t
ctgccagtagacccccggtcaccctgaggctggtggtccctgctagtcagtgtggctctctcattggaaaaggtggatgcaagatcaaggaaatacgaggagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgnccagctctncggtcatctttgcaggnggtcaggacaggtacagcacaggcagcgacagtgcgagctttccccacaccaccccgtccatgtgcctcaaccctgacctggagggaccacctcta

SEQ ID NO: 4966 - DNA, 166 bp, Homo sapiens
ccgggcaggtccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctgg

SEQ ID NO: 4967 - DNA, 475 bp, Homo sapiens
ccagaggggcagggcacgctaggctggactaggagttaagagtactgtctaaccagtctggcttcttccttcttccagcagccagccctcccctcccattaaagttttactcccacatcctaaaagctcctaacttgaactttgtctaaatagtctctgagactgcatgtgaatttaatgttttttgaaaaagccttcttttttgtttggactatgtagcaatttgattctgccactcccttcactgtggcattcccctcccacccccgctctggcctagacaataagttaatgctagacaccacaaaaaagggcagacatggcagtgcagttttaatatacatatatgtagaatatatatgtacacacagttagcacggtcagggtggggaggggcatcttggggtaggcaggaggctggggtcactcactgtactgtagtgatgtggctaggaggtgttcacaagcccagggg

SEQ ID NO: 4968 - DNA, 519 bp, Homo sapiens
tggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagc

SEQ ID NO: 4969 - DNA, 226 bp, Homo sapiens
ccaagcagccagccactgcgatctaggagtgaattaccttcagtccttctgccccaccaccccataagctcccacccaggaggacaggggacctgccaaggacccagcgaggcagacaggatctgaatcaagctttgctcctccaggttctcagaaactcccaaaccctcttaatgcattcctcacagccctacctagcctgggaaaacgaaagacttgaggcgag

SEQ ID NO: 4970 - DNA, 571 bp, Homo sapiens; identical to SEQ ID NO: 363
  misc_feature (1)...(571): n = g, a, c or t

SEQ ID NO: 4971 - DNA, 447 bp, Homo sapiens
  misc_feature (1)...(447): n = g, a, c or t
ccatcaacacaagggcgctgaccagcacagcatacagggtggccttccctagcaggatctcatagaggatggtggcagacaggaccccttgctggtaggacactgttggcacggaggaaggacaggtgggtacctgtgcacaggtagctctggtctctcccaccctccaccctccagtgtctgtgagttcttcatgccttggttctaggtcaagaaccatgagagagggagaggaaaaggaagggcttacttacccgaggtaaagccacagtctgaaagaaagcagggagaggaaaataaatgagagaccttattttcataggcaattaaaagtaaagtcagatttgcagttggcacagactcccangcccanaccagcttcctctgacagcccagcacctcctttcttntgccatgcagatgtcagccacattgtccttgcaatcc

SEQ ID NO: 4972 - DNA, 293 bp, Homo sapiens
  misc_feature (1)...(293): n = g, a, c or t
aaatgttctcaccacaaaatgataagcgtgtgaggtgatggatatgccacttaccttgttttnatcatcccacaatatagacaggcattgtcactttgcattgtaccccangaatcttcacatttgcttttttgtcaattaaaaatagagacacaaaaggagagaggggagagcaatagactcttcacggaaccgngggcttctgcctccgggtaaaataaactgcaaaaaggattcccaggaaaccgttccctctttcagcccttggttacaggaagccggatttgggaaat

SEQ ID NO: 4973 - DNA, 414 bp, Homo sapiens
ctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacag

SEQ ID NO: 4974 - DNA, 282 bp, Homo sapiens
cgacggctccttcttcctctacagcaagctcaccgtggacaagagcaggtggcagcaggggaacgtcttctcatgctccgtgatgcatgaggctctgcacaaccactacacgcagaagagcctctccctgtccccgggtaaatgagtgcgacggccggcaagcccccgctccccgggctctcgcggtcgcacgaggatgcttggcacgtaccccgtctacatacttcccaggcacccagcatggaaataaagcacccaccactgccctgggaaaaaaaaaaa

SEQ ID NO: 4975 - DNA, 377 bp, Homo sapiens
  misc_feature (1)...(377): n = g, a, c or t
ctgaaatgtctgcttaatggtgacgatggtgctattagcaggtgggtgagccagttcccaaggtacacgttcactatcaagagctaancacacctgctaacaactcagtctcctacaaacctgatgtttctccagcaaaacaaattaaaattaaacctaatggtacttctggctgaggctccagaggtccccaggagggagggtgtttgcgtggagggggccttggttccacagaatggtggcttatggacgcttttaagacactaaagaaacccacatggtaaaaggctgggtgcggtggctcacgcctgtgatcccagcactctgagaggctgaggcgggcggatcacaaagtcaggagttcgagaccagcctgg

SEQ ID NO: 4976 - DNA, 420 bp, Homo sapiens; identical to SEQ ID NO: 364

SEQ ID NO: 4977 - DNA, 212 bp, Homo sapiens
ccaggctgcactgtggctagctcaatgtttgttgcattcagcttctcctccattacttgtttgaggatgatgagtgaagacttgatggcttctttcaaagtcatagacttgtggtaaacttcttgcaaggagctctgggcaccctctgaagcagagccaattgctcgagcatcacactgtacaaaggtcccagatgggtccatatgaaacag

SEQ ID NO: 4978 - DNA, 274 bp, Homo sapiens
cctggctgagcaggcagagcaccctgggaccccagggcagaaggacccccgccctccagtccccaagacccaggcccgtctccactcatacacgccacctacatgtgacgtcagccctgaaaaggtaacaggaaagttcagaacaaaaacaaaaccccaaaagtaaaaaggctacgtgtagcagagtaataccggaaacgttatatacacaggcggtgatggccccctcggaagtgtccgggtcacttagggggcactgcagaggtccctgtgg

SEQ ID NO: 4979 - DNA, 460 bp, Homo sapiens
  misc_feature (1)...(460): n = g, a, c or t
aaatttcatagattttcatgtgtcataaaatattgatcttttcttgatttctccccaaccacataaaaatgtaaaaagtacattagtttgcatccacactaaaacaggcagtgagtcaaatatggcctgtgggccatactttgccaacccttggcctacagtanaaaaaaaacccctcagaattccttatgggctttgtgttattttgtcacgtggagccaccttaggctggggaagtagaaagcacagggcttttgggcattaggtcctangttccagttctggccctaccatctaccagccgggtagccttggacataaaattcaaactctctgggctttactaccatcatctataaaatggggcaataacacctagatcacagagttgtcatggcaattaagtgagctaatgtatatagagctcgtggcaccagtatctggcatacagtaggcactc

SEQ ID NO: 4980 - DNA, 398 bp, Homo sapiens
  misc_feature (1)...(398): n = g, a, c or t
aaaaacaaaatcttaaattactaggagtatatttacaagattaattacattttaagccagcacaccatggatgtacatgaagggccactcagtgtccctcgctgggacaggttgtgtgacctgcccaaggggctccggctcatttgccaaagtcaagacgacgaccaggtcttctgactgctcagcccaaccaataatgaaaaaagtatcagagatgtgtcatatccattttgctaacnagcaattacatgcctttttagtgnttaagagaagccttaattttcctgggatatctccgtaaaatcattctggaatttgattttgaaaattctttaagaaaaaaaaaaaagcttgtcacccccatgagacctgctgtctctcatgtctgcagggacagg

SEQ ID NO: 4981 - DNA, 302 bp, Homo sapiens
aaataaccttactttcaaaacttagtttaaggttgaacatcccagtgaccagattatgattaacagattgaaaaatgataaagcctgaagtctaagtttatccagcagggtgactcatgcttctttgtcatcctcccacggcagcaatttgttccatgtgaatgctagtaacaggcatcatacactgttaatgctaatatgtaggagtcagttggaggcaaaaacccctatcacgattagcattaacagcatacagcctacagcaagccttcagcactcagaggatgaggcataaagaattt

SEQ ID NO: 4982 - DNA, 171 bp, Homo sapiens
aaatacagtcatttcgtaatgaggagtgggcaggctcagggctgcactccctactcctcaccctcatctatagtggtagagatagggacagggtggaaagaagagaactgactagcaacggcctgactctgtgtgtgtgtgtgtgtgtgtgtgtgtgtgtgtgtgtgtgtg

SEQ ID NO: 4983 - DNA, 286 bp, Homo sapiens; identical to SEQ ID NO: 220
  misc_feature (1)...(296): n = g, a, c or t

SEQ ID NO: 4984 - DNA, 475 bp, Homo sapiens
aaaagaaattcagaaactaagcggttggagaggggcattggaaatagagggggatgctatgagatgggggttgggagcagagaagaaactgcaggagggcaaagtgtaactagcaatataccttctgtgatgctccagaaacacatgtctgctaagattaacttgattggagtttcttatgaaacaggctgatcatcaagatttttaactcaggtttcagtgaaaaaattggaaacttttacaagaaagatttgagaagtagaaggcaggcagcaaattttccagatattatgcttgcatttcaaattcctgtttcaggcttttcaagtaggcatgcacattcccaaagccatgatatttggctaaatacacaaggaccccagtcgcacaccgtccatctcgctgccggcagaaactgcagttgcagattcctcgacaaggcgggcaatgccagttcggatccagcagagcatcc

SEQ ID NO: 4985 - DNA, 536 bp, Homo sapiens; identical to SEQ ID NO: 221
  misc_feature (1)...(536): n = g, a, c or t

SEQ ID NO: 4986 - DNA, 221 bp, Homo sapiens
cttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcag

SEQ ID NO: 4987 - DNA, 582 bp, Homo sapiens
  misc_feature (1)...(582): n = g, a, c or t
aaatatttattttcaaaacccctaaaacactggagtatgcttcacctagaaacagattacaggacgaatagctataatgaataagcaatacaatttgtatttgggatgcaattgtgttgtaaagtttcaaataatcaatttataaatttgttgcttttacttttacaaaaatattcatttaacccataacatgagttgcaaaattatctccagacttctacagatgattataaactgtaattgtgtttcagttacacagcaggcgaaaaatttaactgaaccgttacttcaaaatacaatgcattaaaaataattgttacaatataggcaccaataaaaagaattttcttggcatacaacaccacaacaactttctcaagtatctgtattatgtaaattaaaaagaggatgtaatggacctcggccgcgaccacgctaagggctgatgaatcccctaatgattttggtaaaaatcattaagntaaggnggatacacatcttgncatatgatcaaatggtttcgcgaaaaatcaattaatcagacaacaagatgtgcgaactcgatattttanacgactctnt

SEQ ID NO: 4988 - DNA, 414 bp, Homo sapiens
  misc_feature (1)...(414): n = g, a, c or t
ctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgangaaagggtatccgcctcaccattgctgaagagagagaca

SEQ ID NO: 4989 - DNA, 374 bp, Homo sapiens; identical to SEQ ID NO: 365
  misc_feature (1)...(374): n = g, a, c or t

SEQ ID NO: 4990 - DNA, 431 bp, Homo sapiens; identical to SEQ ID NO: 219
  misc_feature (1)...(431): n = g, a, c or t

SEQ ID NO: 4991 - DNA, 530 bp, Homo sapiens
ctgaagggctgcaggaaatattttatgttctgctaattttactctttcagaaagagttgcgacagtatcacccctcttcacgggaacagcttcttgcaaaataatctgtccagcatccacatcttcagctacaaagtgtacagtgcacccagtaactgtgactccggtttccagggcttgctcatgggcatttgaacccttaaaagaagggagcaaggatgggtggatattgagcatttttccattccacttttggacaaaggggccagaaagaattctcatgaatcctgcaagacagactatgtctatggagaactcttcaaggactaggtcaattgcactgtcaaattctacacgatttttatacagtttatgattaattactctagtgggaataccagctctttccgctttatctaacccagctactgcggctttgttggagataacaatatcaatttgtgcagagctatttggttcccgagtactgtctataagtgcttgcaggttcgatcctgttccagatatta

SEQ ID NO: 4992 - DNA, 565 bp, Homo sapiens; identical to SEQ ID NO: 222
  misc_feature (1)...(565): n = g, a, c or t

SEQ ID NO: 4993 - DNA, 529 bp, Homo sapiens; identical to SEQ ID NO: 223

SEQ ID NO: 4994 - DNA, 379 bp, Homo sapiens
  misc_feature (1)...(379): n = g, a, c or t
aaattagccaggcatggtagttggaggctgagacaacagggtcatttgaacccaggagttcaaggcttcagtgagctatgattgcaccactacattccagcctgggtaacagagtgagaccccgtctcaaaacaaacaaacaaaagtaacaactaaacaaaagagaataaagtacttgctcaggaggatagagaagggctaggggagagggcagaaaaggtttgtacaacttagagggcatgaacagcagcagcaccttgtttttttgaccaaacaagaaaaggcccccagagctcacgcacagctatcatcagggccggtgccatggcctggctcctcgggtgacacttncccatctgacacatggcacgagggctca

SEQ ID NO: 4995 - DNA, 266 bp, Homo sapiens
  misc_feature (1)...(266): n = g, a, c or t
cggtgtgattgaaggtggattaaatgtcactctcaccatccggctacttatgcatggaaaggaagttggcagtatcatcggaaagaaaggagaatcagttaanaagatgcgcgaggagagtggtgcacgtatcaacatctcanaagggaattgtcctgagagaattatcactttggctggacccactaatgccatcttcaaagcctttgctatgatcattgacaaactggaagaggacataagcagctctatgaccaatagcacag

SEQ ID NO: 4996 - DNA, 274 bp, Homo sapiens
aaaagagaagggttgaaaaagattgtgtgtgtgtgtgtgtgtgtgtttaattggcccagggttacttaaataaatcataaccattttgccacattctgtaactgtttagttaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagtgaaaaa

SEQ ID NO: 4997 - DNA, 486 bp, Homo sapiens
  misc_feature (1)...(486): n = g, a, c or t
aaaaacaaaacaaaacgatccttttgattgtgtggtgcagacgcaggactgaagccacaggcttttggggtgctgtgagcccagggctttgctcagctcacagctagcgcggcgggcagagcaacccttcggcccaagccatcctcgcagcttgcacagaagcttcctgaacctaaggganccgttcccagctctccttaaattcccagtccccaccctgggcctctctccctaacgatcttgtcgctttgggagcccctgaagtgaaccctgaaatactccctccgtcaactctgggctcagacctttgcccttctctgtgtcacaaggaaatttcggtcaagagggtgggaacaggtggtttcagaccgtgcagcaaagccactgccaggtaagttttaaggcaaattttatctcttcttattcagtctgagccggacctaaccttctcaccaccgagcaatcctgcctatgctggacatgcat

SEQ ID NO: 4998 - DNA, 233 bp, Homo sapiens
cctccttccttcagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaagg

SEQ ID NO: 4999 - DNA, 392 bp, Homo sapiens
  misc_feature (1)...(392): n = g, a, c or t
aaaagtttttctatgatgatgcattaacaatacaaaaatattttgaacactacaataatctttttctcaagacttcttgcagtgttacactagaatatgtgatctttggattctgagaaaccagtggctaaagtaggaactaaaggctttttttgaggggtgtgtgaatacatggacagccctttttttttttttttttttttttganatgcagtctccctgttacccanactggagngcaatagcgccatctcggntcactggaacctccgcctcccgggttcaagngattcttccgcctcancctcccgagtagctgggattacatgcgcgcaccaccacgtccggctaatttttgnatttttagnanatacagggtttcaccatgttgg

SEQ ID NO: 5000 - DNA, 337 bp, Homo sapiens
  misc_feature (1)...(337): n = g, a, c or t
ttttttttttttttttccaanaaggggacaaatgtgggaggccatcactgccccattttattgatgcaggctggacaggaggactcaccacctgagctggggatactcaggtcctggggtgctgagganatggggctgcatctggagagggtgctgttggggtgtactctcatctggagagggtgctgttggggtgtactctcatctggagagggtgctgttggggtgtactctcatntgganagggtgctgttgggggcactcccatntggaaagggtgctgttggggtgtactcctgggaaggcaggggccatanaggagcgggagatgtgtcaa

SEQ ID NO: 5001 - DNA, 496 bp, Homo sapiens
  misc_feature (1)...(496): n = g, a, c or t
aaatccttacatgatttttgaaaccttattaactgaaaatattgcttgctgataaaacttgctcaaatgctattgctgaatgtacaagtcactgattatgccaatacaacaaagataaccacatgtttgaggattgcaatgtgccagacattcactgaaaaaaaaaaaaacacacaactaaacaaaatccacacaacaaacatctganaatctggacacttcacatcagtgttttgaagtgtttcattaatatcttaagacaagtgtatcaaaaccttggcatgatttaatttcaagtcgccaattttgtttttactaacatcagaaagttatggctacactgccaacgccgggtctgcttaatttgacttaagagtttaatatgacttaaacattaaaagctcacactaccccgaaatatataatttcacgcatacggngacattcaacattcaagtgccagtgtttttgtactgncttttggtcaagtttcttt

SEQ ID NO: 5002 - DNA, 297 bp, Homo sapiens; identical to SEQ ID NO: 224
  misc_feature (1)...(297): n = g, a, c or t

SEQ ID NO: 5003 - DNA, 88 bp, Homo sapiens
  misc_feature (1)...(88): n = g, a, c or t
ctgaggtggtcttgcttgtcatcgtcggtgaagaaggacttgttgnggnacgtgcctcncgccagcatgcccttgggagcctcctcaa

SEQ ID NO: 5004 - DNA, 327 bp, Homo sapiens
  misc_feature (1)...(327): n = g, a, c or t
aaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatanaggtgggaagcttataatctaattttaggaggaccaaatt

SEQ ID NO: 5005 - DNA, 526 bp, Homo sapiens
  misc_feature (1)...(526): n = g, a, c or t
ccaacatggtgaagccccatctctactaaaaatacaaaatttagctgggcgcagtggtgggcacctgcaatcccagctactgaggcgggagaatcgcttgaacctgggaggcggattgcactgagccaagattgcaccaagattgcaccactgcactccagcctgggtgacagaccgagactccgtctcaaaaaaaaaaaatcttgtttccgtagagtgcctcggggaacctagtttgggaaatgctcatttagggacctgtcgtaatgtgtgcaggggtcctctcacagaagtgtcctaattaaccacacacacttctgctgctggagctctgagcacaggcagaatgacactaaaatattcagcattgaaaggacacaagaagggaaccatttgcagtttcaaaatactgnttcacgccaggctgcatgttgccttacgaacgctgggcaccttggcgtctctcatccaaactcttccaaaactcccacttattctttgctcccttgatggaaaagcagtgatg

SEQ ID NO: 5006 - DNA, 421 bp, Homo sapiens
  misc_feature (1)...(421): n = g, a, c or t
ccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcattttttttttcttaacagtcaaggggaagagtgattcctcacactgctttcaagctggactgagccagtctcattctgggaaaganatgctgtgtccagaactcagcagctccatctat

SEQ ID NO: 5007 - DNA, 217 bp, Homo sapiens
  misc_feature (1)...(217): n = g, a, c or t
ctgcggggtctggatccgagtctgccctctccgttacctaatctcggacctcagggcccggccctcacgcctgaacaagaaaacatactgcataccacccagacagactgctataacaatctagctgcttgtctccttcagatggagcccgngaactacgaacgagtgagagaatatagtcagaaagtcctggaacgacagcctgataatgccaagg

SEQ ID NO: 5008 - DNA, 165 bp, Homo sapiens
  misc_feature (1)...(165): n = g, a, c or t
ttaagtttgatttttttttcttttttcctttcttaaaaaaaaaaaaaggaagtaaataaattaaattgccaacaatgtggctgagatagccatgatcangccattcttaaaaaaaagaggggggggggcagtaggtggagtttgngaaatataaacaaacaatgg

SEQ ID NO: 5009 - DNA, 490 bp, Homo sapiens
  misc_feature (1)...(490): n = g, a, c or t
aatttcatacaaacaccaagaccaaaatcctaagtattggtattgcgtctcaaatttttcccattaacttaaaaaaaaaaaaagcttaaacttacgtgccttacaggttattaaatgaaactagaattaacaaacatgccaaaatgtttcacttttaatagtagacacagctcctatattgttttacaaaaaaataaaagcatgtctttcaacatgcatccaaaacagtgttcaatttaacgtggcaaagggcaacatttaacataattcaactgcttttacctaaatacgcttactgcttaagtacatcctataactaacttgagaaaagctggaacttaagtttaacagttatagtttactcagcttcactgttacatcctanatgagtattgnattcaaaaatactgggccttaagtcttcataacaatnnctgatttcnacttagagtaagcataaatcacaagcttgtattgcanaaactgttaa

SEQ ID NO: 5010 - DNA, 258 bp, Homo sapiens
  misc_feature (1)...(258): n = g, a, c or t
ctggggacnngtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcanaactactgtgtgtctgttcacta

SEQ ID NO: 5011 - DNA, 402 bp, Homo sapiens; identical to SEQ ID NO: 370
  misc_feature (1)...(402): n = g, a, c or t

SEQ ID NO: 5012 - DNA, 389 bp, Homo sapiens
ctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtaggaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatat

SEQ ID NO: 5013 - DNA, 514 bp, Homo sapiens
ccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaag

SEQ ID NO: 5014 - DNA, 381 bp, Homo sapiens
ccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttgg

SEQ ID NO: 5015 - DNA, 524 bp, Homo sapiens
cctcacctcctcatttcatcacactggggatgaggtttcaaccactaatttttggtgggaggagacaaatatttagaccttagcaaagtacaacaaaatgttcctgtggttgctttctgatattcacccaatcaccctgaagggacaaacctttctaccacttcaaagagggagacaatcttactagcatgtaataatcagcactgttacccacagctcaagccctcaccctagaaacaaagccaagaccactaagtgggtaggtgtcctggctaagtgtggacacagggcacaatcagagatgtgaacacacaaagagcttcaccagcttctcacagaccctgcttgcctttcgaagtgatgaatacacatggcctggtcattccagagactaataagacccctctggcccattacctgaaactggggacccaataccatgcagatggactgagtcattacaaaggcaattaaatgcccaactccataaccaggtgccaacatgtaggcttttgtgcatggat

SEQ ID NO: 5016 - DNA, 432 bp, Homo sapiens
ctgaggccaccacacattacatacattcacgcacttcataaaaaacacctgagggagagaccctggctttgattagcaaataaggtatgaacctgggccagtgcccacattcacacagaccctggcccagggacatcctcctcatatgaagcattaaggcacatgctgtactgtgagccagcactccctgacctcagggtgtgtgaggagttggcactgtagagagaaaccaagactcttcctcaatgcctgccttattctgagcacccacccttagctctgataaggatatcctgagaccacattcaagatccaaaacctttcctcatagatgagggccgtcacccctgcaaacatgaccctgttctgtttgcagggtctccaagattttcacttctgagacaaaaattgaggagacttctgtctgcacca

SEQ ID NO: 5017 - DNA, 328 bp, Homo sapiens
  misc_feature (1)...(328): n = g, a, c or t
cctacagacttatttnttcttggacacacccacggtgcggccacggcggccagnggtcttggtgtgctggcctcggacacgaaggccccanaagtgacgcagccctctatgggcccgaatcttcttcagtcgctccaggtcttcacggagcttgttgtccagaccattggctaggacctggctgtnttttccatcctttacatccttctgtctgttcaagaaccagtctgggatcttgtactggcgtggattctgcataatggtgatcacacgttccacctcatcctcagtgagttctcccgccctcttggtgaggtcaatgtctgct

SEQ ID NO: 5018 - DNA, 511 bp, Homo sapiens
  misc_feature (1)...(511): n = g, a, c or t
ccaaaagtttagcatattctgcagcctcttctttatttttcttggtacgctgcttcttcagagcaatacgccgccgtttgtgctgcaggacacgtggagtaacaagacgctgaatcttgggtgctttggtcctaggtttcttaccttctttatttaagggctttcttacaacatactggcggacatcatcttctttagagagattgaaaagtttgcggattctgctagctcttttggggcccaggcggcgaggcactgtggtatcagtcagtccagnaatatccttctctcctttttttacaataaccaagttgagaacgctcagatttgcatccacaatgcaaccacgaactgattttctctttctttctccagttctccttggtctgtaacaggaatgccccttactcagtagcaggcggacacggccatgggtcaagacaccctgcttcatggggaaaccttgtttgncgntcccaccactgattcggaccacataacccttccattc

SEQ ID NO: 5019 - DNA, 183 bp, Homo sapiens
  misc_feature (1)...(183): n = g, a, c or t
aaaaccacttnacntgaaaatgaattttctgcaaatgtattctttataaatgtanagcatgcaagaatgtataaacataacagaagcatttgtaactggntaactcagttgacagcttgcaagataagtttttgttttgggaggaattggaagtctcccagattttgctggagtctttgctta

SEQ ID NO: 5020 - DNA, 217 bp, Homo sapiens
  misc_feature (1)...(217): n = g, a, c or t
ccatgagtgacaggtggcctcttggtgggagaggtggggcagggggaaggcagctcccactanaccagggcagtatttaggggaaggaggcagattggagcagttggctgccaacacctggcctcactcagggagaggggccttgggcctggatgatatctgggtgaggtacccacaccatctgctgcaacctctgtgtatccattatgggctcacg

SEQ ID NO: 5021 - DNA, 434 bp, Homo sapiens
  misc_feature (1)...(434): n = g, a, c or t
cccaggctgactccttctccctgactgcaagggctcactccctcctncaagctcccacaatgcttcatggctcntgccgcttacctagcttggcctagagtggcaaatggaacttctctgatctcccccaactagactggagcccccgaaggatggagaccatgtctgtgccatctctgttncccctgttttcccacatactangtgctcaattcatgcctgtgaatggcgtgagcccataatggatacacagaggttgcagcagatggtgngggtacctcacccagatatcatccaggcccaaggcccctctccctgagtgaggccaggtgttggcanccaactgctccaatctgcctccttcccctaaannctgccctggtctagngggagctgccttccccctgccccacctttcccaccaagaggccaca

SEQ ID NO: 5022 - DNA, 370 bp, Homo sapiens
  misc_feature (1)...(370): n = g, a, c or t
gccgccntnaatgacncctatngggttccaatancctnatgtncaaatntgactcgttagcaaatccncccaactnaacatcggtcatnttgacnttgcaggatnttcagcaagtntgaagtttttaatcgggaaggattttntnccgttnctgaacaaataaaggttctttgtancaatggctggaaatgcaacatganccctttnttcacnccaaaagaactcataaatagttcaccgggngaaccaaanactttntttttcaaaagcaggtaacnccaaagtnctntggggtatccatnttcgtngcaaaaatgataattnctgnaattttccaaacatcaaatgaagggggatcaatggttaccac

SEQ ID NO: 5023 - DNA, 471 bp, Homo sapiens
  misc_feature (1)...(471): n = g, a, c or t
aaatttaggacacggtacattttccactgaaaatttacaatcatccaacataatgcacaccacccctcaaaggtaacattagctcatatacaaaatcatggaaaacctcacaacatccttggaaggtagatattgttatatccttacaaaaatttaatacacccattaacattcctatttcaaatagctcaatcgatatcaacacataagacagcccacaattgtgatacagnattaagaagaaactcaggccagccgcggtgcctcacgcctgtaaccccaacactttgggaggctgaggcgggcagatcacctgagcccaggagttcaggaccagcctggacaacatggtgagaccccgtctctacaaaaagtacaaaaattagctgggtgtggtgacccacgcctgtagtcccagctagttgggaggctaagacgggaggatggctngttgcttgagcccaaggaggt

SEQ ID NO: 5024 - DNA, 465 bp, Homo sapiens
  misc_feature (1)...(465): n = g, a, c or t
cctattctttctgtgggacagtggagtacatggcccctgangtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcacgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcacgccacccttcaagccagcagtggctcagcctgatgacaccttctactttgacaccgagttcacgtcccgcacacccaaggattccccaggcatcccccccagcgctggggcccatc

SEQ ID NO: 5025 - DNA, 485 bp, Homo sapiens
ccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagcgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacg

SEQ ID NO: 5026 - DNA, 297 bp, Homo sapiens
  misc_feature (1)...(297): n = g, a, c or t
aaaaaaaaaataccctaagtactctgtttacttctggtgaaacaaaaccagtcattagaaatggtctgtgcttttattttcccagactggagtggcttttctgaaacacacacacacacacacacacacacacacacacacacacgtacacacatccctcacttctcttaagccaagaagtttgctttccctagctgcagtgtagatggctcttgtttttgtttttttgntttaatcatttggcattcacatgtggctgttaatatgtgcttgtttttaattaaaacaagaagcttt

SEQ ID NO: 5027 - DNA, 411 bp, Homo sapiens
  misc_feature (1)...(411): n = g, a, c or t
caggaaacaaacactgcttgatttgaaatgaggtattcgtatacaaagcacactattgcnaagggtatgaaaggaagaacgtccgaacatgggcccctgccccaaccaatgcaggccanggctgggggcagccaagcaaggcaggctctcttccctaggtgattttctcagcanaacagacttatgagttgatgcngtgtctggaggacttgacgtcaanaagacctgtgcatggagaatctgataccnagcanctccaggatgatnacatngagaccaccaaggtggaaatgctgagactttctctggcncgaaatcttgctcgggcaattataagagaaggctcactggaaggttcctganaactgcttcaatgtggtatctttgtatggcaatgtatatagatttttt

SEQ ID NO: 5028 - DNA, 438 bp, Homo sapiens
  misc_feature (1)...(438): n = g, a, c or t
ctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgcgtatttctgtgccagcagccaacccaccttggggggctctggaaacaccatatattttggagagggaagttgactcactgttgtagaggacctgaaaaacgtgttcccacccgaggtcgntgtgtttgagccatcagaagcagagatctcccacacccaaaaggccncactggtatgcctgg

SEQ ID NO: 5029 - DNA, 461 bp, Homo sapiens
  misc_feature (1)...(461): n = g, a, c or t
cctactatgtgccaaggaggggtaaggcagctagctctcacagacacaccccacagngaaaatcacacacacacacacacaccccggcatctgtgctcactcacaggcagactgctcactttcttgcacctttcttgccatcacctcggccacacccacattcctccaataggcttgggaaccagcatggaagggtcaagtgtcatagaagaaaccccctagcctaccctactcccagacttcatgccagaggtttaactccacttcccttctgtttgcctgcctagatgctctccccttctccatccacaagcggtcagggcgacaggtaggcagactcctgagaaccagaagtccagaggctttgggtgtgtggagtgattccagtgccttcagattccttcaggctcctgggggtcccctctgccagccaccctatgttcagatcgtccatctgatgg

SEQ ID NO: 5030 - DNA, 258 bp, Homo sapiens
aaaagtttgaagactctcacaggtaagtgcagctcaggatcctgtgagtgcagcagaaagtcttaagaaatggcaggggctggttgaacccagattttccattggctgagcagatatccccagaggcgtagaaaattaaatttgttttatgttgttccaaaagaggagaactgaggccagaggagcacacttctgagacactcatttttgctgggtagaggaactctctggcaagcaggaccatcgatattagagcag

SEQ ID NO: 5031 - DNA, 133 bp, Homo sapiens
aaagcaagaaacagaatgcgagtaatcagaaagcactagcaggcatcagttaatccaagatactagctcttagttccaaaagcacttgcaaagaaaaccttttggggggaaggggtggagagggatggaagca

SEQ ID NO: 5032 - DNA, 187 bp, Homo sapiens
aaaagtcaactggattgcccagcagtttagatgcatgtgttttgttctttatcttatccacattgaagatgtaagtaggtcatctgaaagcatcgggtttgattacaccacataatgcatgtctttctgaagttaagtgttggtgttacacaaatggttcttatctcagaagcagagaagctgacag

SEQ ID NO: 5033 - DNA, 363 bp, Homo sapiens
  misc_feature (1)...(363): n = g, a, c or t
gagatgctgacgggctccctgcccttccaggggaaggaccggaaggagaccatgacactgattctgaaggcgaagctaggcatgccccagnttntgagcactgaagcccagagcctcttgcgggccctgttcaagcggaatcctgccaaccggctcggctccggccctgatggggcanaggaaatcaagcggcatgtcttctactccaccattgactggaataagctataccgtcgtgagatcacgccacccttcaagccagcagtggctcagcctgatgacaccttctactttgacaccgagttcacgtcccgcacacccaaggattccccaggcatcccccccagcgctggggcccatcag

SEQ ID NO: 5034 - DNA, 543 bp, Homo sapiens
ccacagaagttgctgctgacgctctgggtgaagaatggaagggttatgtggtccgaatcggtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttgg

SEQ ID NO: 5035 - DNA, 461 bp, Homo sapiens
  misc_feature (1)...(461): n = g, a, c or t
cctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgnctgggcggaggtgaangacgtccttccccaggagccgactgg

SEQ ID NO: 5036 - DNA, 491 bp, Homo sapiens
ctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcatgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacag

SEQ ID NO: 5037 - DNA, 324 bp, Homo sapiens
ctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacag

SEQ ID NO: 5038 - DNA, 570 bp, Homo sapiens
  misc_feature (1)...(570): n = g, a, c or t
tgttaacacttacatttttgtatatatagacactttttgtattttctacatttttcatatgtaaaccctccccactctccacacatcattattcattatgatcatgaggggtttatcccaggatattcattgatagaaaattaaaagagtaatttataaaatcactacatgaacaagtaaaaacacacacagcaaaatttacatcaaaattattacgtggtacagaatccaaaagtcataaaaagcaaaagctatctttttttcactctggcacccatctgttcttccctggagtnaaacactatnaccaatttttaggtatacttccaaagatacttactgcatttacaagcacagacttatattgattctaaaagaataagagacattttcagcatgtngtttngttcaacaccacagtatatcttaaagatggtcccccatcaatacatatagagatctctcttttttatggcttcatagtattatcatgtgctgatatgccaaaaactaatccattanacccttttgggtatatatttactattttgcagtcttctgctcttagga

SEQ ID NO: 5039 - DNA, 505 bp, Homo sapiens
  misc_feature (1)...(505): n = g, a, c or t
ctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctntgaatttgcacattttgtataatttttttttctttgagcagtgttgatcaagccaagttgaatatttgccatgaaattccagtgaatgtgtagctcaaatgcaaaccctaagtttgctgtcagttattgtatggtcagtgccccagtcctagtacacatatttt

SEQ ID NO: 5040 - DNA, 253 bp, Homo sapiens; identical to SEQ ID NO: 225

SEQ ID NO: 5041 - DNA, 430 bp, Homo sapiens
ctgaatgccactttcagatggaagggaaatgagatggaaaacaacaaaaaaggactgccaggcggaacagtttccaaccgagttttcgttgagtgaggatccagcagccatcaaactcaaacataggggcccgcagggaaactggaggaaatacttcagagacagcaaagctgaaggtttctgtgctctgagggatccgagagtggatgtcccactcctgtatcctcagccagacacagaactagccagattcattagggaagctcggatgctctcattctataaagtaaggcccccagcagggcacgtacatacattgggaaagaagaaaccccttagtaccatgttggtcaaaggcaagagagagaattctatttccatctggaatgtcattcttgtttacttcttccaacagtgaaatacttccagg

SEQ ID NO: 5042 - DNA, 381 bp, Homo sapiens
ctgggcctatgctggtcatgaacggtcctggaaaatgactcccttccttcagtatctgcatcctcatgaagtcattcattttggagattgtgtcttcacttttcttggtgaagaaactgctggatggagttgttggtggcatctgaggagtccgaaggtggctctcagggaaggttgtgctggcctctgaaggatttggaagctgactctgttcctggggtagcttcatgctcttggggtcattgtttctcgggtttgtttttttctttatctggataaaactatgcatttctgaaatcagttttgacatctggttcttttttctaagtcgaaagcagaaaagttggagcttatctccttcttcacaggggatattgtgac

SEQ ID NO: 5043 - DNA, 348 bp, Homo sapiens; identical to SEQ ID NO: 372

SEQ ID NO: 5044 - DNA, 318 bp, Homo sapiens
aaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaagaaatttcggatttcaacaagag

SEQ ID NO: 5045 - DNA, 568 bp, Homo sapiens
catggatcagtgcttccttccttttcatggctgcatcatattccacggtatggatggaggatggaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcaaccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgct

SEQ ID NO: 5046 - DNA, 598 bp, Homo sapiens; identical to SEQ ID NO: 226

SEQ ID NO: 5047 - DNA, 346 bp, Homo sapiens; identical to SEQ ID NO: 371

SEQ ID NO: 5048 - DNA, 556 bp, Homo sapiens; identical to SEQ ID NO: 490

SEQ ID NO: 5049 - DNA, 470 bp, Homo sapiens
aaataaagaagaaagctattgtacaaatatcgctcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatccagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttacacaagattgcaattctagccctttctattatgtttatgatctaaatgagaaaaatctgggatgagaatacacccaacatgaataactgataccaacaaaaatgtggaagctttggagg

SEQ ID NO: 5050 - DNA, 300 bp, Homo sapiens
  misc_feature (1)...(300): n = g, a, c or t
ctgcagggagtgccggctctgttcctgaaaatctgaacctgtttccggagccagggagcaaatcanaagaaataggcaagaaacagctntctaaagactccattctttcactgnatggatcccagacgcctcaaatgcctactcaagcaatgttcatggctcccgctcagatggcatatcccacagcctaccccagcttccccggggttacaccttctaacagcataatggggagcatgatgcctccaccagtaggcatggttgctcagccaggagcttctgggatggttgcccccatgg

SEQ ID NO: 5051 - DNA, 653 bp, Homo sapiens
ctgaacccaaacccacctttcttctcctctgggtctttctctttttcatcctctgttttgactctcttggcttttttgaagttggaagagttcttgcggcccccctctccctcctcttcagaatcggagaactcttcctcacaggcaattcgtttgtcagaggagcagactgggagggagtgggaagcatgggtgagagggcaggcgggtgctgatttagctcagcgtctatgcccagtgcttccctgcgtgtcctccaagagacaccaagggaaagggaaccagaagagggaggaactcgggctccctaacctgttcctacaggcactggaactcgaaaacagatttctctacaggtggggagcttggagggagtgtgcagccaggaatggtggtggaagtgtgagctgcctattgaatggaaggcatagggctctaggtctgggtctcactcgagatgcgcttgtcagggtcgtcttcgtcctcatcgccactctcctcagggatggcgtcctcaggaatcgcctgcatttggaccccaggtgcgtgcggcagcattctaaggttctcaaacagtcgctgtttgatcttctccaggtactcattcgtgttctggttagtcatattggaaggactgatgtggagcttgaaat

SEQ ID NO: 5052 - DNA, 278 bp, Homo sapiens
aaataaatacttagaacacgacttggctcctacaagcatctggactctaggtctcagtactgaagtgtctcacccatgggccccacgcagggacgccacggttccctcccaccccgtgatcaagacacggaatcggctgccgatggttggatcgcaatgcgccccttttctagagccttccccggccatctacaggcaggatgcggctgggaaaaagacaactggaatttctcgaaggttgatggtccgcacggttgaggattctacgtggttctctt

SEQ ID NO: 5053 - DNA, 171 bp, Homo sapiens
cgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccagg

SEQ ID NO: 5054 - DNA, 514 bp, Homo sapiens
ctggccgatttacaccttgataacaagaagcttggagagatgcgcctgaaggaggcgggcacagtggagcataacgcgctgtcaggatcgggggaattttccggtattttaatctgctgacatttggaatccgtgtgcagcccacatggtaaatgtggggagatttgctgatgatcggaacagatcaccaggggcctgctgtaggagacggagacatgctgttagtctgttctgtgagggtccatgacggatccacccaggcggcctgtgtgggagaggaggtgggcaggaggaacggccctttgtggcccggtttggatttgacgtggtgacgcgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatc

SEQ ID NO: 5055 - DNA, 532 bp, Homo sapiens
aaataccataacctgtccctcccaccccccaactacattcgaaaaagtaagaacagcagaaagatcacgaaggccatgtaaaattaattcagatttaattttcttcagggctgtaatcactagggatcaaaactccttagtctggttgattgctgaatgggagaggagtaagtgagaaagatcatggcaggctggccctgcaattattcaaacccaggcccctggctgcctgggaacgggacttgggtgagatgaagtagtaaagacagtagttctgcccatggtgtggagactaaaaagcaaagcaggccaaacttagcttccatggttacatttggaagtttctattcatgacaccaaataaaagtggggaagaaggaagcatggcttactgaagtagtctcaggaagacagggcaagtgtgcaaaaagccacactgccaaagcaggctactagtgaggatcatcctgggtgacttcgaatgcacttgaggggaaaggctcaagtaccctgtagttgtagcaggaaaaag

SEQ ID NO: 5056 - DNA, 577 bp, Homo sapiens
ctgctgaagctcaactcccttttcgagcaggtgtggaagccctgaggcttctctgacatagcatgtgtttattttcttaggtgagacctgattcaggaaagtctgcagccgatatccatcttcaagtttgtggtcctttctccctctatatatccttgacctcagcagtcatgctggggtccagagtggatgattctctccgccttaggtagactcctccttaagagtgtaagtctctcagtctcacatattttgtgagacgtaagctgacattccacaaggagaggaggaaattctgtgggtcacatccaggggtgcttggaacctgattggttgtcaatcctccagttagtttgtcacgagtggaattctgtcctggattcccaaggatcaaggctgccccattagccaggaaatagggagatagaggaggtcacttgagaaagagctgcctctttgccgcctccaggttgtgtctgtttcctctcatatctgaagacagatgtgctggcagaagcaaagtcctttgtccggccacgtgcaaatgcatgggacataaatatgaacagagattctt

SEQ ID NO: 5057 - DNA, 647 bp, Homo sapiens; identical to SEQ ID NO: 571
  misc_feature (1)...(647): n = g, a, c or t

SEQ ID NO: 5058 - DNA, 426 bp, Homo sapiens
ctgcccttccatgtcgtcacaggcataccgggcgtggacccactgcttggtgcccttgccgaagtagtagcacttccgttggaaattgatccacttttcagggcacgtgttgcacacaaagccgctggacacctgcaactccatccttagctttgtcacctcctcccggagtctttccagcaaatctgaagcttcgttcctctcgttcaattcctgggacttgaagctgctcagatctgcttgaagcccgttcaggttccaggacagctccaagtcctgagatttcaatctctgctgttcagctcgaagttcctccagttcctgtgaaatctgcgtggactgggatttctgcgccatctggtcaccgtggtggctttccaagttcttggaaacttgagagacgttccgggcagccctctcttccag

SEQ ID NO: 5059 - DNA, 346 bp, Homo sapiens
aaaagtaagaacttcgttttgaaaatataaattaccaagatatacaaaggagctttcacattgtatttcatgcaatgtgtggatttttcttcaacttttcacttctcccttccatactgggttcttgaccagtgttttcatcagttgaacatataaatggtcttaaatttcctcgagcctccttcacaaaataatcaatgacactgaaaaggtttgggagtgttacaggtttttccagttcaatagtgtagttttgtcctacgctcatcactttgtagtgcttgattcttggaatgtctatctcctgccgaatagtgatggagtagtttctactgtcactaccagg

SEQ ID NO: 5060 - DNA, 514 bp, Homo sapiens
  misc_feature (1)...(514): n = g, a, c or t
ctgatgccaaaataataaaaatgttacaattgataacaaaatctattagaaaaacaggaatatgataaagctgcttcaatatgagaaaggtataataaaaacgaacacactttgtaaatatggatgaaatgttgcaatctttttacctaaaataggaactgatacatatgatatacatataacctttctgtgccttctattcaacattcaaaataaaaccttagctagtccanattcaatgcaatctgtatcaaaatgccagtgacattcttcacagaaatagcanaagcaatcctcaaatttatatggaaccacaaaacatccagtatagccaaagcaattctgagcaaaatatcaaagctggaggcatcacattacctgaatatactacaaagctacagaaaccaaaacagcatggngctcatattaaaacagacatacagaccaatgaatccananacaaatccattngtttacagacaactcacttttgacaaaggtgccangaacatac

SEQ ID NO: 5061 - DNA, 556 bp, Homo sapiens
ctgaagcaggggctccaggaggtgaagcaggtaaccctgtagtcctggtccaggtccagcttccaaaagggaatcacgtccaggaagcacagctctgcatggcggccttcaaggaaaccgtgtttatgtggagcctggttgcatagaaagcccctgcgctggttcagcaggacccaggtgtcattgtgcatgcgctccacctcataacacaggcaagtctcatgccgtcctctgacccaaggttcattgttaaagttgaaagtgaatgtgggtggatccatcgagtgtctgagaatctcccccagcatgatgtgcagtaatatataatatttaggcagattattccaaggctcaaatagctctctttggctgtacacgaacttgctccaacagtgctgaaattcgtcataattcatgatcttcatggtggcacgcggaccgtctcttttctgacacaggctgcgaagcgcctcctggtaatctgggtcccagaagtagtagaggcgggcaacgaagatggtcagggtaaccttcgggtcctcggccaggaacgtgg

SEQ ID NO: 5062 - DNA, 377 bp, Homo sapiens
ctgaaatgtctgcttaatagtgacgatggtgctattagcaggtgggtgagccagttcccaaggtacacgttcactatcaagagctaagcacacctgctaacaactcagtctcctacaaacctgatgtttctccagcaaaacaaattaaaattaaacctaatggtacttctggctgaggctccagaggtccccaggagggagggtgtttgcgtggagggggccttggttccacagaatggtggcttatggacgcttttaagacactaaagaaacccacatggtaaaaggctgggtgcggtggctcacgcctgtaatcccagcactctgagaggctgaggcgggcggatcacaaggtcaggagttcgagaccagcctgg

SEQ ID NO: 5063 - DNA, 270 bp, Homo sapiens
ccaacaataagaacttctctcccatgttgcacagcaagggtggcacgcccttctctccaagtccagaggctgctgctaagaacttttccaagagggcttccagtgttagtgagcgcacttcagggaaggcagattctaacagcttgaaggcccaagggaatcccgttatcagctctgatcctgagataatccctctgacttcctcccagaagccaagactctccagaactaagaagcaaaaaaagcaaaagggaaagagataatcacttt

SEQ ID NO: 5064 - DNA, 573 bp, Homo sapiens; identical to SEQ ID NO: 245

SEQ ID NO: 5065 - DNA, 280 bp, Homo sapiens
aaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaaaaaaaaaaaa

SEQ ID NO: 5066 - DNA, 201 bp, Homo sapiens
ctgggggtcctgccgggcaagccgcagcagcatccctcgcttcaggtccatcccaaacttggagcacaggtcctccttcggggtcttgaggatgtaaaagtcgagcccataagcctcatcgatgaggtccagggtccgcatggtcacagtcactgtgaacttcttgtccaggatctcactgtagaactctcgctcaaacag

SEQ ID NO: 5067 - DNA, 295 bp, Homo sapiens
ccataaggaagaaattaaattaacactggtctttggtctctcagaaaccttcagccagaagaacctgtctttgaagaaaaagatcttatttcccacggtagtgacagcatcaaaactcaaattggggtcacagagagctggttctgaattgtcaggatttggcaagcgttggttctcttttgggtctccatacagggactgaatgccacgtatgtcatcagcagagaggcgaaatgtgttgatgtcaacatatttgtaggtggggaacattacggcctttggatcactagaatgg

SEQ ID NO: 5068 - DNA, 381 bp, Homo sapiens; identical to SEQ ID NO: 374

SEQ ID NO: 5069 - DNA, 372 bp, Homo sapiens
aaacacatgcatatatattgtcaattgtgggaagctttacaagttatattccatgcactttttggacagagttctaacagagccagccagtccacaaaacaggcagacaaaagttgaattaactggggcaaataggactcttatgcaacatccaaaatatctgacattctgccctgaaatacgttcagcacacctacaggactggggtgaaagtggataaagcaacatttatggttggcagctatggacctcggcctgaggagtatgagttcctcactccagagacaagtttatgtagtacttaatgtacatgatatgaatgtgaagcataaaattaaataaaatttttccccattggcttggttttatttt

SEQ ID NO: 5070 - DNA, 612 bp, Homo sapiens; identical to SEQ ID NO: 227
  misc_feature (1)...(612): n = g, a, c or t

SEQ ID NO: 5071 - DNA, 443 bp, Homo sapiens; identical to SEQ ID NO: 563

SEQ ID NO: 5072 - DNA, 460 bp, Homo sapiens
ctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggttctgactaataagaagacgaccttctttggtggcaattctatctctatgattgattacctcatctggccctggtttgaacggctggaagcaatgaagttaaatgagtgtgtagaccacactccaaaactgaaactgcggatggcagccatgaaggaagatcccacagtctcagccctgcttactagtgagaaagactggcaaggtttcctagagctctacttacagaacagccctgagg

SEQ ID NO: 5073 - DNA, 498 bp, Homo sapiens
aaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggattt

SEQ ID NO: 5074 - DNA, 386 bp, Homo sapiens
ccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttt

SEQ ID NO: 5075 - DNA, 258 bp, Homo sapiens
ctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaactttt

SEQ ID NO: 5076 - DNA, 487 bp, Homo sapiens
  misc_feature (1)...(487): n = g, a, c or t
ctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgngngtgctttcttaatgngngtgccaatggtggatctttgctactgaatgtgtttgaacatgttttgagatttttttacctgcc

SEQ ID NO: 5077 - DNA, 542 bp, Homo sapiens
  misc_feature (1)...(542): n = g, a, c or t
cctgggcttgagcaatagcctcaggtatctccatcacttacacagcactcattcgttcagtgagatgtcatttattaagcagttacaatgctgcaggtgctgtgcaggagactggacatacaaaagaagaatttgacccagaccttccccctctggggtctcataatcttgtagggggaagggaatacaaatacaaattagcgaagaatgatagcagtatcttaggacactgtaactgtgtgctacgggacccaaggactggagagccatcccttcgtgaaggtcagggaagagctgggtggtggagagagctgagcctgtgtggacccctgatgcatgctctgatgctgagggagtacagtagagatggacactgatagtgacagaagagtttggccccaaagcagaagcggcatcctgcaccgactccccttagaatgaatgagtacgcacaaganaacaaccacaggcatcgccgcccttcantggatctctttgctggagaattgacagantgcgtgtcgcgcctgantgagccggta

SEQ ID NO: 5078 - DNA, 220 bp, Homo sapiens
ctgcctgaggaacccagcccctgacccctgccaccctccggtggcccaggtgcctacctccctcaagcctgggaaggtgggtctggggaaagtgggccaagtgatctgggggtaccccttgggttggtgtggggaaggagtgcctccttagtggtgcttgcagtcacaggaagcagcagcagtaaggacaaggggccggattccaggtcttcaacactgg

SEQ ID NO: 5079 - DNA, 518 bp, Homo sapiens
  misc_feature (1)...(518): n = g, a, c or t
ctttttttttttttttttttttttgcaggtgaaccatagtctcactttatttcgaattttaggactgaacagaaagaaggttcacagatatttcttcagggaaggaaagtgggcaaatagcacaatgaggcaaaccacacaatctanacgtactttcccgggtaaacaaactgggaagcccanagctcacagaggaggagagcagagcttggggtggcananaggtgttccttgggaaggagtcaggaacacaaganaaatgttcatgagctcatccaggatagagaggactcttggggaaggggacctccttccccatgctgtctntgccccaagcccttaatgaagcaggagagggaagtctgtccanaaactcatctggttagacatttgcatcaggaatagggagggggtggaggcanagccactttggacatgggaaatcacagttgcagtanacagtgagctctagtcactccanaagctngacataatttgcagggaanagtccaaagtgg

SEQ ID NO: 5080 - DNA, 268 bp, Homo sapiens
ctgtatggctgggggctcctcgtatgcatggaacccccagaataaatatgctcagccaccctgtgggccgggcaatccagacagcaggcatagggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttt

SEQ ID NO: 5081 - DNA, 560 bp, Homo sapiens
  misc_feature (1)...(560): n = g, a, c or t
cctgctcctactatgtccttttccttctctcatatatttcagtcgtctggagttctcagaataaggaatccattatcaatgacctatcccatgaacattttttttgagaacctgtgtaagactatatagacatgaatatttgatgacctgacacctcaccgttcaaacctagatttgggttgtataaatatcaactcaaggctgtaagagcctcccatggtctaatgtttcaagagtaaagaagaatagacaaacacccatgttggaatcatctgttgcagaaaagaacacaaagatagttttattaatttagaacaaattttgagaactttacatagacagaaatcttctatctcctttttttctaattttggggaatgtcttccactagtggtcgctaaaaatgtagaaatatcatagggagtgcaaattacattgtctctttacctgccacaatctggcagcactcatcatgtagcaaatgcccaaataatagactacagattatagtgacttcaccctaggttaacattatttctaggtaaggnactagtatatct

SEQ ID NO: 5082 - DNA, 224 bp, Homo sapiens
ctgcctccgtttgggtggcagaaaatgtcacagggacctttcagccacaaagaggcttttaggccgtggttgggggtcttcagggtcttgctctgggcctggctgtatccatgctcaagagtggagaggggcagagggggtgggcaggcggccgtctgggtctggtcttgaatcaggtcccatggactccgcggaaccttcgctggctggcggcgtgcatgtgg

SEQ ID NO: 5083 - DNA, 288 bp, Homo sapiens
ctgtgagctggcaccgagaggggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctgg

SEQ ID NO: 5084 - DNA, 181 bp, Homo sapiens
  misc_feature (1)...(181): n = g, a, c or t
caacaatctgngtgcctctctggttgtttctcttttttattattactcctgagttgatgacattttttgttagatttcatggtaattctcaagtgcttcaatgatgcagcatttcttgcactaaaaaaaaaaaaaaaaaactanaaagttttgggacatggggttatattaaattattctt

SEQ ID NO: 5085 - DNA, 288 bp, Homo sapiens; identical to SEQ ID NO: 228
  misc_feature (1)...(288): n = g, a, c or t

SEQ ID NO: 5086 - DNA, 343 bp, Homo sapiens
ctggtctccctccaccctctcatatttacacccaaccccttccccaaagctagcttttaccaaagttcctggtaggaggtcaagaagtgtgtccacttagccggcagtcctagatgtagtggacgctgtttgtccccaggccagttgggcaccaggaagggctactctggggattcagggcatagactccgtactggggtcaagggaggcccccactcacagatactctcctttccttctggggctcaatgtacaccaaaaccttcagaaagcaaagttggagtggtggacccccaatgtcaagtttagtgctctctttgcttgtgaggacccacacaagtgg

SEQ ID NO: 5087 - DNA, 635 bp, Homo sapiens
  misc_feature (1)...(635): n = g, a, c or t
cctgattggttaaaaacatcaggctgtagctaaagcttaaactccctatatgattgggtgaagtttcaatcacttagtttgcagcagtgactcatttttgcttaggagaaagtcccctttgattggttgaagtttcaatcccttagcttgcagctatgactcattttggcttagaggaatgtccccttagggaagtccctgttgacccaggaagtctagctaacttagccacttagtgcctcagtaccccctctcaacaggaaagcccaagtgctgttgagaagttgggcaatgatcattctagctacttcctgctgaactggggcacagaaggggatctgcagttgagggttcctcaggaggggagtcttcttcagtgtcgtggtgttagaacaggttggtaggtcagtctaggggtcctcgatagtaggtgctagtggtggtcatttggggctccatttgtagaaccacttgcagtttcatggattctattcacttcagagaaatcccggacaggcccccagaaatgagatgagaagtctcttccgatcgaaggtttttatcaattgaagagtttgnggttccacgggcttcaaagaatgaaggcttggaccgcagcagtgagtgttacagct

SEQ ID NO: 5088 - DNA, 535 bp, Homo sapiens
aaaaacaaaaggttgatatactataaaataagatgcttcagtgcagctccaaaaacctttataaatacagccatttggaaggacgatcctggatcagaaattattccttgtgtatctatattatgtgcatgcctcatttcagttgtcataattgtctctgtaatttcctcctgagtagcggtcataaccaccctggtttctgccattatagtctctggaacgtccatatccatatccataccctccaggtcgactgtcataatacctgccactcccatagccctggtccccaccacctctagagtagctgcgaccacgcccatgggccccaaagccacctcctctggttccccgagcagacttgcctgcatgatccacacggatctgacgaccatccagagactaagtgtgggagacacaaggatgatgggttggcagtcagtcagggcaatggtgagggaagagcaggcaagggtaagtgggcaaaagaggccaaaaattcctgctgggcaccaggttctgggtgccatgttcc

SEQ ID NO: 5089 - DNA, 418 bp, Homo sapiens; identical to SEQ ID NO: 4915

SEQ ID NO: 5090 - DNA, 545 bp, Homo sapiens
cctagattttcaagaagtccaatatctctcacttgaagtgtcttttccctggagtagattgggagatttgagggatatctgtccaaagatgagacagtctgtttctagtttcccatccagcctgatggggcgtctacagtttttaccacaaggtgtcgctgttgaacagattctggtgcagtctagtgcatagctgtccacttctagagtgatcacttgctgggccaagttcctctccttaagtggtgtctcacattaaggttcccaaattacagactcattaattcaccctaataagctcatccaggcagtttaggtcttcaggggcttccagcctccaacacacattgggccaaaaccagcctgtaccaccagctccaagccctgtgttgaatctaggtcattggtccagatgccccttcattctgggcctgtggtgtcctttccagacagcagacctcagttaagggcatcccagtccatcagagaagttccaggatcacagaccctcaaaaggggcagtgttgaggattcagtctgttttc

SEQ ID NO: 5091 - DNA, 571 bp, Homo sapiens; identical to SEQ ID NO: 230

SEQ ID NO: 5092 - DNA, 584 bp, Homo sapiens; identical to SEQ ID NO: 231
  misc_feature (1)...(584): n = g, a, c or t

SEQ ID NO: 5093 - DNA, 409 bp, Homo sapiens
  misc_feature (1)...(409): n = g, a, c or t
cctctcctccactgcatgtggcggcagggcgggtaggtcgcagggctccatgattgtggggcagcttcaagggcacatggggcagaggccctcgaaggtcccctcctcagtaggggatgtcattctgatagtactggatcatgttgtaggtccggctcctgttgctgaggaagcagctctggatgaccttcatgatgaaatttgcagcctcgcgctcagtcatgttggggctaaacctgtgcttcaagaacttgattggccgcgaaaacagggcaggcccgtgtccaacatgatagtgaccagggagacgaccacatccatgtagggccgcacagccaggtagcctggacacacatctncatgaaccacttgaagggtgtggcctccatcttgccccccatgatcatca

SEQ ID NO: 5094 - DNA, 135 bp, Homo sapiens
aaaaaagagcattttattttaataaagaataaaagagatcaatatactgttttaatggatacaaaaataaatattcattcagcatattaaagatatgtgctttgacattcatttgaattggagattcaagcctat

SEQ ID NO: 5095 - DNA, 549 bp, Homo sapiens
ctgaggaaatgggcagtcccatcgctagaaccctgttcttagaaattacctggtctcttgctctgacagatgctgagctaatgctgggtcacatatttaacagctagcctaaagccataggctggaacagagttggcaagagcctggctcaggtgtagcgaggagtagagagggaagacaaagggagtatcagacccctcacacgggcctctcctccccaaagatggttccacctgggtgtgttcaggagtcactaccttcacgctccctcctcccccaccccagctcttccagggtatacctaaggggtccagagcaaggaagggggcttgagctgggcccgaggaggtgaggttggctggaatttagggtggctggcagaggagagctggggaggctgcagcctttacagcagacagcaggcacggaatatcagcaggtccttcggctcagtaagcttcagtgagacactctcattggccccaatgaagagcacgccaccacgttgcagagggattggtgtctgggttgtgggtgtgctggctatta

SEQ ID NO: 5096 - DNA, 276 bp, Homo sapiens
ccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgagg

SEQ ID NO: 5097 - DNA, 443 bp, Homo sapiens
ctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccag

SEQ ID NO: 5098 - DNA, 332 bp, Homo sapiens
  misc_feature (1)...(332): n = g, a, c or t
aaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtnncataatttacaaattagttcttt

SEQ ID NO: 5099 - DNA, 594 bp, Homo sapiens; identical to SEQ ID NO: 229

SEQ ID NO: 5100 - DNA, 325 bp, Homo sapiens
  misc_feature (1)...(325): n = g, a, c or t
gtacaagcttttttttttttttttttttttttttgcanaaaanaacacaaagatagttttattaatttanaacaaattttganaactttacatanacanaaatcttctatctcctttttttctaattttggggaatgncttccactngtggtcgctaaaaatgtanaaatntcatagggagngcaaattacattgnctntttacctgccacaatctggcagcactcatnatgtagcaaatgcccaaataatanactacagattatagngacttcaccctangntaacattatttntaggnaagggactantatatntgaattgaa

SEQ ID NO: 5101 - DNA, 166 bp, Homo sapiens
aaagccacacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaacttt

SEQ ID NO: 5102 - DNA, 574 bp, Homo sapiens; identical to SEQ ID NO: 380

SEQ ID NO: 5103 - DNA, 510 bp, Homo sapiens
  misc_feature (1)...(510): n = g, a, c or t
ctggacacagacacttccccagccccagggccagagtggggctggagggaaggacagggctacagtagtagtgggggtatatgagggaaggctgcaaggatgtggtagctggagttttgagagatggataagagttttccaaggaggcaaaagtggcanaaaagctttgcaggtgaggaggagcagcanaagcttaacctgcatgagaatncctntcancagtcagaaagttgaccctgcacagccaaggggtaagctctgaccattttgcaggggacagaactgagacccagagagggaaaggaacttgcccactgtcacactgcatggaaggggcaaaactgtaggctccaatacttgngctcttaacctccttactctgagccttctcacgcttggcatgctgttccctctgccaggaatgcctttccttcccttgattgcgtgaaaagttcctgccaggtttggtgtcatccctttgtgccccttgtagggtgaggacagaaaggg

SEQ ID NO: 5104 - DNA, 130 bp, Homo sapiens
ctggcggtaaggctggaaaggactccggaaaggccaagacaaaggcggtttcccgctcgcagagagccggcttgcagttcccagtgggccgtattcatcgacacctaaaatctaggacgaccagtcatgg

SEQ ID NO: 5105 - DNA, 597 bp, Homo sapiens
  misc_feature (1)...(597): n = g, a, c or t
ccagggatcagtctcatggccgtagaagcagccaaattcctctgcctttgccttcccttcaggagtcacatgctaaggcatccttgggcatttggaaaaggccgcttggggtgagagtgctctaggccactctgcaatgtccctgggcccgatgagtaacaaatgcaccccgggacccagagaagtggaaagacatgaaagggatttggaaacagatcgtaaaaataacctgtatgaaaatcacacagacaagaaaacaaacaaatccagctagccccttggatcctgccatccgtcttttctcccgggactgcctttgctttgtggagggtgagtcctgggacaggctttgggtgacaagttgtgggcatgttccatccaagcctggctctcccgactggcagagggaggtggctgacaatcaattcctctggatacattttcctgtgattgctcctgtgatcaaaggcagccaccgacaggtgcgggagcggttagttcaccacgtcatagtagtaattgcgcagccgcagttccactgntgcgaatccgggcctgttttccacatcgtatgtccagcacagattcatganatcg

SEQ ID NO: 5106 - DNA, 583 bp, Homo sapiens
ctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaattatacttacttctggcataac

SEQ ID NO: 5107 - DNA, 123 bp, Homo sapiens
  misc_feature (1)...(123): n = g, a, c or t
agctcttnttaagcctcttggatttccagattacaccaaagactgtttccaatttgactgagagcagctccaantccgtccagagcttcctgcagtcaatgatcaccgctgtgggcatccctg

SEQ ID NO: 5108 - DNA, 361 bp, Homo sapiens
ccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcag

SEQ ID NO: 5109 - DNA, 343 bp, Homo sapiens
ccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgaccccctaccaggaactttggtaaaagctagctttggggaaggggttgggtgtaaatatgagagggtggagggagaccag

SEQ ID NO: 5110 - DNA, 457 bp, Homo sapiens; identical to SEQ ID NO: 232

SEQ ID NO: 5111 - DNA, 547 bp, Homo sapiens
  misc_feature (1)...(547): n = g, a, c or t
ctgcagtttctcaatctctaggaatcctgcagtaaaacaagccccttggtgagctggaagatttgtgcccagtgacaaagagatagtttgtaaaatgctgtgtaattgtaagttaccacaaatgaaaatacatgacagcacaatgtggcccgtagaaaattcccctctccgcttctgcttttcctgaaggagagttctgagcatccaaaggctcctcacttacctcactgactccccttatttcctgggtttactttccccattaacactgacatctaaatctctagaggagtatgtcatcccttcctccctggttccatattctaagtttcagaatcatgatctttttctgcactaacgtcccacagtcctcagagtttctcacagttcattgatgtgtactgagtatataatttatacttagcccccacggcggggtggttctcagaagtggaagacaggtgggtctttggagaacacggngggaatcttggtgtactgactaacttgatgggcgcttggttcctcttccagccagacctcggcc

SEQ ID NO: 5112 - DNA, 256 bp, Homo sapiens; identical to SEQ ID NO: 233
  misc_feature (1)...(256): n = g, a, c or t

SEQ ID NO: 5113 - DNA, 388 bp, Homo sapiens; identical to SEQ ID NO: 574
  misc_feature (1)...(388): n = g, a, c or t

SEQ ID NO: 5114 - DNA, 259 bp, Homo sapiens
  misc_feature (1)...(259): n = g, a, c or t
cctatccaaggaacaggntagtaggaaatcacattctgaagcactcattctgcctttcttcagtgtaagaaagttgctcaaaagaagaagcgngacaacacaagctgctacaatggctacattctctacattcaatgtaagagagaaggagctatggtcactccatgcaaaggccagatagagatgtggtgcgtatgtgcagagtacctcaagaaatgaaagncagcatgtctcttggaagctatgaacactaatgttt

SEQ ID NO: 5115 - DNA, 143 bp, Homo sapiens
  misc_feature (1)...(143): n = g, a, c or t
gaggtaaagctgttttacaatatgataacaagaacacccagcagatacaggttgtacagttaatcattttgactgtgtcagtaatataatcagaatactgtaacggtaagagaaaaatacttttttttttttttnganactgg

SEQ ID NO: 5116 - DNA, 364 bp, Homo sapiens
  misc_feature (1)...(364): n = g, a, c or t
ccatgaacgcctttggagacatgaccagtgaagaattcaggcaggtgatgaatggctttcaaaaccgtaagcccaggaaggggaaagtgttccaggaacctccgttttatgaggcccccagatctgtggattggagagagaaaggctacgtgactcctgtgaagaatcagggtcagtgtggntcttgttgggnttttagtgctactggngctcttgaaggacagatgttccggaaaactgggaggcttatctcactgagngagcagaatctggtagactgctctgggcctcaaggcaatgaaggctgcaatggtggcctaatggattatgctttccagtatgttcaggataatggaggacctgc

SEQ ID NO: 5117 - DNA, 275 bp, Homo sapiens
  misc_feature (1)...(275): n = g, a, c or t
aaaaagcacaaaacttttggaatgttaatggataactactattagtctcaaaattctaggcatttctataaaacattggncaatgtgactagtaagttaacgggaccaaggtttcaaagatcaatactgaaccttgataaataataagaggaaatgtaactccacaaaatgtttctgattaagtttgtgcccatgcaaaattaacataaatttcttaactcaagaatgaggaatattaaagcaatgtattttttcaacataaagcatgcattttc

SEQ ID NO: 5118 - DNA, 247 bp, Homo sapiens
  misc_feature (1)...(247): n = g, a, c or t
ctgtaattatttancctcaantgactttctccattgcttcacgctatgccactattttgcttntttaatttttttaaccttgcttantattctatagttngcccaaccagttttacgtccaaggaaaattagccaatgcataaaatatacaaactatgaaaggcaaggatcangaanccaganactttgccaccaaatctcanattattagaaactaggtgtcagggtttatcaanaaggccaggaa

SEQ ID NO: 5119 - DNA, 205 bp, Homo sapiens
ccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcag

SEQ ID NO: 5120 - DNA, 320 bp, Homo sapiens
ccatcctccgccaagctcgagagcccaggcaagctgtgattgtcacaaggaagctgactccagaggtcatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcag

SEQ ID NO: 5121 - DNA, 161 bp, Homo sapiens
  misc_feature (1)...(161): n = g, a, c or t
tgtcagagnacggctcctgngacgctttngcttattttntgtacggctttttcgagttggcttaggcagaattctcctctgagcgatnaagacgacatgcttcccactgaactttttctccaattcgcgnnnctagccggacttggnttttctggaaagat

SEQ ID NO: 5122 - DNA, 258 bp, Homo sapiens; identical to SEQ ID NO: 5075

SEQ ID NO: 5123 - DNA, 318 bp, Homo sapiens
  misc_feature (1)...(318): n = g, a, c or t
tggggcgtntttgtgtttgagatattagctcaggtcaattccaaagagtaccagattctttcaaaagtcagatgagtaagggatagaaaatttgttcatcttaaggaacagccaggcgctagccagttaagtgaggcatctcaattgcaagattttctctgcatcggtcaggttagtgatattaacagcgaaaagagatttttgttaaggggaaagttattaagttgacactgtggatcaccttcggccaagggacacgactggagattaaacgtaagtaatttttcactattgtcttctgaaatttgggtctgatgg

SEQ ID NO: 5124 - DNA, 327 bp, Homo sapiens
ctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaatttaattattagtactatgactgaaagattcttcatggctaaaaagctctgcatcaaactcaattcaggaggccttccctccccaccaccatcaacctcttcaaaacctactccctccctctaagtatctctcaacacag

SEQ ID NO: 5125 - DNA, 421 bp, Homo sapiens
  misc_feature (1)...(421): n = g, a, c or t
cttgctttgttatctnctacatatatnccaaagggataagntaggaacaccngaaactcagnagtaactcactttaaccttgcttntggggctccaattcaagtgatgctcaatttcnaggtacaaggaaaaccatnagaatataaagtcataatgccatttccactcagangaaaagatttatctntctttagatactcaaaattattcttggcattttagcacttttggnacacatttcctgatgnaggaaatagtaaaatttcagngcctatggcattggntttcaccacctatgcaattttntacacatctgaaaattaccaggttatctaactccttaaatgttcctctcttcaacaacaaaaaacacanacaaaaatgnngggagaaacaggaagcatccaggtccaaatgacag

SEQ ID NO: 5126 - DNA, 192 bp, Homo sapiens
  misc_feature (1)...(192): n = g, a, c or t
aagtgngctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaactttt

SEQ ID NO: 5127 - DNA, 196 bp, Homo sapiens; identical to SEQ ID NO: 653

SEQ ID NO: 5128 - DNA, 323 bp, Homo sapiens
aaatttggggcgtttttgtgtttgagatattagctcaggtcaattccaaagagtaccagattctttcaaaagtcagatgagtaagggatagaaaatttgttcatcttaaggaacagccaggcgctagccagttaagtgaggcatctcaattgcaagattttctctgcatcggtcaggttagtgatattaacagcgaaaagagatttttgttaaggggaaagttattaagttgacactgtggatcaccttcggccaagggacacgactggagattaaacgtaagtaatttttcactattgtcttctgaaatttgggtctgatgg

SEQ ID NO: 5129 - DNA, 329 bp, Homo sapiens
cccggccaagagaagagattttcctaactgggcatatgcagcacatgtgtgccgatgggaatgatccactggaggaggagtagcgggaaacgacaggcactgtagagggggatacacaggggaggggcggagagaatcatccactctggaccccagcatgactgctgaggtcaaggatatatagagggagagaggaccacaaacttgaagatggatatcggctgcagactttcctgaatcaggtctcacctaagaaaataaacacatgctatgtcagagaagcctcagggcttccacacctgctcgaaaagggagttgagcttcagcag

SEQ ID NO: 5130 - DNA, 571 bp, Homo sapiens; identical to SEQ ID NO: 234
  misc_feature (1)...(571): n = g, a, c or t

SEQ ID NO: 5131 - DNA, 489 bp, Homo sapiens
ccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgagcgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtagggaaggaaaagggcaaatacaaggaagaaaccattgagaagatgcaggaataaagtaatcttatatacaagctttgattaaaac

SEQ ID NO: 5132 - DNA, 404 bp, Homo sapiens
  misc_feature (1)...(404): n = g, a, c or t
aaaagtgtcgtaaaattctcaactatatacaaaacattgtccacttaagctgcctgcctttcaagagtaactctcctcccatgcaaagggtactgttgcacataaaagatatcctcatctgcatgttttccagtacctctttctccaccctaaacagttgaaatttaattggtctcaaatttcaagtgaaactgatacatggcaaggctgacaccactgtatcatgtaggttttctaaataaagcattttatgtataattntaancattaaagtaagtagatagggatgccatttctaatatatcagcatggctgatggcagtgaaaccatccaagatagaaggcccacttttaacagagtttaaccagtatttatgggccttatnaaataaaaagataatttt

SEQ ID NO: 5133 - DNA, 413 bp, Homo sapiens
  misc_feature (1)...(413): n = g, a, c or t
aaaattaaagtcatcacgaaatggaagttttcccaggatggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctanatccagcctcaggaactaacaagttttgagaaaagcaggtggtagagcagcagcttcgtgctctcancggtggctggctggcatttttctctagcgttg

SEQ ID NO: 5134 - DNA, 252 bp, Homo sapiens; identical to SEQ ID NO: 656
  misc_feature (1)...(252): n = g, a, c or t

SEQ ID NO: 5135 - DNA, 379 bp, Homo sapiens; identical to SEQ ID NO: 657
  misc_feature (1)...(379): n = g, a, c or t

SEQ ID NO: 5136 - DNA, 374 bp, Homo sapiens
  misc_feature (1)...(374): n = g, a, c or t
ccaggctgatcttgaactcctgacctcaagtgatctgcccacctcggcctcccaaagtgctgggattacaggcatgagccaccgcgcccggccagcattgtatcttaaaggtagcctttcagttgtttggatgacagttgtctccactggacatctgcttcatgccaggccctctcctgggngttggtgtgtccactcttccctccaaccaccatattcccttgaggccaggaatggacctaagggtgcctcaggcatgggaagacccgataccggcctctctggagctcgctggcttctggagttctgagttaaggaggnagttgaagagacccatgtatgacccccagatgccagnaaaactaatcatgtgc

SEQ ID NO: 5137 - DNA, 271 bp, Homo sapiens
  misc_feature (1)...(271): n = g, a, c or t
aaacgcttcatgacagggtaattcatgtccaacatatcaaaaacatatttatagataactttagaaagaaaatacatactttttttgataatcacaagtagcaatgagattttctatattattttcagnctcactttagaaatgttttaattgtctaaatttaatcaattcatcgattaaaggaaagacaataaaatagtaaaattacatgtgtttatatataagngtgtgngtttcaaataacaaaacgcaggttgnaaactaaaatcac

SEQ ID NO: 5138 - DNA, 266 bp, Homo sapiens
  misc_feature (1)...(266): n = g, a, c or t
ctccaacacgaccatcgtagggngaagcccacgttttcttccatggcctcaaaggccctagaacttgcctacctttctggccttacctcctagctacttatccatctcttgaactttatactcttgtataaatttctaactttcagaaaatgccatactctgttttgncaccacacatgtatatttccccctggtacacttggaagactcttatccatctgtgaaaccctatgttgncatcacttggtccatgaaatattacctgg

SEQ ID NO: 5139 - DNA, 557 bp, Homo sapiens
ctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgtaaacagactagcttaattaatattaatatgattaggatgggc

SEQ ID NO: 5140 - DNA, 525 bp, Homo sapiens
gcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctca

SEQ ID NO: 5141 - DNA, 399 bp, Homo sapiens
  misc_feature (1)...(399): n = g, a, c or t
cagtggncttggngtgctggcctcggacacgaaggccccanaantgacgcagccctntatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcctcagtgagttctcccgccctcttggtgaggtcaatgtctgctttcctcaacaccacatgagcatatcttcggcccacacccttaatggcagtgatggcaaaggctattttccgccgcccatcgatgttggtgttgagtactcgcaaaatatgctggaactttt

SEQ ID NO: 5142 - DNA, 459 bp, Homo sapiens
  misc_feature (1)...(459): n = g, a, c or t
aaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccctcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagngat

SEQ ID NO: 5143 - DNA, 248 bp, Homo sapiens
ccatggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctgg

SEQ ID NO: 5144 - DNA, 471 bp, Homo sapiens; identical to SEQ ID NO: 382

SEQ ID NO: 5145 - DNA, 452 bp, Homo sapiens
tgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtga

SEQ ID NO: 5146 - DNA, 425 bp, Homo sapiens
  misc_feature (1)...(425): n = g, a, c or t
ctgcacactggcacacttgaccttcatgcagtcagaagctttggctgattccccatccaaaatattagagatgaaatgaaagcaaagtaggcatctgacaaaagttgctttttcccttctgcattttaggacctcaagtaatgtttatccagaaactgctatcataccagagattcactgtgtatttaacaacataggcatccaatctggcaaatttgaaaaactcttaacatacaccccaaatccctgcccaaatttaagaactagggtggacacagtgcttttttccatgtcgcatcttctgtgatggggctacgatatgtgggagcagagaatgnggagggtggagcgcatnccagatgaggatctatcagcaatgggagggggcctccactttagcatctccaccctgctcctctcagagg

SEQ ID NO: 5147 - DNA, 348 bp, Homo sapiens
  misc_feature (1)...(348): n = g, a, c or t
aaagtttagacattaacaagtgatagattagcctcaaaaaaagacaatttggtaaggtttaggtcttttaatttggtgcttgttcacaacttgactggtgcttctttccttgctgtcttcacatcaagccatggggccaattctattttcagtaaatgtttgacagctttttacttagtaacagtctcagcacttttattaagcatgcaagactaacaaaaactttggcaatgcataagngtaacacagtgacaagagagcttttacaattaagncttctaatactgccttcacagngtggaaattgtgctacatccaccaaaagagggccccgnctactcaaatatt

SEQ ID NO: 5148 - DNA, 405 bp, Homo sapiens
  misc_feature (1)...(405): n = g, a, c or t
ctgcccttccatgtcgtcacaggcataccgggcgtggacccactgcttggngcccttgccgaagtagtagcacttccgttggaaattgatccacttttcagggcacgtgttgcacacaaagccgctggacacctgcaactccatccttagctttgtcacctcctcccggagtctttccagcaaatctgaagcttcgttcctctcgttcaattcctgggacttgaagctgctcagatctgcttgaagcccgttcaggntccaggacagctccaagtcctgagatttcaatctctgctgttcagctcgaagttcctccagttcctgtgaaatctgcgtggactgggatttctgcgccatctggtcaccgtggnggctttccaagttctnggaaacttgagagacgtt

SEQ ID NO: 5149 - DNA, 130 bp, Homo sapiens
  misc_feature (1)...(130): n = g, a, c or t
cggatcagaaggccacaagcttccctctcctcccctatcttcccaggtctgtattccgggagcctgtgtaactcgggcctcaactccaggctcccggctgggnattctcattctctgcagtacttgaaaa

SEQ ID NO: 5150 - DNA, 345 bp, Homo sapiens
gagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccgcagaagcagagttacaggacatgattaatgaagtagatgctgatggtaatggcacaattgacttccctgaatttctgacaatgatggcaagaaaaatgaaagacacagacagtgaagaagaaattagagaagcattccgtgtctttcatttttc

SEQ ID NO: 5151 - DNA, 400 bp, Homo sapiens
ctgtcccttgaatatcatcattgaaagtacaatatttttctcggtactttctaaagaacctgaatgcattatgatttccaaagtcttcgaactgaatgagtgtgttccggccatatctgtcagtaatagctttcataaactcatcaatcaggtcatcatactgttgtgtgcgatctcgtttctggtacaagcccatgtaaaatgggtcttttaagagtgcgatattatcagttcccacatcaatacacactggcaggcatctatcaggccgtattcctgcacaagctgtatacaaacaaagttttcctactggaattcccattccatagacacccagatctccaagacccagaattctctctccatcagtcactacaacagccttaacatgattttctgg

SEQ ID NO: 5152 - DNA, 316 bp, Homo sapiens
  misc_feature (1)...(316): n = g, a, c or t
taatgaaaaagacttanaacaatgtattatttacatgtaaataacnaaaaganagcagaatccccatatcctcttcaaaggaagggagacggcaggccatttatganaagaaagtccatataaaccccattaagnanaatctggatctaaatacttccaaacaggagtacacagcaggngaacagnctccctnatcccactgatctgctgcttcagataanatcagcaacnntcatcggcntctcatcaatctgagtggaatagtactgctcgatatctctgaggatgcggatgnngtcattctttacaaagttaa

SEQ ID NO: 5153 - DNA, 408 bp, Homo sapiens
  misc_feature (1)...(408): n = g, a, c or t
aaaaaaaaaaaaaaaaaaaaaaaaaaaaaaangaaaaacttctntttaggctgggtgcggttcctcatgcctataatcccancatttagggaggctgaggtgagtggattgcagganctcaggagttcganaccagcctgggcaaggnggcaaaaccccgtctntactaaaaaaaattagctgggcttggnggcaggcncctgtaatcccaggtnctcggganactgaggtagganaattgcttgaacctggaaggtggaggttgcagtgagttganatcacaccaatgcactccacccagggtganagtgananactgtctcaaaaaaaaaaancaaaagaaaaacttctntntagctntgtgacgggcagttcanataataccttcaccanatttacctgttttca

SEQ ID NO: 5154 - DNA, 327 bp, Homo sapiens
  misc_feature (1)...(327): n = g, a, c or t
caggncttattcatcagggaggaaagtttctttgaaaatagttattcagntataagtaatacaggattattttgattatatacttgttgtttaatgnttaaaatttcttagaaagcaatggaatgagaatttaagcctcaaatttgaacatgtggcttgaattaagaagaaaattatggcatatattaaaagcaggcttctatgaaagactcaaaaagctgcctgggaggcaganggaacttgagcctgtcaagaggcaaaggaatccatgtagnagatatcctctgcttaaaaactcactacggaggagaattaagtcctactttt

SEQ ID NO: 5155 - DNA, 426 bp, Homo sapiens
ctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttacaggtgtccagcggctttgtgtgcaacacgtgccctgaaaagtggatcaatttccaacggaagtgctactacttcggcaagggcaccaagcagtgggtccacgcccggtatgcctgtgacgacatggaagggcag

SEQ ID NO: 5156 - DNA, 481 bp, Homo sapiens
ccacacagactcaccaagccacagacttgtcttccacaagcacgttcttaccttagccacgaagtgaccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcggtggacgatggaggggcccgactcgtcgtactcctgcttgctaatccacatctgctggaaggtggacagtgaggccaggatggagccaccgatccacaccgagtacttgcgctctgggggtgcgatgat

SEQ ID NO: 5157 - DNA, 463 bp, Homo sapiens
  misc_feature (1)...(463): n = g, a, c or t
ctgagattggctcagtgacccgggggcgtgaggctgaggcatgcggtactgactgaagattggctctggctcgtctgagggcacggatgtccttcccaatgcctcgtgtgagttggtaagtattgccagctaaggaaagaaagttggatatgttctcacccaaaaactccttcacctccttcaatttgtcaaggcttttgatgaccaggtcgtgggcttgggcttgtgtccaccacttctttccgtagtctatggtactgctggtaatcccggtcaaagctgctgtgattcccaactccatcccaggttccaagagtacaaggctgcctccctctgtgaagggtgccagacccatgccgacgagggtcaggatgccagangaaatgctgagagagccagacaccacattggcgatggnggtgcctttgtggaccttntgaaccccatctgcaagggcacggag

SEQ ID NO: 5158 - DNA, 326 bp, Homo sapiens
  misc_feature (1)...(326): n = g, a, c or t
cctgccttttacacaccagttgtgtgtttgttagtggctgctggatgccagtccacaccctcaaacacctctcagtcccaaacggggtgctcctacaggncccagggtcctgttagtggaagaaaggcagttccaggaagtcttcctctagccttcatgacaggaagtagttaatcctctgggaaatagacttgcagccctgggaagaaaagagttgttcctccttggggacatacaccatcatctgggctatttcatccagtgtctcttctttatacaggagctcctggctcaggaaggcatcccgtgcacacagcctcacgtga

SEQ ID NO: 5159 - DNA, 357 bp, Homo sapiens
  misc_feature (1)...(357): n = g, a, c or t
ttgtgttaatcccagttttagtgcagcttaggaggctgctagttaggaagatggcagtggctgtaggttgggttgccagaaaagatggnggcctagtcttattattcagatggagaacttagaaagcctgaagagtacccaaattggattgtattttaatggacaatggctgtattttttccatgttagaaggatcctaatgaaagcacctgttatttttaagnttctaagggtctagttgttcagaatccccaaggatatttccctaacctcactcagtcacattgtaggagccagngtagctatggaattatcttaggaactcaagcttctaaaactatccatgtagtcaaatct

SEQ ID NO: 5160 - DNA, 332 bp, Homo sapiens
  misc_feature (1)...(332): n = g, a, c or t
ctgtgtaaagtacagatcctaatataggtaactaactaatacctactaaatatgcattatttttagcttgttttagaagcagatacctatcgatttcagaagaatctgcgaatggcaaccaaaaggcaaaagaaaagtaaatgaacacagcagtgtttattaggtggnttttaatattgtttattagcacagnaacaaatgcagacttaagtagtccacaacatagaaccaatccactgagcaactcctattccacgccttacagntagttaacagcttaaggtatttcactacaggttttcacaagtcctgattcagaccttttttacctc

SEQ ID NO: 5161 - DNA, 452 bp, Homo sapiens
  misc_feature (1)...(452): n = g, a, c or t
gttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttaggtatatttataatttccagatgacaaagtatttcatcaaataacttcatttgatgttccatgatcaaganagaatccctatctctattttacaagtaattcaaagaggccaaataacttgtaaaca

SEQ ID NO: 5162 - DNA, 292 bp, Homo sapiens
  misc_feature (1)...(292): n = g, a, c or t
ctgctggtgctgggcaggctggagactcacgggagaggcaggaggagaatcagcgtgttgagtccctcgctgtgttagtgtgaaaaattctcattactgttgcaaataaaagggatcacgatcactagccccggaaaccctcatctcccggaccatcaggatcgcactgaacagaatggtcccctaatggtccctgaggacagcgtcttgcagaacataaatgtnaacattgaatggcagacgactcccttccccttgaaatcttcacaaaagtgtgtacgagaaagtatgt

SEQ ID NO: 5163 - DNA, 464 bp, Homo sapiens
gagaaacataagctagactgaaacataggggcaacactttcactgtgcttttcaatccaaaataattttcctaagagcccactatgtaccacacactattgagcacttgggattaaaaaaaagttctccagaggctttccagtctagtaccatgtgtctcagtcttggtgctactggtattcggggcttcagaattatttgttggggattggtggggtggggagctttcctgtgcttcgtaggaggttcagcaacacctctggcttctaccaaatagataccagtaagcacatgcaccctcacagccagatgggacaatcagcaatgtcttcagccattgccaggggacagaatcatcctcgattgaaagcatctggtctaaggggaaagaccagtgtggaagtcagacaggaagtcactggcaggctagtatcctttggatgaacagtttacttactataagt

SEQ ID NO: 5164 - DNA, 505 bp, Homo sapiens
  misc_feature (1)...(505): n = g, a, c or t
cctcagggcctcttctggaaaatgaagaaattcaactagtagattcctgaggtctccccagcttaaaaaaaaaaaatctgccccgtgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccanaggagccctattccactct

SEQ ID NO: 5165 - DNA, 489 bp, Homo sapiens; identical to SEQ ID NO: 235
  misc_feature (1)...(489): n = g, a, c or t

SEQ ID NO: 5166 - DNA, 480 bp, Homo sapiens
caacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagacgggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgc

SEQ ID NO: 5167 - DNA, 395 bp, Homo sapiens
aaaaaaaaaaaaaaacaaaaaacagggtggagaggaggataggaaggggacagttgataaaaccccagggccacagcagaggcaaagggcatctggggagagggttcgaagctgtggcggactccactaatgtaaccctccaatgtcaagccatgggcgtgatcagtagctaagtgatgacaaggctgttgggggtggacggaaaagacttggggcaaagcagactgtttatagcctgagctggtagggcctggtgcagcagcctacccggaactggcactactctttcccaggttccctgactctctatcctggtctctgagagcgtgccctacttccgtttcccccactccaaacacacctgaggcatcttccagtgctaggccccatgctgg

SEQ ID NO: 5168 - DNA, 269 bp, Homo sapiens
  misc_feature (1)...(269): n = g, a, c or t
ccaattatccatatgatgagacgcggagtggtagtgctcacgaatacagctcctccccagatgacgccattttccaaagcttggcccgggcatactcttctttnaacccggccatgtctgaccccaatcggccaccatgtcgcaagaatgatgatgacagcagctttgtagatggaaccaccaacggtggtgcttggtacagcgtacctggagggatgcangacttcaattaccttagcagcaactgttttgaaatcaccgtggagctt

SEQ ID NO: 5169 - DNA, 456 bp, Homo sapiens
ctggagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtactatgttggaagcccaccgacgccagcgtcaccctttcttac

SEQ ID NO: 5170 - DNA, 342 bp, Homo sapiens; identical to SEQ ID NO: 577
  misc_feature (1)...(342): n = g, a, c or t

SEQ ID NO: 5171 - DNA, 363 bp, Homo sapiens
  misc_feature (1)...(363): n = g, a, c or t
acgcagcagcctatccgtcgncctatgccccagtgagcacagcttttccccagcagccttcagccctgccccagcagcagagagaaggccccgaaggctgnaacctcttcatctatcacctgcctcaggagntnggtgatgcggaactcatacagacattcctgccctttggagccgntgtctctgctaaagnctttgtggatcgagccnccaaccagagcaagngttntggggttgttaattttgacaatccaactagtgcccagactgctattcaggcgatgaatggctttcaaattggcatgangaggctcaagnnccagctaaagcggnccaaggatgccaaccggccttactgacctg

SEQ ID NO: 5172 - DNA, 272 bp, Homo sapiens
  misc_feature (1)...(272): n = g, a, c or t
ctggaactggctcacagacaggacatctgcctcctcactcaactccactgctctctgggctaagaagatctcaagctccatgagctcatcaaggaactgattccgggtctcagtgtattcaagcagngncagggcatctgggcccctggcaacaccttctggagcctgggttcctgcttccagcactgtgatctgcaaagcaacagcatcgtctccccagtctatcccatcacctccaggatcctttgaatctgattccgggaagatgcccc

SEQ ID NO: 5173 - DNA, 275 bp, Homo sapiens
  misc_feature (1)...(275): n = g, a, c or t
caaagttgaaaattcatagtaagattgatatctataaaatagatataaanttttaagagaaagaatttagtattatcaaagggataaagaaaaaaatactatttaagatgtgaaaattacagtccaaaatactgntctttccaggctatgtataaaatacatagtgaaaattgtttagngatattacatttatttatccagaaaactgtgatttcaggagaacctaacatgctggcgaatattttcaactttttccctcactaattggtactttt

SEQ ID NO: 5174 - DNA, 560 bp, Homo sapiens; identical to SEQ ID NO: 237
  misc_feature (1)...(560): n = g, a, c or t

SEQ ID NO: 5175 - DNA, 306 bp, Homo sapiens; identical to SEQ ID NO: 236

SEQ ID NO: 5176 - DNA, 451 bp, Homo sapiens
  misc_feature (1)...(451): n = g, a, c or t
ttttttttttttttttttttttttttttttttataaaagcttatttttntttattanaatacttttttcaattctgatttgncacaatttaaattntttttntaagaataagcnnaaatttacaaaatttaatttttatttatacatccatccgttcaatacacatttnaanaaagctgtattgcaccctttcagnggtagttacaggacaaanaaacaaaataatccaagagaganaccaacaaatgtntntttataacacagagtaataaacncaaataaatgnggagttatttaagcatgtaanatggtacatgctntaccaggtntgggggcttntntaagacacaagatcagattaaagtnttgaaaganaatntggggttagtcaagcaggtaaaagtgtgaaaagcactttntgagcggaatntccatntgccaagtntaaacc

SEQ ID NO: 5177 - DNA, 484 bp, Homo sapiens; identical to SEQ ID NO: 238
  misc_feature (1)...(484): n = g, a, c or t

SEQ ID NO: 5178 - DNA, 416 bp, Homo sapiens
  misc_feature (1)...(416): n = g, a, c or t
ctttttttttttttttttttttttttttttttttatgacaaattttttatttcaaaaatntcaagttgtaaccagcatagcaccactgacatggatgccttgatagaactccttgatagaactttatgatctgttcaccanaaaanattctacatgatcacnccanactntaattaaggntaaccaatcaaaattcaggtacccaaaaccagttntaatccaggtagaaactacagatcataggaaccctgggactggttttccagggaaccctggaattattttttaagngctacagcatgtacaaggacactggcccanaagcttgcttntcacacgtanaaactgacagactaanaggtagatganagattccaggttccatntancantgganaggcagggctccagcatgt

SEQ ID NO: 5179 - DNA, 186 bp, Homo sapiens; identical to SEQ ID NO: 386

SEQ ID NO: 5180 - DNA, 439 bp, Homo sapiens; identical to SEQ ID NO: 240
  misc_feature (1)...(439): n = g, a, c or t

SEQ ID NO: 5181 - DNA, 306 bp, Homo sapiens
  misc_feature (1)...(306): n = g, a, c or t
ccacccagactgaccagcgggagatggggccccacagggcctcctgcgtcaatgccatggaagggaagaaactggcccaggatgtcagagccaagggctacctggagtgctcagcccttagtaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagnccgggaagcca

SEQ ID NO: 5182 - DNA, 320 bp, Homo sapiens; identical to SEQ ID NO: 388
  misc_feature (1)...(320): n = g, a, c or t

SEQ ID NO: 5183 - DNA, 173 bp, Homo sapiens
  misc_feature (1)...(173): n = g, a, c or t
ccttagcagtagcntgagctgcccccagggctgtgagctgctgaatcttctgactcatcatttccatgacggctgtttcatggcgtgcttctcctgaagagctggntggattttctccatctgcttggctagaaaatctatcttcctcttgaagaagnccttggcatcctcag

SEQ ID NO: 5184 - DNA, 228 bp, Homo sapiens
  misc_feature (1)...(228): n = g, a, c or t
ctggaagatggccgcactctttctgnctacaacatccagaaggagtcgaccctgcacctggtcctgcgtctgagaggnggnntgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcag

SEQ ID NO: 5185 - DNA, 331 bp, Homo sapiens; identical to SEQ ID NO: 389

SEQ ID NO: 5186 - DNA, 439 bp, Homo sapiens
aaaagaggtgcctgcatgtcactattacccccctccccaaatgagaaaaggattttgtttccggaaactggatcagcttctcctcagttaaagaggaaacgggaagtgggcggctggccttctgaccaggcacccgtttgaaccaggatgctcagggcggcctaggcttggctttgtgaagtgtgtgctgctacgcgtcttgtttttggcagtttggtgtctctgagggaggggaggagagtggcaaccggccactggttaatggaagaggatgcgatgcggagatgcttgcttccttcctttggtccaccgccaccccgcctttggagagggcacccacgtaatagacctcatttgtctccaccagagctcactcttacaaaataagctttggattaataccgagttaggcgcagtatggcaggcagggggcgaaaag

SEQ ID NO: 5187 - DNA, 493 bp, Homo sapiens; identical to SEQ ID NO: 239

SEQ ID NO: 5188 - DNA, 435 bp, Homo sapiens
cctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggc

SEQ ID NO: 5189 - DNA, 377 bp, Homo sapiens
  misc_feature (1)...(377): n = g, a, c or t
ccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggnatctatg

SEQ ID NO: 5190 - DNA, 345 bp, Homo sapiens; identical to SEQ ID NO: 498
  misc_feature (1)...(345): n = g, a, c or t

SEQ ID NO: 5191 - DNA, 391 bp, Homo sapiens; identical to SEQ ID NO: 390
  misc_feature (1)...(391): n = g, a, c or t

SEQ ID NO: 5192 - DNA, 178 bp, Homo sapiens
  misc_feature (1)...(178): n = g, a, c or t
tctctntcacacacacagagcccctaccagaaccagacagctctcagagcaaccctggctccaacccctcttccctttccagaggacctgaacaaggtgttcccacccgaggtcgctgtgnttgagccaccagaagcagagatctcccacacccaaaaggccacactggtgtgcctgg

SEQ ID NO: 5193 - DNA, 490 bp, Homo sapiens
  misc_feature (1)...(490): n = g, a, c or t
aggagctgtgcccagtgcctgcanccttcataagcncacacgtncattccctactaaggcccanacctcctggtatntgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctct

SEQ ID NO: 5194 - DNA, 457 bp, Homo sapiens
  misc_feature (1)...(457): n = g, a, c or t
ctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcgtgctgtttccctttaggaatctcggctcaccaacccaggtcatatctaancctgagagcaaggaagaacatgcgatatacacagcagacctagccatgggcacaagancagcctccactgggaagtctaagagtccatgccagaccctggggggaagggctctgaaggagaacccagttgacttgcctgccacag

SEQ ID NO: 5195 - DNA, 202 bp, Homo sapiens
  misc_feature (1)...(202): n = g, a, c or t
tcctctatggcccctgccttcccaggagtacaccccaacagcaccctctccagatgggagggcccccaacagcaccctctccagatgagagnacaccccaacagcaccctctccagatgagagtacaccccaacagcaccctctccagatgagagnncaccccaacagcacnctctccagatgcagccccatctcctcagca

SEQ ID NO: 5196 - DNA, 565 bp, Homo sapiens
ctggcctgggtttctgacccattgagactgccgtgccacgatgctccgtcacctcctttgatcctcctgtatgctgggctggagagaacaggaagggctactgacccatttttatagaagcaaccctaacgatttgagcaatggagtctggcacaggctcagcaggtggaggaagagtaagctgtcaggaaagcagcaggggagagtagtagggtcctgacttgactcagggtctttggaaagttgggtgtggcctccaaggtgagaagataggtgtgggccaccaccaggccatgacaggcgggcagtattgcccaggcttctctctccagtctgtcctgcgtggcatctcctttgagggtcagagaagccagggagggaggcaagctggggtgggtctcattatagaaaagagaagactggggctaagaggggatgttcctgccagcatgccagcctctgatgccacctgcaaaactggtggcaccacctcaaactcagcaatggccttttcaaacctggctcagtacaaacaactcccaaaccatacactttaggaaaactt

SEQ ID NO: 5197 - DNA, 441 bp, Homo sapiens
ctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttgg

SEQ ID NO: 5198 - DNA, 441 bp, Homo sapiens; identical to SEQ ID NO: 5197

SEQ ID NO: 5199 - DNA, 462 bp, Homo sapiens; identical to SEQ ID NO: 391
  misc_feature (1)...(462): n = g, a, c or t

SEQ ID NO: 5200 - DNA, 276 bp, Homo sapiens
ccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatacctacggggtcatggacagtggctatcggcctaatcttagccctgaagagg

SEQ ID NO: 5201 - DNA, 469 bp, Homo sapiens
ccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttgg

SEQ ID NO: 5202 - DNA, 362 bp, Homo sapiens
aaaaaacaaacaataggatagtacttgagctcaggtctggttctcagctacttcatttttattttgttttattttattattatttttgagagagaatctcgctctgttgcccagtggcacgatctcggctcactgcaagctccacctcccaggttcacgccattctcctgcctcagcctcccgactagctgtgactacaggcgcctgccaccacgcccggctaattttttttttttttgtatttttagaagagacatggtttcaccacgttagccaggatggtcttgatctcctgaccttgtgatccgcccacctcagcctcccaaagtgctgggactacaggcgtgagccaccgtgcctgg

SEQ ID NO: 5203 - DNA, 300 bp, Homo sapiens
aaaacgatcaaaatctgtcatcttggctttcctttctctggcttcaatcttcttggcccatcgtgtggctgcccattttgtattgatgtctgccttctgccaggcttgtcggacatacttctggtgggcactgtgcggaaacttgaggatgaaatcagtgagctgcatgcacttgaaaggcatggcctgtctcctcacttgagtgcaaggtccatcgaccaaagccctgttctgatcaataacatctacaatcgcgaccaattttccggcatgaggtccaaaggagacataggccacccg

SEQ ID NO: 5204 - DNA, 574 bp, Homo sapiens
  misc_feature (1)...(574): n = g, a, c or t
ctggaagaccaagcccagaaattcagaggaaataatcttccaaacaaggaacaccaaggtgatcttcttccattccagccacaatactggtgatcataatggtgctagtcagttatccanattatcgagtgtttaccacatcatctattttcagaatgctccgaacagtttcagttgcaagagtcagagcactgactgataccaacagaggctggacaaccagttcctccaaaatgttggaaataccaccctttcggacattaatgcctgcagttttttctccctgggcatgccggtttcttagttctgttactgtanaaatgggattcaggccggcattttcagctagtgtagatggaatgacctccatagcatctgcaaaagcacgaacgcagtaggattccataccactcagtgttcgtgaatattcagttaatcgtagggccaactctatttctggagcaccacctcctgcaataagagccctcttcttcactaaacaacgaataacacatagggcatcatgaatggagcgctcagcttcttcaatcaccagtttgttagaaccacgaac

SEQ ID NO: 5205 - DNA, 88 bp, Homo sapiens
aaattacaaaagaatggggcactcctaggttcaggttgtgagtctgtccatcgcgaaatgcttccacagggtcagggctgaggcatgg

SEQ ID NO: 5206 - DNA, 607 bp, Homo sapiens
ccagggaacgactcagtggcacaaaggaaagagaagaaatgttacaggctgatgctgtcggggcaaatagccctgcaaccagccggacttactgtctaaaagtattaaccgtaatttcaaagacaaaccacaccccttccttttcccctaatggcctcagagatttgtaatgtactttggaaaattaacttctaaggcagagtggaagccaacctcaagtcctgccacttggactctgtgtcttctcttcgaggaagcagcattgtgcacccagcaggggcagatgctgaggcttgccttaacatctcagcagctacaaaatgaaatccactgatacagaaccccttgctgtgagcagtgaggagagagagctgtaaacagacacaaattgagatttttgcacttccaaaaaatacgaggtgaacattagtgctaaacagagagaatgttctaggaagggagaaatctgagaagaaaaagtaagatgagagagaagaaacatgatttttctaatgtacttgtttgagatcaacactttaagactactgataaaactaaatttcgtggggatagacagtgagcagtgagcatcagccagtgaatctgg

SEQ ID NO: 5207 - DNA, 537 bp, Homo sapiens
  misc_feature (1)...(537): n = g, a, c or t
ctggctgggcccaagagctccatctgtttccccaaagtacaggcagcttctaggccattgagtggggcatgatattggatgcttggctcaggaaacaaccccagccaacccaaggggcagtgggacatgttggcctcaggttagaaattattgctcaaagcagaaacagttgtgtcctanagagggtctgttaaaccctctttccatgtgtatctctatgtagcaattgatgggccctgcggtcaggatccctggtttctccagctccatgaatgcctccctgtgaggccctggacagtttctccctcttcttctcctggcttcagtttccccgtatgtacattgagacagtaaggctggatgattctcaggttccctctggctttccattctggcatcccagagtggaggctctgggagggcagaaccctgttcctgcctcagtttccccacctgtgggtctgcgtatagggctgggtatggaggtactgagtaatggagtgctgcgtgaacatcccantctccctgtggatagct

SEQ ID NO: 5208 - DNA, 539 bp, Homo sapiens
ccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaactctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatattt

SEQ ID NO: 5209 - DNA, 543 bp, Homo sapiens
  misc_feature (1)...(543): n = g, a, c or t
ctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacngacaagtaatgtcgataaagaggaggaagctgttaccatagagatgaatgaaccagttcaactaacttttgcactgaggtacctgaacttctttacaaaagccactccactctcttcaacggtgacactcantatgtctgcagatgtaccccttgttgnanagtataaaattgcggatatgggacacttaaaatactacttggctcccaagatcgaggatgaagaaggatcttangcattcttaaaattcaaganaataaaactaagctctttgagaactgcttctaagatgccagcatatactgaagtcttttctgncaccaaatttgtacctctaagtacatatgtagatattggtttctgnaaataacctatttttttctctattctntg

SEQ ID NO: 5210 - DNA, 424 bp, Homo sapiens
ctgctggctggctgggcccccgtagctggactggtttgctgttaagttaagaaaacattagaaccttttttcttatgtgatgtggtacctggtggtaccgggcttgtaattctatagctatcattttccagtcttgatcttacattactgtaaccctctgcctccttctgcctactgtctataaccaggccacccttctatccatcatttgagccagtcaaatattgataaaccaaagtgctaacggtaaacacatcagcaggactaaaatcaacatgattccgtaagtagaggcattttgtgaagatcttatgaaactgcttgactggatttagtgggttccccctcagtttgatacatcaaaggcatgtcaatacacctaattatgcccacatttatcttaatcctgttttgctattgattt

SEQ ID NO: 5211 - DNA, 308 bp, Homo sapiens
  misc_feature (1)...(308): n = g, a, c or t
ccatttaccagactccgacacaatgggccaccaccagtgtgacagcaggacatcctaatatatggatcttgatttttaagtttcagtatctgaacttcgtaaattagtaacttttagctgggaaagtataacatgaaaccagaggttctcagaatgactgtaagatancnnacatttnctntttttgcctttatctccccaactaaaatacaatggggaagaagtctgcctatgatctttgaatgagctttttaaggaagaaatattatatattgtttgttaaagtttattgaaataaagaatcattt

SEQ ID NO: 5212 - DNA, 327 bp, Homo sapiens
  misc_feature (1)...(327): n = g, a, c or t
aaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaacactgctgtgttcatttacttttcttttgccttttggttgccattcgcanattcttctgaaatcgataggtatctgcttctaaaacaagctaaaaataatgcatatttagtaggtattagttagttacctatattaggatctgtactttacacag

SEQ ID NO: 5213 - DNA, 237 bp, Homo sapiens
cctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcag

SEQ ID NO: 5214 - DNA, 525 bp, Homo sapiens
  misc_feature (1)...(525): n = g, a, c or t
ctgtcttctctacatagtacccagttcccacatcgatgagcacgtgttccacatcatgcagnttcccagggacatacatagaactcgtnagtgggacgagtaattctttccctgtgaaagcaatgaagacaaacacctggggaaggttagcggctccaacgtaagacgttaaagagagttccaacagggcacagcacccacagacagtgtgaaaagaacggaaacaggggcaataggagcagaggaatgtcctgtacttttcaattctaggcaggcaacatgcaaagggttcatgaagcggtatacgatatgtaatggattttntcgtttcaggtaagaaaaactgggttaggaggtgggacgagagaagcaggttcgccactttaggttaccctcacccgcctaccccataccctcgttgctcttgttcagcacgttcagacagtccttggcttccacatacttggtctgtaccactttgagctgagcaatggacgtggacaagaactccacttcctggtccag

SEQ ID NO: 5215 - DNA, 118 bp, Homo sapiens
aaaaaaatgttttttaactctcctttctgtcccactgaaaaatttattttgaaagggttaagaagagtctatcattgctggtcaaaatcggcctgaggatggccgccagggacagagg

SEQ ID NO: 5216 - DNA, 616 bp, Homo sapiens
  misc_feature (1)...(616): n = g, a, c or t
cctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccnggagaagaagagggagaaactgtccagggcctcacagggaggcattcatggagctggagaa

SEQ ID NO: 5217 - DNA, 392 bp, Homo sapiens
  misc_feature (1)...(392): n = g, a, c or t
cctggcctccanttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccanagggggactatgaggaggntctcgagcctgaagantcttctttttcttctgctctggctggatcatcangctgnccggctggggctggggctggggctgnggctctggggatctca

SEQ ID NO: 5218 - DNA, 496 bp, Homo sapiens
  misc_feature (1)...(496): n = g, a, c or t
ctgttgactcagattcggcattttaattacattgtttccaagtatgatattctgagagtgtctatancacttagtgtctgcttcatataaactaccagntattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgttgacttggctcccacagtttatgcagacattggagagacaatttggttatttcaaacatcacaggatttgagtaagaagacctggttatgaaacaaggctctcataattactagttntgactgttgacaagttaccttttcttgtttacaagttatttggcctctttgaattacttgtaaaatagagatagggattctttcttgatcatggaacatcaaatgaagttatttgatgaaatactttgtcat

SEQ ID NO: 5219 - DNA, 504 bp, Homo sapiens
  misc_feature (1)...(504): n = g, a, c or t
ccagcctcacgctggagtgcttcgtgcagatgttccccttggtggcggagcacgtgcgcaagtgcatgggggaggaactctaccagctcttcctgagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcanatggcctacctcacacacttcgaggaggatgtagaatcaaaggagtaacagcccctgtggcaaaccaggaaggccaaggctgcggggcagggaagcctggcaagaggaaggcgcctggggtcaagctcanagccactccacttggctccaggggggagacggggattaggcatcccanaggggcagaggaaganccgctggctgcgaanagtcaataaacagccttgatacncaaaaaaaaaaaaaaaaaaaaaaaagcttg

SEQ ID NO: 5220 - DNA, 141 bp, Homo sapiens
  misc_feature (1)...(141): n = g, a, c or t
aaaaacaatgtttgcattttggtatttttcagattcaaattcagtaatacggttcatacgggagctaatacgtgcatntaccaatgaaaagcattgtatctcatgatttgcaaggcacccctgggggggtgaanaccccag

SEQ ID NO: 5221 - DNA, 344 bp, Homo sapiens
ctgctcagagtcttctgcagggattccattcgggacacctctgccagcctccatcttctccttcaggttccgtttgaagaaaccaacctgtacaaagacaaaatttgaacgagcaaagaattcactgagcactttggccccaagaaaatgtgagaacaccttttttttttgagatggagtctcactgtgttgcccaggctggagtgcagtggtgcgatctcggctcactgcaacctctgcctcccagacttaagcaattctcttgcctcagcctcctcagtagctgggattacaggcatctgccaccacgcccggctaatttttgtatttttagtagagacagg

SEQ ID NO: 5222 - DNA, 162 bp, Homo sapiens
gtgtgcatgcacatagggggatatctattgggatgcagagaggtgagagcagctcttcagaagcgctggcaaaagaagaatgtgtattgaaaccatgacgggttagaagctcctaactccacttccagggctgccttcagaaatcctttctcttgaccatgg

SEQ ID NO: 5223 - DNA, 505 bp, Homo sapiens
ctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgccagcttcagaattttgccaacctctgaatttgcacattttgtataatttttttttctttgagcagtgttgatcaagccaagttgaatatttgccatgaaattccagtgaatgtgtagctcaaatgcaaaccctaagtttgctgtcagttattgtatggtcagtaccccagtcctagtacacatatttt

SEQ ID NO: 5224 - DNA, 555 bp, Homo sapiens; identical to SEQ ID NO: 393

SEQ ID NO: 5225 - DNA, 78 bp, Homo sapiens
  misc_feature (1)...(78): n = g, a, c or t
ctggatggtcctcatgtctcttanttgcttccttcagcctaagcacagcagccncagncctttctggctccattgctg

SEQ ID NO: 5226 - DNA, 554 bp, Homo sapiens; identical to SEQ ID NO: 392
  misc_feature (1)...(554): n = g, a, c or t

SEQ ID NO: 5227 - DNA, 533 bp, Homo sapiens
cctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagacc

SEQ ID NO: 5228 - DNA, 236 bp, Homo sapiens
ggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccag

SEQ ID NO: 5229 - DNA, 267 bp, Homo sapiens
ctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcctcagacctagaataatactagtcttataataggtttgtgactttcctaaatcaattctattacgtgcaatacttcaatacttcattt

SEQ ID NO: 5230 - DNA, 618 bp, Homo sapiens
  misc_feature (1)...(618): n = g, a, c or t
cctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgnt

SEQ ID NO: 5231 - DNA, 333 bp, Homo sapiens
cctgcgttcagttggtgcttccagacaccaagggcccttgtgaatcccatcctggaatggaagggctgactgaaaccgtggctaagaattgggagactctcttgtttcaagccaatttaacatcatttaccagatcatttgtcatgtccagtaacacagaagcaaccaactacagtatagcctgataacatgttgatttcttagctgacgttaatatttctttcttccttgtgttcccacccttggcattgccacccacccctcaattaaggcaacaatgaagttaatggataccctctgcctttggctcagaaatgttatagcaaaaatttt

SEQ ID NO: 5232 - DNA, 193 bp, Homo sapiens
  misc_feature (1)...(193): n = g, a, c or t
ctggctccaaaggananagcggnancangggtgancccggntctgctgggccccaangtcctnctggtcccagtggtgaagaaggaaagagaggccctaatggggaanctggatctgccggccctncangacctcctgggctgagaggtagtcctggttctcgtggtcttcctggagctgatggcanagctgg

SEQ ID NO: 5233 - DNA, 546 bp, Homo sapiens
  misc_feature (1)...(546): n = g, a, c or t
aaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaanagtattgtanactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggncagttttgtacacagactgaacaatacagcactttgccaaaaatgagtgtagcattgttt

SEQ ID NO: 5234 - DNA, 281 bp, Homo sapiens
gttacatctaaaatacagaatgtcaaatggttgcatagcttgtttcccacaagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttcctttttt

SEQ ID NO: 5235 - DNA, 508 bp, Homo sapiens
  misc_feature (1)...(508): n = g, a, c or t
ccaggcgcaatggctcaagcctataatcccagcacttgggaacctgaggcaggcagatcacctgaggtcaggagttcaagaccagcatgtccaacatggtgaaaccccatctctactaaaaatacaaaaaaattagccaggcatggtggcacatgcctgtaatcccagctacttgggaggctgaggaggagactcactagaactcaggaagcagaggttgcagtgagccaagactgcgccactgcactctggcctaagcaacagagggagactccatctcaaaaaaaaaaaaaaagattatttctctaacttactggtttatcttttatagctcatttnaggtgatttgttgtgtttgtctatagagtaaaataacatgtctaatgagttataatttaatgtccttccattcaatcactgnatttcaaatttattccaatattttggaataagcttccaatattttaacttaaatagggaaggtcatacttggtatttttcctgacct

SEQ ID NO: 5236 - DNA, 446 bp, Homo sapiens
  misc_feature (1)...(446): n = g, a, c or t
aaaaatctatttatttatcaaaacagtattggcacagnaattctnatattatcatcaaataataaaattgctactttctgtactcaattctttanaatcctanaaattgcaaatgcattcaatttaacaatattgtaaataacaatacaaaagaaagaactctgcatatttatggaaacattgttgatggtacagttctactgaaacncatacacatttcactatttaatttacatatggtcttgttgaaaaaaaccantatgttntactttttcaatttncttatgctaaaatacatgtaattctaaaggatatctcttaggtgtnataaaaaccaaggaaggtccaccaccaagtcaaagttagagtcaaagatacttcaaagattccatgaaatgatctgaaaacaaanttaaccaaaaaatgtgtactgtattggggnacat

SEQ ID NO: 5237 - DNA, 538 bp, Homo sapiens
  misc_feature (1)...(538): n = g, a, c or t
ctgctgtgtgcctccacatggacttctcgtgtctctaggtcattggcattccttcctcctcctcctcctgggagtggggtggatttcaggcggtgtcaaaggctcaacggggctgcaacagtttttttttttttttgagacggagtttcgctcttgtcgcccaggctggtgtgcagtggtgtgatctcagctcactacaacctccgcctcccaggttcaagcgattctcctgcctcagcctcccaagtagctgggagtacaggcacatgccaccacgcccagctaattttgtatttttagtagagaaggggcttcactatgttggtcaggctggtcttgaactcctacctcaggtgatccacctgcatcggcctcccaaagtgctgggattacaggcgtgagccaccgcactgggctggaaagtctttttgagatcttcctcctccttctctccctttttcacagaagggacaaactaaggttgggaagcagcaagtcatgcaccctanatccacctgcccacccaggctcaaggacc

SEQ ID NO: 5238 - DNA, 340 bp, Homo sapiens; identical to SEQ ID NO: 325

SEQ ID NO: 5239 - DNA, 528 bp, Homo sapiens
aaaagaactggctggaatattcatcagcctactaatgtcatctcccaacccactctccaaactccatcccaaaaaagcatccagttcagaattgcccactgttggcaaagaaagaatgtcactaatttatttacaggtgagtattaacactttctgccaatgtgtattttaagcaattacatttagcaattacaattagattcttggcatcctcaagggttccatcatcttcaatctgtcctaagcctcagtttccccatctctaaaatgaggataatagtacctacatcataaggtggttctgagtattaagtaagatgatccatgtaaagcacttagcacaatgcctggcacataaaaacactcagtaaatattagctattattttgcatagatttatttacctggtttggaattttgaggatccacctcaaaagctgatctttgtaattttcctgaagcagggctcagaacagcccacttgataagagacagagtatgtgagtcttatcaaaggagtgaacccag

SEQ ID NO: 5240 - DNA, 443 bp, Homo sapiens
aaaaagttccatacccatcattcagcagcatgcctttttttccttactcaacagtgtttttgagattctgttgtataaatatattctaattttatttagccagtctcctgctgatggacagttaagcagcttccagttgttcactatcacaaacaatgctgcaatgggcatctgtgtatatggcttcctgggcgcagggaagccaccatgatgcctctctgggcaccaaactgctggatcggaaggtctggtggatattactaaaccataccccaacaccaccaccaccaaacttctgcctctgtctttaatacaagttgagagactggatgggctccagggtgaagtgagaggttcttcaaggtgaactgtttctgcatccagtgccaggtctcctgtctcaaactgcaggggtgcaggcagaagcggggagctatgcccag

SEQ ID NO: 5241 - DNA, 529 bp, Homo sapiens; identical to SEQ ID NO: 241
  misc_feature (1)...(529): n = g, a, c or t

SEQ ID NO: 5242 - DNA, 544 bp, Homo sapiens
  misc_feature (1)...(544): n = g, a, c or t
gttttcatactgctgtggtttgaatgttccctncaacactcatgttgagacttaatccctaatgtggcaatactgaaaggtggggcctttganatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagggagaatggcgtcaacccgggaggcggaggttgcagtgagccaggattgtgcgactgcactccagcctgggtgacagggtgaaacgccatctcaaaaaataaaaattaaaaaaataaaaaaagaacctggatctcaatttaatttttcatattcttgcaatgaaatggacttgaggaagctaagatcatagctngaaatacagataattccacagcacatctctagcaaatttagcctattcctattctctagcctattccttaccacctgnaatcttga

SEQ ID NO: 5243 - DNA, 589 bp, Homo sapiens
  misc_feature (1)...(589): n = g, a, c or t
aaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagctaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgngtcttacttgatttattcttt

SEQ ID NO: 5244 - DNA, 498 bp, Homo sapiens
atagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttatttttcaaaaaaaa

SEQ ID NO: 5245 - DNA, 482 bp, Homo sapiens; identical to SEQ ID NO: 395

SEQ ID NO: 5246 - DNA, 440 bp, Homo sapiens; identical to SEQ ID NO: 242

SEQ ID NO: 5247 - DNA, 265 bp, Homo sapiens
  misc_feature (1)...(265): n = g, a, c or t
ctggcctnaggagggagtaagagccccatccntgaaggtacacaagttgnggcancaaccatctggcctgcagtttccanaggggantcangcgtggggtgggactggagtgaacgggtngatgcttncacatgcggnagttggcactgacggcaggaacacggnggtggcttaatgggtcctggggctcccctntggccctcangaaggcaggagcntgaggggcttgggatgcagcacctgcaaatttgnncgttcctggcct

SEQ ID NO: 5248 - DNA, 167 bp, Homo sapiens
  misc_feature (1)...(167): n = g, a, c or t
cttttttttttttttttttttttttttttttttncggataaaataagtttttatttatagtcttatagtaaagggggaanccttaacttgcaananaattnttcggcagtntgtncaacatactttttatttccatggaanggaatcaaacncnaactganactaca

SEQ ID NO: 5249 - DNA, 438 bp, Homo sapiens
gtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgccatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtgg

SEQ ID NO: 5250 - DNA, 345 bp, Homo sapiens; identical to SEQ ID NO: 243
  misc_feature (1)...(345): n = g, a, c or t

SEQ ID NO: 5251 - DNA, 368 bp, Homo sapiens; identical to SEQ ID NO: 244
  misc_feature (1)...(368): n = g, a, c or t

SEQ ID NO: 5252 - DNA, 304 bp, Homo sapiens
  misc_feature (1)...(304): n = g, a, c or t
aaaagagaagggttgaaaaagattgtgtgtgtgtgtgtgtgtgtgtgtttaattggcccagggttacttaaataaatcataaccattttgccacattctgtaactgtttagctaaggtcaaattaagtttaccctatggattttgtttnatcttttgtttcgtgtatatactgtttgcctttttcataaaaatcttggatttgttatatattgttcctgttatttttgacatctttgctattgtaaataaattactattttgttttaagtgaaaaaaanaaaaaaaaaaaaaaaaanaaagctt

SEQ ID NO: 5253 - DNA, 272 bp, Homo sapiens
ctggcctcaggagggagtaagagccccatccctgaaggtacacaagttgtggcagcaaccatctggcctgcagtttccagaggggagtcaggcgtggggtgggactggagtgaacgggtagatgcttccacatgcggcagttggcactgacggcaggaacacgggggtggcttaatgggtcctggggctcccctctggccctcaggaaggcaggagcatgaggggcttgggatgcagcacctgcaaatttgcacgttcctggcctcaggagg

SEQ ID NO: 5254 - DNA, 191 bp, Homo sapiens
  misc_feature (1)...(191): n = g, a, c or t
caccttgaaggcccaagggaatcccgttatcagctctgatcctgagataatccctctgacttcctcccagaagccaagactctccagaactggctggttgtcctttgcagatntgttgaggcancaagtnantaggaagagaatatnaatatatacagntntggtcaccaaacatggattttgcctcttgg

SEQ ID NO: 5255 - DNA, 156 bp, Homo sapiens
  misc_feature (1)...(156): n = g, a, c or t
tttacantcncatgttcattgtgncactcttcacaatcactgtttccaaagttatggaaacaacccaaatttccattgaaaaataaatggacaaagaaaatgtgcatatacgtacaatgggatattattcagcctaaaaaaagggggaatcctgtt

SEQ ID NO: 5256 - DNA, 448 bp, Homo sapiens; identical to SEQ ID NO: 396

SEQ ID NO: 5257 - DNA, 577 bp, Homo sapiens
  misc_feature (1)...(577): n = g, a, c or t
aaagaatatgtagaatctaggtaagtggataaaaggtctgggggcaggggaaaggagagcatttcattgtgaatcaaggaatttctccacctgttttaactcttccatatgacatcaaagagatgtcacttgcagctagcatttcagtgatgttttcttactaataatatcgtgataaaagaaacattgactataagaaataggaatgggtctcataaaaggaaacagcaaaacccccaaactaaaaaacagcgcaggctgtttctctcttctctccttttgcttggcactcatgagatgctaggtgtggaagtcagccaactgaaaaagagaggtggctgaagaaggtggggaggctgaagccagttaaataggatggtccaattcacagacggcgaggctacagtgcaaataggactctttcaacttgagcaggaccccattacttcactggagttagaaagaaaggagagcgtagactttttgaactttctatnaagagtgtacctccacagtatacagaagacgacgtgaaatttgatctgcaagaaaactgagtccatattcacatatgtat

SEQ ID NO: 5258 - DNA, 525 bp, Homo sapiens
cttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgtattaccttcagcatcaaagggatggtccacatcagaaaactcactaaatgtcatgttagaatcccacatgga

SEQ ID NO: 5259 - DNA, 562 bp, Homo sapiens
  misc_feature (1)...(562): n = g, a, c or t
ccacacacagaaggaaagttgatccccagggcagcctttcccaccaaaaaaatcaggcccaatccaggagagtttgccagtagctccccagggttccagggtgtctgccagccttcctaggaatcgtgggcaggcttctaggtgccagtgactcaaactcctttttccacttcccagttcaacctggtcactctcatccccacaagttcccaatctgaatcccattctctgaccattctctgcttccttgtttttaatctcatttgagagtgatcctcacgggttcccctggcccctgcactcattttccttactgggtatgctaacgtttgtcttctaattcaggaaatccttccaaccctgttttcagctctgcctccaaacccttccatttccccatttcacctcccagtctcctcactcctggagcaaagagctctgcacttggattgctaagcatgcatggntcatgtggagcaggggagtgggaagatgtccctcanggcagaaagcctgcttttggtggggaacctacgtatnattcaaacaggcttagctgtag

SEQ ID NO: 5260 - DNA, 422 bp, Homo sapiens
ccaccaaggctatcgatgagtacatgaagctcgtggcacgggattacctccaggagaccctgggtgagctgggggagagtccatgtcagcggcctgctggtgagctaggggacctgggtgaagttctaagagtccttgagcaacctggattctggtagtgagtggtgttttgggggtgctaggatcctggggacaattgggagctccccaagatgttgggtgcctctggaataacctgaagacaaggttggaggatgggtgtggcaggttttggtggtcatggccccagcccctatctggctgtgctgggctgcaggacaggttgtgcggcgtctctgtgcttctactgaggactgtgaagtggaccccagcaaatgtccagcctcggagctgccagagcaccaggccagacttcggaacag

SEQ ID NO: 5261 - DNA, 573 bp, Homo sapiens; identical to SEQ ID NO: 245

SEQ ID NO: 5262 - DNA, 426 bp, Homo sapiens
  misc_feature (1)...(426): n = g, a, c or t
ctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttnaagcagatctgagcagcttcnagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcag

SEQ ID NO: 5263 - DNA, 354 bp, Homo sapiens
aggtctgagggaggggtcagggtgggtgcgcggtgacggggagggcaaaggtggtgtcagtatcttcattttgaggattggggttcagagcacttctggggtgtcagctcctccttgtccccccgtggggctccgtaggactggaaagaggacatgaagagctctgacagagagcagcagaaactctggaactgtttccagagggcctgcactgcatggaccagggccaccaccttctccttcacccaggccagaaccccgtgccaccaggtctgcagccgctgcagcatggcctggaaccatctcatgaccttgtcacaaaagctctccccaggctcctcggttgcgggatcc

SEQ ID NO: 5264 - DNA, 268 bp, Homo sapiens
ctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttt

SEQ ID NO: 5265 - DNA, 342 bp, Homo sapiens
ttgataaaaccccagggccacagcagaggcaaagggcatctggggagagggttcgaagctgtggcggactccactaatgtaaccctccaatgtcaagccatgggcgtgatcagtagctaagtgatgacaaggctgttgggggtggacggaaaagacttggggcaaagcagactgtttatagcctgagctggtagggcctggtgcagcagcctacccggaactggcactactctttcccaggttccctgactctctatcctggtctctgagagcgtgccctacttccgtttcccccactccaaacacacctgaggcatcttccagtgctaggccccatgctgg

SEQ ID NO: 5266 - DNA, 450 bp, Homo sapiens
  misc_feature (1)...(450): n = g, a, c or t
ccgaggtccaannttttccntgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactattt

SEQ ID NO: 5267 - DNA, 421 bp, Homo sapiens
ctgctgaagctcaactcccttttcgagcaggtgtggaagccctgaggcttctctgacatagcatgtgtttattttcttaggtgagacctgattcaggaaagtctgcagccgatatccatcttcaagtttgtggtcctttctccctctatatatccttgacctcagcagtcatgctggggtccagagtggatgattctctccgccttaggtagactcctccttaagagtgtaagtctctcagtctcacatattttgtgagacgtaaactgacattccacaaggagaggaggaaattctgtgggtcacatccaggggtgcttggaacctgattggttgtcaatcctccagttagtttgtcacgagtggaattctgtcctggattcccaaggatcaaggctgccccattagccaggaaataggg

SEQ ID NO: 5268 - DNA, 250 bp, Homo sapiens
  misc_feature (1)...(250): n = g, a, c or t
ctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctacatatgctagaactctacctgtgtttcattagtattatctaatgtacttttacatatttgtaaaaacaatttttggtaaaatgtgatgaanatggatttcac

SEQ ID NO: 5269 - DNA, 395 bp, Homo sapiens
aaatgaaatggggttgaagtgaacatgattttgttgaccatgttcgtgaattacagatgcaatatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgttt

SEQ ID NO: 5270 - DNA, 340 bp, Homo sapiens; identical to SEQ ID NO: 325

SEQ ID NO: 5271 - DNA, 425 bp, Homo sapiens; identical to SEQ ID NO: 246

SEQ ID NO: 5272 - DNA, 593 bp, Homo sapiens; identical to SEQ ID NO: 247

SEQ ID NO: 5273 - DNA, 453 bp, Homo sapiens; identical to SEQ ID NO: 248
  misc_feature (1)...(453): n = g, a, c or t

SEQ ID NO: 5274 - DNA, 504 bp, Homo sapiens; identical to SEQ ID NO: 400

SEQ ID NO: 5275 - DNA, 303 bp, Homo sapiens; identical to SEQ ID NO: 580

SEQ ID NO: 5276 - DNA, 363 bp, Homo sapiens; identical to SEQ ID NO: 581
  misc_feature (1)...(363): n = g, a, c or t

SEQ ID NO: 5277 - DNA, 584 bp, Homo sapiens; identical to SEQ ID NO: 582
  misc_feature (1)...(584): n = g, a, c or t

SEQ ID NO: 5278 - DNA, 591 bp, Homo sapiens
ctgttccctgaatggcttccctgggttatgtagaaacagcctggggaggaggtgatacaacatacttaatggggcctctgggcagaaaacagactgaatcctcaacactgccccttttgagggtctgtgatcctggaacttctctgatggactgggatgcccttaactgaggtctgctgtctggaaaggacaccacaggcccagaatgaaggggcatctggaccaatgacctagattcaacacagggcttggagctggtggtacaggctggttttggcccaatgtgtgctggaggctggaagcccctgaagacctaaactgcctggatgagcttattagggtgaattaatgagtctgtaatttgggaaccttaatgtgagacaccacttaaggagaggaacttggcccagcaattgatcactctagaagtggacagctatgcactagactgcaccagaatctgttcaacagcgacaccttgtggtaaaaactgtagacgccccatcaggctggatgggaaactagaaacagactgtctcatctttggacagatatccctcaaatctcccaatctactccagggaaaagaca

SEQ ID NO: 5279 - DNA, 365 bp, Homo sapiens
ctgtacaatactttggtgttaacctgtggtcttccttcacctcagtgaactctgccctgcccatctgtccagaggaagtcttagctcctaccccccaccctccctggcgcttggatgggaggcgacacagtatgggattgtgaaatccctgctgcgatgctgggtatctggaaggggagaagggggtggaagcagcgcagggaatgctgtgagatgagaagagctcacatcgatgggaaatggccctggcccaggctccagaatgtgacagcaacagtggcctggctgttttcccggggggcggggggcgggactggcaaactgggaggagaggcaattaagacgcaacaatcaaaccaaccttt

SEQ ID NO: 5280 - DNA, 553 bp, Homo sapiens
  misc_feature (1)...(553): n = g, a, c or t
ccacaactgtgaagttagaaaagccctgtcaaagcaagagatggctagtgcttcatccagccaaagaggtcgaagtggttctagaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagangtgacagggaagctacaggttacaacagatttgtgaactcagccaagcacagtggtggcagggcct

SEQ ID NO: 5281 - DNA, 577 bp, Homo sapiens
ccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatct

SEQ ID NO: 5282 - DNA, 70 bp, Homo sapiens
  misc_feature (1)...(70): n = g, a, c or t
agaanctgcnaaagtnggngggagcgccccnggagaacaaacagcaagccttatttcccctagcccatcc

SEQ ID NO: 5283 - DNA, 484 bp, Homo sapiens
ccacattcattttgaagtaacctttccagccctggtggaaatccagtcggtctttctttaccgcctctgcctgtagatacttggcaatatgcttagggcagcggcggtttagggtacgctgcgagtcaaaataggtgatggtgcgtcgcctcacatcaacagagatgagggaccaatgcacctccaggtggatggggattagcagtagctccttattgaagatgtccacgtttttggtccaccttttcaccccatcataacccttggtacggagtttatcatagaagaaactattgaagaaatgcaccttttcagggactgtgtccatgaccaggtctccatacatgttcatcacctggtcattgagccagttctgtccatacaaggtccccaagtcatccatggtcagcacatgccgcttataagccactcggaagcccctcaccatggcattgcctggcatccgctggtaagactggatcag

SEQ ID NO: 5284 - DNA, 298 bp, Homo sapiens
  misc_feature (1)...(298): n = g, a, c or t
gcaagggaggacagtggatgacagggaagatgagtgggggcagagctgctcaggaccatggctgaggccatcacctatgcagatctgangtttgtgaangctnccctgaagaagagcatctncagccggttaggacaggacccgggggctgatgatgatggggaaatcacctacgagaatgttcaagtgcccgcagtcctaggggtgccctcaagcttggcttcttctgtactaggggacaaagcagcngtcaagtcggagcagccaactgcgtcctggagagccgtgacgtcaccag

SEQ ID NO: 5285 - DNA, 439 bp, Homo sapiens
ctgccgctcatccaccatcagtgactttgtgctgttatcattcatgtgcaccttgacgacgagcttcttaaccttggcctccttcagtttttccagcgccagcttaattttatcagccttggcttgggcttcttcctcttcctgagagagaggttcaggaggtggtggtggcagtggaaggtctaacacaggatcggctggtggaggtggtaagtcatcctcatattggctgataccagtggcagcaacatttgttccataaccaagagaggctgcaccactgaaaattgatgcttgtagagatgctgaatgatgttgattctgcaaggactctttctgtgcctggattgtcctctgctcagcctcacttatgtctgctaccagatctgccatgagagcatctaaatcttggtcttccagtgcatttaaggactcattt

SEQ ID NO: 5286 - DNA, 257 bp, Homo sapiens
  misc_feature (1)...(257): n = g, a, c or t
ccaaaaacaatnanggtcataaccatccatgcagacntggaggctcggctnaaccangactcctcactgnctacctgananaatgancncccctnatccatctcagcatcaacacaatttncaggggnnctcaggtctacctcaggactgaacgccncacctcangattcctcctccttgaatctgagactggctgcccattctgagatggggatgaangtaagatgccgcatcaccaggcncgccgcccctgacag

SEQ ID NO: 5287 - DNA, 496 bp, Homo sapiens
ccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctgg

SEQ ID NO: 5288 - DNA, 628 bp, Homo sapiens
  misc_feature (1)...(628): n = g, a, c or t
cctcagggcctcttctggaaaatgaagaaattcaactagtagattcctgaggtccccctagcttaaaaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccagaggagccctattccactctggttttaggctgatctgagagggtctccctttgctcctttctggagcatttctctaacgtttattacaattaggagggggaccccacatctgngagattctgtttcatttgaggnttac

SEQ ID NO: 5289 - DNA, 611 bp, Homo sapiens
ctggacacagacacttccccagccccagggccagagtggggctggagggaaggacagggctacagtagtagtgggggtatatgagggaaggctgcaaggatgtggtagctggagttttgagagatggataagagttttccaaggaggcaaaagtggcagaaaagctttgcaggtgaggaggagcagcagaagcttaacctgcatgagaatccctctcaccagtcagaaagttgaccctgcacagccaaggggtaagctctgaccattttgcaggggacagaactgagacccagagagggaaaggaacttgcccactgtcacactgcatggaaggggcaaaactgtaggctccaatacttgggctcttaacctccttactctgagccttctcacgcttggcatgctgttccctctgccaggaatgcctttccttcccttgattgcgtgaaaagttcctgccaggtttggtgtcatccctttgtgccccttgtagggtgaggacagaaagggtcccattggacaggtgggaaaactgaagccctaggacactcagataccattagggtggactgggaccccagcctttcctgccccctttcaggatcccaaag

SEQ ID NO: 5290 - DNA, 597 bp, Homo sapiens
  misc_feature (1)...(597): n = g, a, c or t
ccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgnggtgatgctagaaatgactcctgaacttggacatgtctacacctgccttgtcgatcactccagcctgctga

SEQ ID NO: 5291 - DNA, 590 bp, Homo sapiens
  misc_feature (1)...(590): n = g, a, c or t
aaaggatttattttccagcagtcctgaggggcaaggacaggacaggagggagaaggagatcccaggacgcttgagggccccgttcatgggcagtaggcagattcgtccttctagtgcctgtggcaggcaggttgaccctgggttcgggagggacacaggccctggatgacactgagctggatgcctaggcagtgtcactccccacactttcaacctgagccccacagcaagcctataaggtgaacattctcactgtgatttgtcaggctgggttcagggagtgaaatggcctcctccaattccacaggttcaaataccctgcagagcggcaccagcctccctcagaaaggaccagacacttgtaacatttatgtcctttacctgggacactgctgtcccatacttgctgtatgaaaagaatatttctcaagaggaagaggaagccaggcgcagtgactcacgcctgtaatcccagcactttgggaggctgagccaggaggatcgnttgagcccaggagtttgagaccagcctgggtaacatggcaaaaccccgtctctacaaaaatcagccagaaaggcatagatagacc

SEQ ID NO: 5292 - DNA, 369 bp, Homo sapiens
ctgcaggaggcgctctgagtcagcctggaggaggcaggacttgctggtggacaccacctcaaagcagaaccgcctttctgagtcagggtagagtttcactgtgcagagacgaaggtcatccaccaccacagtcacagggtccttgtacttcttctggtaaaccagttggttgctctgaatggtgaaccagcgtctgctccaggtcttaaatgcgttgctggcccgtttgaagagatgtccttccatcaccaggccaccaggcccctctcttaagcttggttctggctcctccccacccagctccttctgtttcagcagcacgtgtctctgctccatgcccctcttctctcgtgctgaattcaagaccag

SEQ ID NO: 5293 - DNA, 608 bp, Homo sapiens; identical to SEQ ID NO: 249

SEQ ID NO: 5294 - DNA, 333 bp, Homo sapiens
  misc_feature (1)...(333): n = g, a, c or t
ccagtacanatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgatgttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttct

SEQ ID NO: 5295 - DNA, 345 bp, Homo sapiens; identical to SEQ ID NO: 4886

SEQ ID NO: 5296 - DNA, 581 bp, Homo sapiens; identical to SEQ ID NO: 654
  misc_feature (1)...(581): n = g, a, c or t

SEQ ID NO: 5297 - DNA, 574 bp, Homo sapiens
ctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatattt

SEQ ID NO: 5298 - DNA, 547 bp, Homo sapiens; identical to SEQ ID NO: 583
  misc_feature (1)...(547): n = g, a, c or t

SEQ ID NO: 5299 - DNA, 531 bp, Homo sapiens
aaaattatttcttgaatctctccatacacaggcaaaaataagtgtgttacttaacatactggaaattgcctaacttaatcattgcctaaagaagagaaaattatccccaaaacgtgcttaaccaggaggccaatgcatttgccgacctccaagaacatggagatgaacgtgatagacagactgtccaccatctgaaccttcattcaccaccattcgataacccttattcaggcccagatcagcagcacatttcttgccaacaatcattaagtgtccaagaagactttcatcatcatcttctgccacagaaatctgggatatatgtttcttgggtatcaccagaaaatgtgttggtgcttgaggggaaatgtcatggaaagcaaggcaccggtcatcctcaaaaatgattttggctggtatttccttgcggatgatcttcccaaagatcgtgtcgccaccaggccgagcgacctgagccttggcaatctcatctgccatctcggcctctctcccgcgcggcggccagaggag

SEQ ID NO: 5300 - DNA, 246 bp, Homo sapiens
ctgagctggggatactcaggtcctggggtgctgaggagatggggctgcatctggagagggtgctgttggggtgtactctcatctggagagggtgctgttggggtgtactctcatctggagaaggtgctgttggggtgtactctcatctggagagggtgctgttgggggcactcccatctggagagggtgctgttggggtgtactcctgggaaggcaggggccatagaggagcgggagatgtgtcag

SEQ ID NO: 5301 - DNA, 410 bp, Homo sapiens
cctttgaccaggttcacgaagttctccaccgacttggcaatggttgggtgctctgcagcacattccatcaggattgactccaggagctgcatgtactgctcgtcgcctcggcccccttctacctcgtggtccagcttcaggatgatttcgttttcaaactttttgaaatccccacttctttgatattcacacagcatcatgtcgaagaagattggtatggtggctttccggagctcagcctcagggataagtgtcatctctaatataggtcctaccatgcctgggatgaagcagattttgttctgaccaagcttgtaccacatatcacggatggagaagccaattagccgtctcatgtccccatacttattcaggattttgttgtatttggcgtgtgagaactgctccag

SEQ ID NO: 5302 - DNA, 424 bp, Homo sapiens
  misc_feature (1)...(424): n = g, a, c or t
tacaagcttttttttttttttttttttttttttttgntttttttttttggatctcttaaagggaatttattgcttccatgganattttanatcgatgttactgaggaattaggtagctgggcggcttaccccaggcatntnttantaggtaacacctganaaaagaaaaaaaaatcaggaggtcagggaaagaattcaaaggcatttgngagctntgaggggatacanaagcttaanaaaaaaaagcaganaaaaggtaanagganaaacatttgcagganaaaaagggtntgataaatcgggccananaatagngctaggtcatgtagcaagtccactcttccgctgctgtaaatggngatgcaccttccttttcaggatgggattcacaagggcccttggtgtctggaagcnccaactgaac

SEQ ID NO: 5303 - DNA, 263 bp, Homo sapiens
cctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtcttt

SEQ ID NO: 5304 - DNA, 606 bp, Homo sapiens
  misc_feature (1)...(606): n = g, a, c or t
ccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaaggtgaggcgaaggacaaagccggaggtggaggaagtggtgtgggagctcagggcagaagccatacctccaggcaggagaggaggctgggcctgggttcggatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaangtcatggggcaactccagagagaagcatcccctggcccggtgggaagcccagacgaggaggacggggaaccggattacgtg

SEQ ID NO: 5305 - DNA, 536 bp, Homo sapiens
ccagggccacaacttcttctgtcgtggggaagagggatgaaaagacaagaccagggctggagctggggtggaagaggggagggggacactggctgcattcccccgcccccaggaagcacctctaggccctggacccctcgctcaccctggcccctaagactccatctcttctctgcctctggccctcctggctcttcctcctgctccccttgactttttcccctgacagattctcaagtaggacgatgttcagggcctgaccccaaccccccataccaccttatgaaggtacaacctttaccggccctgcttctgcccctcctcaaacctcaccgctttccctctttgggacagctctgatccccctccttcctctcctccctccccctggaaaaaaaaaaggaaaagaaagcaccaactccccggggaggggctgcagacagcagggggagaggactggaaggagagaagaggaccgtcgagggaagaggctcacaagtccctgggaagacagggcatgggcttacagagaggag

SEQ ID NO: 5306 - DNA, 400 bp, Homo sapiens; identical to SEQ ID NO: 250

SEQ ID NO: 5307 - DNA, 493 bp, Homo sapiens
ccagggatcagtctcatggccgtagaagcagccaaattcctctgcctttgccttcccttcaggagtcacatgctaaggcatccttgggcatttggaaaaggccgcttggggtgagagtgctctaggccactctgcaatgtccctgggcccgatgagtaacaaatgcaccccgggacccagagaagtggaaagacatgaaagggatttggaaacagatcgtaaaaataacctgtatgaaaatcacacagacaagaaaacaaacaaatccagctagccccttggatcctgccatccgtcttttctcccgggactgcctttgctttgtggagggtgagtcctgggacaggctttgggtgacaagttgtgggcatgttccatccaagcctggctctcccgactggcagagggaggtggctgacaatcaattcctctggatacattttcctgtgattgctcctgtgatcaaaggcagccaccgacaggtgcgggagcg

SEQ ID NO: 5308 - DNA, 393 bp, Homo sapiens; identical to SEQ ID NO: 251

SEQ ID NO: 5309 - DNA, 361 bp, Homo sapiens; identical to SEQ ID NO: 5108

SEQ ID NO: 5310 - DNA, 620 bp, Homo sapiens
ctgagggaggggtcagggtgggtgcgcggtgacggggagggcaaaggtggtgtcagtatcttcattttgaggattggggttcagagcacttctggggtgtcagctcctccttgtccccccgtggggctccgtaggactggaaagaggacatgaagagctctgacagagagcagcagaaactctggaactgtttccagagggcctgcactgcatggaccagggccaccaccttctccttcacccaggccagaaccccgtgccaccaggtctgcagccgctgcagcatggcctggaaccatctcatgaccttgtcacaaaagctctccccaggctcctcggttgcgggatcctcaacatccgggacaggggatctgttgcctcggcaccgtaatccatctctttctttttcaagtagaggagtgagctctgggtgctgctcctcataataagccgccactgtctccaggtagccctctttgaagtcgtcctccagctctgccaggctcgacatcacctgtccacgtcctgattctgcattttgcattttatcataaaatctttctatggcctggtgcattcgggccttcagcttcttcatgtcatcagagaggaccttcggg

SEQ ID NO: 5311 - DNA, 514 bp, Homo sapiens
  misc_feature (1)...(514): n = g, a, c or t
ttttttttttttttttttttttttttttttttattttttttttttttttgctttcatgtttattaaanaanatcnctaaanatnttgactnganaatgctgngngctntttcaattacatttgtttttcttttattaacaggaattttgattnttcaaggaagnggctcaatttcaatttcaggngaccaggtttatcgggacttttccttnttgnttacttttcnctaggaaggggagttgtaggggcanattcaggttttggaataggaaaattacntntaaaccatggaaatcttggaaatggaattggnggaagtgggcnaaatggatntgggtaagggaacncaaaaaaccctgaagctaattcatcgctggcactgatacttcttttttctcgttcctggncttgananactgggaaaccaacagccnctgccaanatggctgngatcaggagganaactttnttnatntcaaacgtttcantcagttaccttgggcgggaacacgct

SEQ ID NO: 5312 - DNA, 588 bp, Homo sapiens; identical to SEQ ID NO: 402

SEQ ID NO: 5313 - DNA, 571 bp, Homo sapiens
  misc_feature (1)...(571): n = g, a, c or t
aaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgnggctggaatg

SEQ ID NO: 5314 - DNA, 637 bp, Homo sapiens
  misc_feature (1)...(697): n = g, a, c or t
atcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacagacatcagaaaaaagaagcacataatgcttttggtgcgatggcactcactgngaacatgtgtaaccacat

SEQ ID NO: 5315 - DNA, 255 bp, Homo sapiens
ctgcatggtgagctgcagagtggtcagaggggctggggccctgccaagagagcaaggccagacctgcccagcgggaggcaggaaggccctgatccagcaaggagaagtagaggaagtccacagccacctctgttactcatcgctactgggacatctggggacaggctctgttcttgggagagcaggccaccaggatttgtagggctgcctgccggtgacagacacgtaagtcacagggagaggccgggatccagg

SEQ ID NO: 5316 - DNA, 108 bp, Homo sapiens
  misc_feature (1)...(108): n = g, a, c or t
ccctggcnaactgctcangattacaggattatggaaaggcaaagtatatacagtaatgtgagagaaactcaaaccaagtaagggtaaaaatgaaatgattaacaccac

SEQ ID NO: 5317 - DNA, 546 bp, Homo sapiens
ctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcacctggggtccaaatgcaggcgattcctgaggacgtcatccctgaggagagtggcgatgaggacgaagacgaccctgacaagcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttct

SEQ ID NO: 5318 - DNA, 425 bp, Homo sapiens; identical to SEQ ID NO: 252

SEQ ID NO: 5319 - DNA, 459 bp, Homo sapiens
ctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtctttt

SEQ ID NO: 5320 - DNA, 603 bp, Homo sapiens; identical to SEQ ID NO: 404
  misc_feature (1)...(603): n = g, a, c or t

SEQ ID NO: 5321 - DNA, 603 bp, Homo sapiens; identical to SEQ ID NO: 253

SEQ ID NO: 5322 - DNA, 397 bp, Homo sapiens
gaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcattt

SEQ ID NO: 5323 - DNA, 595 bp, Homo sapiens; identical to SEQ ID NO: 587

SEQ ID NO: 5324 - DNA, 444 bp, Homo sapiens
ctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacag

SEQ ID NO: 5325 - DNA, 386 bp, Homo sapiens
ctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaa

SEQ ID NO: 5326 - DNA, 272 bp, Homo sapiens
  misc_feature (1)...(272): n = g, a, c or t
cacacattcaccgttggcctgcctctgttcaccctccatggccctgntactggccctcagcctgctggttctntggacttccccagccccaactctgagtggcancaatnatgctgaagactgctgcctgtctgtgacccanaaacccatccctgggtacatngtgaggaacttccactaccttctcatcaangatggctgcngggtgcctgctgtagtgttcaccacactgaggggccgccngctctgtgcncccccagaccagccctggg

SEQ ID NO: 5327 - DNA, 307 bp, Homo sapiens
aaatattttttacacagatttgatgctgtgcaaatgccctctccccttttaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatattt

SEQ ID NO: 5328 - DNA, 600 bp, Homo sapiens
ctgtgcttttcacatcaagttggcttagttcttggaggaaagtcttagtgactaaaattgtacacagatcacaagacaagagaactagtctaacaaattcaataagaaatcaggacaactgtagactatataaaaactgtcttagaaaattatttacaactttatcatagtgtaaatactctaaatgtaaaataaatctatggattttatacaaaaatactctaaagtacaaatgtaagttaaatgctgaataaaacattttcaccttttccagtggatgctattactaagactataatctaggtgtcaaaacttaaagtgataaccacaaagcaatgttttcttaatcactcataattttacatttgttagtagtcatcacaaggtttagagttccactgaaaaagtctcatttttacaaatgcaactcatgcactttccttcatggaccctttctctgtttaacacatgttaaaaaagtaaaacaaaattcttagtcaaaagttgacatgctatgtgaagcatataaattgtaaaattatcagtcttaaatacctagttgattctctttacaaaagaaacagtcatgtaatacatcag

SEQ ID NO: 5329 - DNA, 232 bp, Homo sapiens
aaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaaccataaaaaaaaaaaaaaaaaaa

SEQ ID NO: 5330 - DNA, 442 bp, Homo sapiens
  misc_feature (1)...(442): n = g, a, c or t
acaagctttttttttttttttttttttttttttttttgattcttcagctaaaacagcggaanaggngatttattatatggttgttacactcggccacaaataaacacanaaatagtccanaatgtcacaggtccagggcanaggaccaacatgggcattttgtttatgancaaggngggtctcanaggngatcggcgatcanagggcgatgaagttctanatccattganacaagctntanacagtantntgcagtcccacaacttgtaccagcatccccagcgtntggcattccatgtttctgctcctgnggcctccacggngcaacaagctagcggtttacttggacctntgccnnatctttcttcttttgcgcttcancctgcncattcgcttcttcctccacttggctntcatggnncanaggtttccaaaaaaatgg

SEQ ID NO: 5331 - DNA, 114 bp, Homo sapiens
  misc_feature (1)...(114): n = g, a, c or t
ctttttttttttttttttttttttttttttttcgggngcaaanattcactttatttattcattctcctccaacattancataattaaanccaaggaggaggaggggggtgaggt

SEQ ID NO: 5332 - DNA, 483 bp, Homo sapiens
  misc_feature (1)...(483): n = g, a, c or t
aaatctttgcctttnanatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtg

SEQ ID NO: 5333 - DNA, 319 bp, Homo sapiens
ccaagggtctctggtcacagtgccgaggtgggcctggcttttccacagtggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcag

SEQ ID NO: 5334 - DNA, 593 bp, Homo sapiens
ccacttttttttttctgtaaacctcaaatgaaacagaatctcacagatgtggggtccccctcctaattgtaataaacgttagagaaatgctccagaaaggaacaaagggagaccctctcagatcagcctaaaaccagagtggaatagggctcctctgggcggtttaagggcacagaaaggaccctcagctactcctggcctccccgggtctctttcccagaagacacaactttccaggctgccaaaagtaatagaagtcaaaaccctcaaaaccaccactgctctcgggaagtttttgagtaggatgaggaagaaagaagagagccctccttcattttgttacacgatctcaaggccaagagcaagtagaagatgtctaaagagaacaaaagaggtttcttcctggtactgtactacagatcagcaacagtttcgcagggaggcgttggctcaggttctggtacatttgaagataactgaaggccaagacttagccaaggaaggacaccagcagaacaactagatacactatcactactgcgagtgttagaatcatggggcagatttttttttttttaagctagggggacctc

SEQ ID NO: 5335 - DNA, 568 bp, Homo sapiens; identical to SEQ ID NO: 255

SEQ ID NO: 5336 - DNA, 485 bp, Homo sapiens; identical to SEQ ID NO: 254

SEQ ID NO: 5337 - DNA, 546 bp, Homo sapiens
ctggaactgaagcctgggtggactatggagccctggttgggacccccagggagtcaaaggctgcgggccaagaggccagaggtccttgagcctgggtgggcaggtggatctagggtgcatgacttgctgcttcccaaccttagtttgtcccttctgtgaaaaagggagagaaggaggaggaagatctcaaaaagactttccagcccagtgcggtggctcacgcctgtaatcccagcactttgggaggccgatgcaggtggatcacctgaggtaggagttcaagaccagcctgaccaacatagtgaagccccttctctactaaaaatacaaaattagctgggcgtggtggcatgtgcctgtactcccagctacttgggaggctgaggcaggagaatcgcttgaacctgggaggcggaggttgtagtgagctgagatcacaccactgcacaccagcctgggcgacaagagcgaaactccgtctcaaaaaaaaaaaaaaaaactgttgcagccccgttgagcctttgacaccgcctgaaatccacccca

SEQ ID NO: 5338 - DNA, 578 bp, Homo sapiens; identical to SEQ ID NO: 406

SEQ ID NO: 5339 - DNA, 475 bp, Homo sapiens; identical to SEQ ID NO: 4646

SEQ ID NO: 5340 - DNA, 450 bp, Homo sapiens
cgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcag

SEQ ID NO: 5341 - DNA, 293 bp, Homo sapiens
cctacagcattccatcagtgtctttgcatcccaagtgtctgctttactgccacaaaggagctgatccagttcctccgggtagaagtactgaagatgactgagtgggaagactgattcaaatccatctctgaacgaatcaaattgcctagaaacgccttcatttagtgcccagaatataaccagtcttagatactcctctaaattgtggatagtgactggtatatccttccctcctttcttcagttcgatattgggaaaccctggcagagtgaaatccagtcctagatcttcaa

SEQ ID NO: 5342 - DNA, 525 bp, Homo sapiens
  misc_feature (1)...(525): n = g, a, c or t
ctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggnttatgtaaagaaagtgtactgatgttcttacattaaagctttacaaagattta

SEQ ID NO: 5343 - DNA, 429 bp, Homo sapiens
  misc_feature (1)...(429): n = g, a, c or t
tcaaccccaacttcgtggcgcgtatgatacctaaagtggagtggtcggcgttcctggaggcggccgataacttgcgtctgatccaggtgccgaaagggccggttganggatatgaggagaattaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgcgtatttttgttgatctataccctgtttccgaattctgccgtgtgtatccccaacccttgacccaatgacaccaaacacagtgtttttgagctcggtattatatatttttttctcattaaaggttt

SEQ ID NO: 5344 - DNA, 125 bp, Homo sapiens; identical to SEQ ID NO: 408
  misc_feature (1)...(125): n = g, a, c or t

SEQ ID NO: 5345 - DNA, 637 bp, Homo sapiens
cctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagg

SEQ ID NO: 5346 - DNA, 412 bp, Homo sapiens
ctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttctttttcctttattgccaatctttgaactcattcaactccaggacatggaagagg

SEQ ID NO: 5347 - DNA, 518 bp, Homo sapiens; identical to SEQ ID NO: 256

SEQ ID NO: 5348 - DNA, 440 bp, Homo sapiens
  misc_feature (1)...(440): n = g, a, c or t
tgcaaatggttctgctgaaacatctgccttggacacagggttctcgctcaacctttcagagctgagagaatatacagagggtctcacggaagccaaggaagacgatgatggggaccatagttcccttcagtctggtcagtccgttatctccctgctgagctcagaagaattaaanaaactcatcgaggangtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccangaagggactattcagaagggcaatgaggttctttccatcaacggcaagtctctcaaggggaccacgcaccatgatgccttgg

SEQ ID NO: 5349 - DNA, 272 bp, Homo sapiens; identical to SEQ ID NO: 5253

SEQ ID NO: 5350 - DNA, 533 bp, Homo sapiens
aaaattctaagtatgcatgcaatctgtaaaaattccaatttaggatagctaaattcattacatttttttttttgcttatattaccttactattttacctgtctccttgttattaatagcaagacatatgttccttttagaaatgtttgattctcttatttgcttagaaatagaattcaatgagtgattaatgtacaccatgattcagaaaaacaaatgcaaatttccatacattaactctacacataatggcttgcaatattttatctaaaacattcattttattttccaattcttaaagatagtttttgctataggtggcatctctgtgaacgcagagctctaaattaaaactgccaaagcaacaaaagatataatatattgggactttataagctaagaaacataaatacaggcgggaaaaagcatagcttatgtagattgctgctgggttaaatgaatatgaattcacactaaaattgtcaatcagctacacatctctcaccaaatcattctttttggtcgtgcataatt

SEQ ID NO: 5351 - DNA, 387 bp, Homo sapiens
ttgttttatcactggacaagaaatgtattaggtttgatatttacaaagatgtttatgttgtctgctattttctattataggtttattcaaagagaatatcacctatagcataaataattaaatttttcaataaaaacaaactaaaaaaaccctagaaacatttgacatcaccaaattcaacagctctcactagaaatccaagcaataaacttagatatttgaaataaacataaattatgattatataactctaagtcacatacataattttgaattatggtaatagcactgtaaacatgaatacaaaggattacagttttatacagaattttttttgtttttcttcttttaggcttatttctccttgaaagaacagaatgatctttt

SEQ ID NO: 5352 - DNA, 440 bp, Homo sapiens
  misc_feature (1)...(440): n = g, a, c or t
aaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagagatggtnnacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtattt

SEQ ID NO: 5353 - DNA, 306 bp, Homo sapiens
aaatacaagtataattttggaaggggtatttgacaaattcagcattaactgccaactctatagacatgttttaacaaaaagcaaaacaaaacaaaacaaaaaaacaaaacaaggcatttactcttggccctttcagtacaggcgaagtgttctattgcatcacaagtgctagtgatgcagtaacagatccaagggcataatattaaatatgtttttttccaactgcgatttagttgaaaaataacataatacaaacatatattaatggctatcaagaccagcagtgatctgcagaatacctagagg

SEQ ID NO: 5354 - DNA, 347 bp, Homo sapiens
cctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgtgttttttttaaggtaaacattactacttgtaactttttttcttagtcatatttgaaaaagtagaaaattgagttacaatttgattttttttccaaagatgtctgttaaatctgttgtgcttttatatgaatatttgttttttatagttt

SEQ ID NO: 5355 - DNA, 603 bp, Homo sapiens
  misc_feature (1)...(603): n = g, a, c or t
aaactagtaatanaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgnaatatatcctgtttgtatttttttccaagtgtataatgttgggtgtggagttttcatgacagaatatacacattttgtaaatctgtact

SEQ ID NO: 5356 - DNA, 444 bp, Homo sapiens
aaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacatgttctatatctatggtgtgtcagatcttcactcggattattcgatgacactcagtgtgagagtccatacatggagctccctgtggcccgtgtgctctcgtgtgactgaacgttttgtgatgaaaggaggagaggctgtctgcctttatgaggagccagtgtctgaattgctgaggagatgtgggaat

SEQ ID NO: 5357 - DNA, 332 bp, Homo sapiens; identical to SEQ ID NO: 4110

SEQ ID NO: 5358 - DNA, 640 bp, Homo sapiens
  misc_feature (1)...(640): n = g, a, c or t
ccaacatggtgaaaccccatctctactaaaaatacaaaaattagccgggcatggtggcagttgcctgtaatcccagctactcaggaggctgaggcaggagaatcgcttgaacctgggaggcggagatttgcagtgagccgagatcacgccattgtactccagcctgggcaacagagagagactcagtctcaaaaaaataaaaattaaaaagtaagcatgtcttattgtttatttttccccagtgctaaaaatgactattttgaaacaatgctgatagagtttacagttcaatttttactttgaggtactaattttgcatttggccggatgctcttaaaaattaaaaagtagacatgtcacctagtaatatgcctattttaattttctaagaagttttgttaaaaattctattaaaatatacatatcctagttaccaatcacattcatacagagaaaatgaacattaaacatattactgtacaaacaatttggacttcagttccagctttggagtcccctccattctattaattagggtgataaacatggcatttagcagggaattaactgtggataccagcacatgcctaagatctaaacaactgaaaaagtattnaagagttctactttggagcagagt

SEQ ID NO: 5359 - DNA, 562 bp, Homo sapiens; identical to SEQ ID NO: 346

SEQ ID NO: 5360 - DNA, 416 bp, Homo sapiens
cctagtatgaggagcgttatggagtggaagtgaaatcacatggctaggccggaggtcattaggagggctgagagggcccctgttaggggtcatgggctgggttttactatatgataggcatgtgattggtgggtcattatgtgttgtcgtgcaggtagaggcttactagaagtgtgaaaacgtaggcttggattaaggcgacagcgatttctaggatagtcagtagaattagaattgtgaagatgataagtgtagagggaaggttaatggttgatattgctagggtggcgcttccaattaggtgcatgagtaggtggcctgcagtaatgttagcggttaggcgtacggccagggctattggttgaatgagtaggctgatggtttcgataataactagtatggggataaggggtgta

SEQ ID NO: 5361 - DNA, 287 bp, Homo sapiens
aaatctttaatcctttgattaagcagcaagcatatcactcttccaggccaaacactgcttaaacaaaaaagaaaaataatgacgtgcaaaatatttacaaaatatgcaaagcacacaataaagacatctcactatatacatgtgtcatattactaatgaagctaacgtttttctactgtgtgctctaatgcatgtaaatcaaattacagcacatccctcagatacagcaccttggcccatgtctgggatagaagagattttttaatgaatcacaatatactgaacag

SEQ ID NO: 5362 - DNA, 334 bp, Homo sapiens
cctggcctcttcagagtaccccccattccactttccctgcctccttccttaaatagctgacaatcaaattcatgctatggtgtgaaagactacctttgacttggtattataagctggagttatatatgtatttgaaaacagagtaaatacttaagaggccaaatagatgaatggaagaattttaggaactgtgagagggggacaaggtggagctttcctggccctgggaggaagctggctgtggtagcgtagcgctctctctctctgtctgtggcaggaggcaaagagtagggtgtaattgagtgaaggaatcctgggtagagaccattctcag

SEQ ID NO: 5363 - DNA, 420 bp, Homo sapiens; identical to SEQ ID NO: 644
  misc_feature (1)...(420): n = g, a, c or t

SEQ ID NO: 5364 - DNA, 452 bp, Homo sapiens
  misc_feature (1)...(452): n = g, a, c or t
aaaaatctatttatttatcaaaacagtattggcacagtaattctcatattatcatcaaataataaaattgctactttctgtactcaattctttagaatcctanaaattgcaaatgcattcaatttaacaatattgtaaataacaatacaaaagaaagaactctgcatatttatggaaacattgttgatggtacagttctactgaaactcatacacatttcactatttaatttacatatggtcttgttgaaaaaaaccagtatgttttactttttcaatttccttatgctaaaatacatgtaattctaaaggatatctcttaggtgttataaaaaccaaggaaggtccaccaccaagtcaaagttagagtcaaagatacttcaaagattccatgaaatgatctgaaaacaaatttaaccaaaaaatgtgtactgtattggggcacatccatgg

SEQ ID NO: 5365 - DNA, 549 bp, Homo sapiens
ccacagaagttgctgctgacgctctgggtgaagaatggaagggttatgtggtccgaatcagtggcgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggacctcg

SEQ ID NO: 5366 - DNA, 471 bp, Homo sapiens
atcactaagtcaagttctttacttcccagaagtgatggctaaggggagggaggagggtgagaagaggaagacagaaagagccagagagaatgaggaggtgagaagggggggacagtaaaccactgttctatgaagtctcacgaggcaagtgctcaaggtaaaaaaagagtcctggagaatcgtccacggctgcgggaagcatctcggtttccttctgcttttaagtcctctcagggaaggctgtcgccgctaccgctgcattaaatagttatgtacatcgcagagagtcccaggccatgggcaggtgggggaggggcgtcatttcaccaggggccgagttttatcatcgtcaccgcactggtgagctttgtactttttcacttctgccatgtacttggcccacgcgtcacctttacttgttaatacctcatcctccgtcttctgcttcttggctactattcccgtcttgag

SEQ ID NO: 5367 - DNA, 152 bp, Homo sapiens
ccaattgaaacaaacagttctgagaccgttcttccaccactgattaagagtggggtggcaggtattagggataatattcatttagccttctgagccttctgggcagacttggtgaccttgccagctccagcagccttcttgtccactgcttt

SEQ ID NO: 5368 - DNA, 574 bp, Homo sapiens
aaagaaaaaggtgtttatttaggccatcaactaggatcataataaataacgtaatatactaatgtaataacagatcttctcatgcatttatcgtgtttataaatatagaagaaagctggcttacagggctgttgggacaaatttggaaaagtgtatttggcaattacacagtaaaagttaacagtgttgactatcagattctcttttctgtcagtttttagaatacatcccctatacatctgtgaataaatggtaatggtctcttagagtttctactttttgtgaacatgccagagttaagtaaattgtcaaaggatccaggttgacaatgtgttatttgtcaatatttctaatgaaaaacagatcttagaaaaatgaactcttctgcatttcattgtagaggctgatatattacaagccggaatcattcaaacaataaaaaaagtgcctcaatgaaataaaacccaaaagtagtttatcaatagtaactgtgatacttaatatacaaatgctgtagtattgcgtttgtaatttggtaagtaaatgaccaagtatctgaatgcaaaagtgatga

SEQ ID NO: 5369 - DNA, 446 bp, Homo sapiens
  misc_feature (1)...(446): n = g, a, c or t
aaacaagttttttttagtgtttgtacacaatttgtcaatttttcaatattcaattttctgtacaggtacttttgggacaattcttatagttacataatgtgaattcatcaaaatgcagttaagaaacttacaggaatatatacacttgaacccaagacccaaacctgacattatatacaacctatttacaaatacatatggacagacaatatatgtacatagattatcataaatattgaaaaataggttagctttaatggattaatgttgttctataaataacattacagttgtaactgaaacatccacggaagacagtaatgcaaaatgaggtgacaagacagtggttttaatactgaagactgctcattaatgtgaggaagctcctccaatcctctggctatttaangttcaaaatcaagtgcctagggaaaattccaatggat

SEQ ID NO: 5370 - DNA, 565 bp, Homo sapiens; identical to SEQ ID NO: 204

SEQ ID NO: 5371 - DNA, 367 bp, Homo sapiens
aaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggttaaggttgtctggtaataaggtggagtgggtttggg

SEQ ID NO: 5372 - DNA, 519 bp, Homo sapiens
ctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatg

SEQ ID NO: 5373 - DNA, 205 bp, Homo sapiens
ctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaataaagttaaactttt

SEQ ID NO: 5374 - DNA, 332 bp, Homo sapiens; identical to SEQ ID NO: 4110

SEQ ID NO: 5375 - DNA, 90 bp, Homo sapiens
  misc_feature (1)...(90): n = g, a, c or t
aaataactcnctnaaccctgcccattaagatcacggtaaacatacaataatttttattatggaaattaatctttacatacaaaatcagct

SEQ ID NO: 5376 - DNA, 408 bp, Homo sapiens
  misc_feature (1)...(408): n = g, a, c or t
ctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcanaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcag

SEQ ID NO: 5377 - DNA, 238 bp, Homo sapiens
  misc_feature (1)...(238): n = g, a, c or t
acaagcttttttttttttttttttttttttctanaaaaatttaacaggtttatttataattattataaagttgaaccgntaaaacttgttcactgaaacatttnaacttgcattaatgctttacgtntccgcatttatattaaaaattcacacacaaatgaaaatggaaaaactgccaatacctgatttctgtcccctatttttccactcgcaatcatatacttaggtaccttttggc

SEQ ID NO: 5378 - DNA, 342 bp, Homo sapiens
ctgctgatacccaggcagtagctgatgctgtcacccaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttgg

SEQ ID NO: 5379 - DNA, 397 bp, Homo sapiens
  misc_feature (1)...(397): n = g, a, c or t
gaaaagccttgtaaatgcctatattgtgggcttttaacgtatttaagggaccacttaagacgagattagatgggctcttctggatttgttcctcatttgtcacaggtgtcttgtgattgaaaatcatganngaagtgaaatngcattgaatttcaagggaatttagtatgtaaatcgtgccttanaaacacatctgttgtcttttctgtgtttggtcgatattaataatggcaaaatttttgcctatctagtatcttcaaattgtagtctttgtaacaaccaaatnacctttngtggtcactgnnnaattaatatttggnagacagaatccatgtacctttgctaaggttagaatgaataatntattgtatttttaatttgaatgtttgtgcttttt

SEQ ID NO: 5380 - DNA, 314 bp, Homo sapiens; identical to SEQ ID NO: 3212

SEQ ID NO: 5381 - DNA, 332 bp, Homo sapiens; identical to SEQ ID NO: 347

SEQ ID NO: 5382 - DNA, 330 bp, Homo sapiens
caaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgacaaaaaaaaaaaaaaaaaaaaaaaagcttgta

SEQ ID NO: 5383 - DNA, 570 bp, Homo sapiens
cttttgtaaagagaatcaactaggtatttaagactgataattttacaatttatatgcttcacatagcatgtcaacttttgactgagaattttgttttactttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaa

SEQ ID NO: 5384 - DNA, 356 bp, Homo sapiens
caagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcattt

SEQ ID NO: 5385 - DNA, 397 bp, Homo sapiens
  misc_feature (1)...(397): n = g, a, c or t
ctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattanngtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagattt

SEQ ID NO: 5386 - DNA, 314 bp, Homo sapiens
  misc_feature (1)...(314): n = g, a, c or t
gaaagtggtggnnntgatctttttatttagaaacccacaaaancnnaaacacagtnnaaataaaacagaaatcaaactataagttgacttttanttcctaanaagaaacatatnncaaaagcaagtggaatctanaattcttataacatgaataacaaaatgtacagcaagcctatgtagntcaattaatatataaggaaaaggaaggtctttcttcatgatacaagcattataaagtttttactgtagtantcaattaatggatatttncttgttaataaaattttgtgtcataatttacaaattagttcttt

SEQ ID NO: 5387 - DNA, 499 bp, Homo sapiens
  misc_feature (1)...(499): n = g, a, c or t
aaaagttgtattcgtctcnnattcaaaatattatcacacaggtgatttatcttaaaaatccatgtgagtactgacctatatgtcattttttgcaaatctaaaacaaaaatatttcaaaatgttcagtggcagagagtactggtaccacaaaatcagagcagtagaagcaaaggggatataagatgtggacattttgtagcttgaggagatggcacctagggaaaagagaattaagtgtttatttgggaaaatgttaatgatatacacagaacataggagctggaataaagaaggcatgcttaggttatagcaaggtatactcctggcctaaaatatcaccatctttctctgcatgcctgggacaaagtaagaatgggggcagaaaaaaagggaagactgagaacacagagcacttagtctacttattagcaaaaataaagtgagattttctaaaatcaggtataatgtcatctgcctctccaaaaaactgttctttttg

SEQ ID NO: 5388 - DNA, 570 bp, Homo sapiens
ctgtagctttttcattcagaaactggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattgtatcagtacttcccctgttaagataactgagtgccacctagtgttcaatttctgcaactactaagcttacaaattcaatactgctattaaaacccaggttctgaaaacggcattttggaaatctttttttttttttttttatgtttacggtggcaaaatacgactatgaaaagaacatgatatcaaaatcagtataaaaatagccacaggctacttaaatatgacaaacagact

SEQ ID NO: 5389 - DNA, 453 bp, Homo sapiens
tttttttttttttggtgggttttggggatgtttaccctattgttttttatttggatgccctaaggcatataaagcgcatagtgaattacctactggaatgtaaatggttctaaaattaaaactgttaaaatagaaagagggaaaaggaaggcccaagaactcttaaagagaggctgagaacaagaacaaaaaaacccagaagtgtaggtaatacataacagcgcagacagaaccgttgtaggccatgtataataaataatgcatgccccaaatttcagttaatcatataatttcaacttgagttctaatactggaaccagccaaccacttgggcttcaacactgtactagatgtcagtagaatcgcttgatggaattacagccttgttacagttgagatcaagagagggtgcttttttttttccttcttttattaaagctatcattccaggct

SEQ ID NO: 5390 - DNA, 520 bp, Homo sapiens
aaattggctttgcccgcttcagtagtcacaggtagctacctgaccgagaagccgacttgggaattactgttacttgtgggtgatactgtcataaaggggttgaaagtacttgttagctgtatatgtcagaattgattaaagagaaccaactattcttgtgcaagggatggtattgtagttaattatgacatttggagaaactaatttctgtctgtcgacactatctctgttccatttagacttagagacttacatgggcaatgcttgactttttgcattcagcacagaaagttaagtaatccactgtggtaaaatattaactaaatttatatgacttcttgactgctgtaagtagagaatatttatcatataagcaccattttcctgaattttttgttactgcatattttatcttactgtcactattgtgtaaaatctttgaaaggaaaatgaatactgtgtaatagttaaacccattcataggttgcaatagagtgtcagccaaatgtgtcatacatca

SEQ ID NO: 5391 - DNA, 519 bp, Homo sapiens
ctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcatt

SEQ ID NO: 5392 - DNA, 522 bp, Homo sapiens
  misc_feature (1)...(522): n = g, a, c or t
caagctttttttttttttttttttttttttttttnattcaatttcctttaatgagtacttgttacagtaaaagaggtataaagtcctgttcccaagtccaaaccactttttaacttaaatnttgagtttttctgaattactcaatttgaagtaattctntttatatctgaaaaanggttttattgaaacgttngaaattaaaaaatatgcattgcaagaagcatatgacaaacattntganagtncaaaattagttgtaaaaaataacatantttaccagtaaacccactcatatanaaatgngcaaagccttttgatataaaaagttttgtacaccaagcacctatttttataacttancttcccatgganagataanggctngcgtgcattttatgtatccataacatacatacaaggctcggtcttttcaatgggataacagttcacaactcttcgatttgaattgnaatgaatctggngacaaggattttnntntaatggattccaaagttagccana

SEQ ID NO: 5393 - DNA, 336 bp, Homo sapiens
ctgtgttatttgatttcttgcttttcggagctccttaagaattacaagcaattgatgctgcacatgttgacggtcgagtttttcattttcaaagtctaaagtacatgcctgcatctgttgttccaacagagctacccttgtttgttcttcttgctgctttagcagagatgtgtaaagaaactggacctgagataagagctcttcggatctcttcttctcttcttcaagttttcccctagcaatatcattctcttccctgagtttttgtatcttctctgttttatgcctatcatcttccagatgttgcacatctgcccttctttgtgaatacaacag

SEQ ID NO: 5394 - DNA, 275 bp, Homo sapiens
aaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgcctttttaacaaaacattttcagtatttt

SEQ ID NO: 5395 - DNA, 168 bp, Homo sapiens
ctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtactttt

SEQ ID NO: 5396 - DNA, 126 bp, Homo sapiens; identical to SEQ ID NO: 348
  misc_feature (1)...(126): n = g, a, c or t

SEQ ID NO: 5397 - DNA, 469 bp, Homo sapiens
cctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggcgataaaattattcaggctaatggctacagttttataaatattgaacatggacaggcagtgtccttgctaaaaactttccagaatacagttgaactcatcattgtacgagaagtttcctcataagcactgtggacaaaaaaagcgggga

SEQ ID NO: 5398 - DNA, 408 bp, Homo sapiens
  misc_feature (1)...(408): n = g, a, c or t
atcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcanatataaagagaattacttcaaattgagtaattcagaaaaactcaagatttaagttaaaaagtggtttggacttgggaacaggactttatacctcttttactgtaacaagtactcattaaaggaaattgaatgat

SEQ ID NO: 5399 - DNA, 307 bp, Homo sapiens
ctgagggtctccgcaggaacaccatcacccggcatgactgccaagtcccaggtctgtctggaagccagcgggaggatcagcatcctgccccctttggtccatcctgtgggctgtggggaccaggcccctgctactcaaggccaaggtaggaaacagtctttcctgttttcttcagggttgcaagcagagtgtccatgctgtgctcagattcaatgcagaccttcttgttgggcaggtcaatgtcatacttaactccggcatgactgaggcagcggcggtgtggcggcggtgtggcggcggtgtcagc

SEQ ID NO: 5400 - DNA, 350 bp, Homo sapiens
ccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcattttt

SEQ ID NO: 5401 - DNA, 620 bp, Homo sapiens
  misc_feature (1)...(620): n = g, a, c or t
agaatggcaacngacaccaagtactttgtagagattgacttcctaagctacttaagacaacttgcatcactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgttttaggtaataagaaatattaagtaattggctttagattttgtaatttttttnccctgagtttcctgctagatttcgnattctagtagtcaatgtattttcagtgaaatgcaaaaatattcccattatcttttgaccagtattaatttttgagatcttactgcttgtcacttgaatcccgtgattgtcatacatctctggtataagcaacatttgatttttgaagtgtgtagaccatctcttcatattttncagatgtaattttacatttctgcatt

SEQ ID NO: 5402 - DNA, 408 bp, Homo sapiens
aaacttaaggaaagagtgggaaagtgagggcaaaataatcctatggtgaaaaaaatcaacaagataatctctgcttgagaaaaaggaccaaagacaagtgaattttctgagggtgatgaaagtgttgcttcgaaaaggggcgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacct

SEQ ID NO: 5403 - DNA, 314 bp, Homo sapiens; identical to SEQ ID NO: 3212

SEQ ID NO: 5404 - DNA, 147 bp, Homo sapiens
agaatcattttgttctttactaacaataatttgaaaattggtaatttaatatcttgtgaatatgaaaatattatggtatagattagcttctaggagaagttaagtgtagcatgatttcttgaagattaaaaaaacatttaacttttt

SEQ ID NO: 5405 - DNA, 524 bp, Homo sapiens
ccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtg

SEQ ID NO: 5406 - DNA, 526 bp, Homo sapiens
ccacagaagttgctgctgacgctctgggtgaagaatggaagggttatgtggtccgaatcagtggtgggaacgacaaacaaggtttccccatgaagcagggtgtcttgacccacggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcaga

SEQ ID NO: 5407 - DNA, 349 bp, Homo sapiens
aaagagtaaactgaaaaattatgaaggatttttcccagtaatgcatagccttcattaattatttttttaataaataaactagtttagcattttttttttttaaccctacaaaatgctactattcatcatgtcttatttaaggtagccttttattctgattaattaagatacatctttaagggttattctggtggtaagaacatttatcttgacttatgtttaatttttttaatgctttggcagatgaagtaacgtttgaaaactgtttgtgaaaatagtatgagactggaaagattacgtcgtggtaaaagtttcacagttttccaggtatttccttatactgaagagg

SEQ ID NO: 5408 - DNA, 201 bp, Homo sapiens
cctagcctccattttatttatttgttctgcaaattcgatgcgtctaccttcaaataaagcgttcatttttctctgtgactcttctattagtttttgggtagctggacacattcttccaggaatataaaacaaatggggctttgtcttagttcttatatatttaattattttggcattatgttcattccattcttcttgcag

SEQ ID NO: 5409 - DNA, 246 bp, Homo sapiens
aaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcagg

SEQ ID NO: 5410 - DNA, 307 bp, Homo sapiens
  misc_feature (1)...(307): n = g, a, c or t
aaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgngtaaataaaactgcttagcattgtacagaaacttttattaaaattgtttaatgtttagaaaaaaaaaaaaa

SEQ ID NO: 5411 - DNA, 331 bp, Homo sapiens
aaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagttttactgtagtagtcaattaatggatatttccttgttaataaaattttgtgtcataatttacaaattagttcttt

SEQ ID NO: 5412 - DNA, 251 bp, Homo sapiens; identical to SEQ ID NO: 4543

SEQ ID NO: 5413 - DNA, 128 bp, Homo sapiens
  misc_feature (1)...(128): n = g, a, c or t
aaaatggttgaanngaattcaaagaataataatattttgggacatgttaaaattatgtgaaattcaaatttcagcatccataaataaagttttattgaaacacagccaaaaaaaaaaaaaaaaaaaaa

SEQ ID NO: 5414 - DNA, 533 bp, Homo sapiens
  misc_feature (1)...(533): n = g, a, c or t
ctggcctnncatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaatggcaaattcaataaactcaaatttaaaataatttttaaattaacagttatgataaattttatattttatacaaatagattgcttagaatggtttctcaagaattataagagaaatgaactcacagtacaaaaattttataattactatacttgtgttttgttttgggggcttgggaaatgtatttttacattgnngccaatcattttatatttgtc

SEQ ID NO: 5415 - DNA, 563 bp, Homo sapiens
aaaaaaagaaaaataaaataaagtgttttgattatttagggctgacttacatttcagtatgtgacaaaaattcaaacccaaatgcatctagctcactcagtttcagacaggtcctatgttcagcccctaaacgaatggcacaatgccaccaattttgggattcctgagtttggttcccttaagttctcagagttttcccaactctcaaaaccaaagcatcatgggagtgacagggccactggcaagactttttgccagtcagcctagttcttcttttaagatgcagtagtctcaaagcttaaagtcagaaaatcttgcaatacaagagtaactgcaagaacatataaagaaggaaaagaaaggacggggtttctagttgctaagatttgccaaacatggctacaaaactggtaaacaaacctttcttgagtgcaaagtccattagcccaacttgccatgaagagatttgaaataaaaatgaacaaatcaatttctgttgtagatacaaagcgaaaaaataaaattcaatcaatatattgaatttctctgagtttatcactaga

SEQ ID NO: 5416 - DNA, 292 bp, Homo sapiens
aaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgttt

SEQ ID NO: 5417 - DNA, 309 bp, Homo sapiens
ctgctgctgccgttgaccatcctgaactctgggggagaggaggagtcagcctggcttgcagacggccgacccagaacatggctgtctgtggtcatttccttccttcacacccagtgggatgggcacagagcccagccttggtctcaccagctcccccaccctcctctgcatcagcatccagctcacacagctctccagaagaatttgatcttagctgcagccttggggtacatcactctacacccagtctcttccctgcgcttctttcaaccaacagaagcaaacatcaaaagcacccacacctactgg

SEQ ID NO: 5418 - DNA, 388 bp, Homo sapiens
agcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaatgtaattt

SEQ ID NO: 5419 - DNA, 344 bp, Homo sapiens
  misc_feature (1)...(344): n = g, a, c or t
tttttttatctttaacctgggactttatttgtacaactaagacatttgtntaaaacaaacagaaaatgaaagaagcnttaagccatgggagagtagaaatgggagctgagaaacttaagagtanaaatgggagctgagganatgaagtgaactcctatcctcaaacccgcaagttcccggccccaaaggaagccctcanagactgatatgccttctgggaactggacagcccctctcancaagcctcattcccaacctgcacctggcctctntgcgaggaaggncagccccagcctgggaagaccaannagggagccagcccancntcaccccatnaaagaccc

SEQ ID NO: 5420 - DNA, 458 bp, Homo sapiens
  misc_feature (1)...(458): n = g, a, c or t
ctgccatcttganaacagttttctgagagatttcccacacagttttataaagttgcttcaggtcatcaggaatttctggtatgctctgaatagagccattgcatgcaataatctggtttttcatctcttcatgccataggccccgctcggtaagatctttcaataagtgaggatttacaatctgaaattctcctgacaagactctgcgagtatagatgttgctggtgtaaggttcaatggactcattattccccaggatctgagcagtggaagctgtaggcatcggggcaataagtaaactgtttcttataccatactttgcaatcttctccttgagaaccttccagtcccatangtctgtaggagtaacattccacatatcatactgaagaattcctttgctaactggagagccctcataggtttcgtatgggccctgctccttggcaaggtcacag

SEQ ID NO: 5421 - DNA, 243 bp, Homo sapiens
  misc_feature (1)...(243): n = g, a, c or t
ctggatgggtccagacnaagtggaatccctggaacctttaactgagcagtgaaggtcagtgtctcanagcctgagagatgaacaggaccagagagagaggtgggcaggcaggcacaaggttatgtcttcctcagactcggaacccttgagatccttcctgaaggctgtgtacattctgtttatctgtgtcctgtatcactgcactcctgtgtgtacacctctgtttgcacatgcgtggcatgg

SEQ ID NO: 5422 - DNA, 548 bp, Homo sapiens
ctgtttcagaggaggggggaggaggtagcagatgtcaagggatttccatttctctttcgatgccgacatacttcagggcatcagcctggctgtatctgtaatcaaaaaacagctcttcgccagtctggatggctctcttggcaaaaatacctatcctgtgatcaccgttaaccatcataacttttgcatagcagtttggatttaccgaatgatttgcaaaacgaattttgttacccttgcgggttgcatccaccacaaaatcattgttcaagttgaacagaaagctgcacatgtatttatcatacactttccctcttctgtcagcttcatcttgagaaataatctctccacagtattctgagatgaattcatttttctgcacaggatctttgataaaaatcccccagcctgccacgtcagatggtgccagcaatagatgctttttggagccccgctgaatactgcagttcttgcaggacacatttttactgtcccaatggtcagcggctccacaagtaagacagaggtcagggtcacactctcggaca

SEQ ID NO: 5423 - DNA, 203 bp, Homo sapiens
ccagagggccctctacagggaagtgatgctggagaaccacagcagtgtggctggactaggattcctggttttcaagcctgagctgatctctcggctggagcagggagaagagccatgggtcctcgacctgcagggagcagaggggacagaggcaccaaggacctccaagacagattctacgattaggactgaaaatgagcagg

SEQ ID NO: 5424 - DNA, 513 bp, Homo sapiens
  misc_feature (1)...(513): n = g, a, c or t
aaagttcatatggnnccaaaaaagagcccacatcgccaangcaatcctaggccaaaagaacaaagctggaggcatcacactacctgacttcaaactatactacaaggctacagtaaccaaaacagcatggtaccggtaccaaaacagagatatagatcaatggaacagaacagagccccagaaataacgctgcatatctacaactatctgatctttgacaaacctgagaaaaaaaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaatgacttcatgtccaaaacaccaaaagcaatggcaacanaagacaaaattgacaaatgggatctaagtaaacta

SEQ ID NO: 5425 - DNA, 167 bp, Homo sapiens
aaagaaacaccaccaaaaggggattagcttagtccatcccttcctcagtcatctgcttcccaccttcctccaaatgttatcccagaacattctggaggcagggagaaggggaggcagctaatcagagtctgagagcacgatgatctcttctggatcgcattgtgtgg

SEQ ID NO: 5426 - DNA, 306 bp, Homo sapiens
  misc_feature (1)...(306): n = g, a, c or t
ctgaggagcggcgncgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctgg

SEQ ID NO: 5427 - DNA, 487 bp, Homo sapiens
ctggctcaagacctctcctttctcagagcctggcccaggccccccactgcctgcagctcccttccggacattttgggtggtcagtgtcgtcctgggagcccttcttggtcttctccttctgggcctcatggcttttctgattctgcctcgagtcacacaagccatgcagaggggtctgggaagatccgaggtatctcctggagaagccatctatgatgtcattggggaaatgccgctagcaggactgtacgaggaaatcatggaggccgaggctgtgctccaagatgaggaggacggaagtgtggtgaaggtggacacagaagccgcagtttcaggggaggtgtctaacctcctggagggacagtctatacgtgcggagggaggacacagcagacctgtttctcagggatatgacgaggctgcgtttcctctggaggagatgacgttgtaaagcaacctgaggatgagatacaccagacctcggccg

SEQ ID NO: 5428 - DNA, 312 bp, Homo sapiens
gatgtgatggtgtccaccttccacaagtactcgggcaaagagggtgacaagttcaagctcaacaagtcagagctaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccag

SEQ ID NO: 5429 - DNA, 292 bp, Homo sapiens
aaatttagcaataccatctcaaacctggagcaatcctggaacagttaccaggatcaccttttcccttcaatccttgtggcttctgggaatcttcagagcctgggtctgaaaggtgtttcctacatgtctcagggctggatgcaaacctggctggggacctgagcatcaactcccatttagaatcagacatctcccttccctgcaaatgtctacaactaccaaattgctccccaacagttagctcaatggattgaatttgcagaagccaactcctaaaatggggactgcctgg

SEQ ID NO: 5430 - DNA, 443 bp, Homo sapiens
  misc_feature (1)...(443): n = g, a, c or t
cctagtgcagctcgacgacgtttagtgcaatgttccgcggtctcttgcatacctggacgctactgtttctccaactcagtcacatagatcaggtggtcctcgggagacttgccgtgggtcttactaaggtgcagtttgactgcgtgcttgctcgcaaaagtccggttgcagagcttacattggaatgtggagcccaagtcttcctcggtggcccccagtgggcccagagttttgttggtgaggactttcgaaacattctgctgttcttgaatctgattgagtggcagcttggagagatccttcaggctgaagcccaagtgtgtctccaaatgacttatgtatgtagaagcagttctgaactgagaggcacaatcgttgcaaaaganaacaggatgccctgtgtccaggttctttaggaatttcgttccccctgtcctcctcaa

SEQ ID NO: 5431 - DNA, 342 bp, Homo sapiens
ctgcacaaaaacacttcagccaattctaacgcagagggagcatagacatggaggggctgggggttaggctgggggagaccagccttccctgctaagggctcgtggtccaagcccacaaccagagggtgctctgggtggtgtccaggaacatgcagtgccggctccggggaggagggacgagaagagaaaggggagtcacagaggaggctgcagatgagcacgagtttattggactctggcctcgcgctgctgcttgatgaagttgatgagcccattggtagaagcgtcgtgagaggtcacttgagcactgccatcaagctcaggctctattttcttagccag

SEQ ID NO: 5432 - DNA, 247 bp, Homo sapiens; identical to SEQ ID NO: 2922

SEQ ID NO: 5433 - DNA, 371 bp, Homo sapiens
  misc_feature (1)...(371): n = g, a, c or t
aaacatctgcctannntcccccattcctccaacacctagaatgtgctgaaactctattcctcttccaaagtgcatctcagcctcatgaagcttttactggtcctctttccggacagagttaaccttcacaccgagggattctaaacgttttctcaatcttggagtcatgggatattcacaatcaccctgtgagatactaaaggatggaaccagggctctaggggcagagccattttactaagctgacagagttggtgagtggcggtggctctgtattgactctgagctggttcccaagcctagcgcctttccactcggaccctggctcactgtccctgcagcgtctggctggatggtggtgttggtgtgtc

SEQ ID NO: 5434 - DNA, 313 bp, Homo sapiens
  misc_feature (1)...(313): n = g, a, c or t
ctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccanagggccaggaactcgtggtgactgtcactgctcggtgcctggcgctgtctcagccagtaanatgcgcatgttactgagggagattttancctcgnangacagcatcaccatcttgtnggtttgcacctttatata

SEQ ID NO: 5435 - DNA, 386 bp, Homo sapiens
ctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcattttt

SEQ ID NO: 5436 - DNA, 372 bp, Homo sapiens
cgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagggacgtggccgggaccctgagatggggggaaagccgagaaggaagaaccctcaggaagg

SEQ ID NO: 5437 - DNA, 407 bp, Homo sapiens
aaaatacattcaaataaaaagatataagttacttgcagtgaatgcacacatacaacagcagggagagctgagaacataattaaccaatactcttgtgttcagagaataaatagtctgaaaccgtgggactgaggcttgttccttaggggctttctcaaagtatccttggtggacataaggttaccctcactcaatggaaggacacatcttctgctgccggggaggacacagcatgacagtttcatttatatgggatgttttccttccataaatgtctggaacacggtgtcacaggacaccatggtgtacagtgcagccctcaaattagaataaataagtcacatggttggactggaatgccacagacacactatgactgaaactggaaggaacgagaatgtttattt

SEQ ID NO: 5438 - DNA, 332 bp, Homo sapiens
  misc_feature (1)...(332): n = g, a, c or t
tttttttttttttttttttttttaggacaggaagtagaatttattggtgagtattaagaggggggcagcacattggaagccctcatgagtgcagggcccgccacttgtccagagggccacgactggggatgtacttgaccccacagccatctgggatgagccgcttttcagccaccatgtcttcaaattcatcagcattgaacttggtgaagccccacttctttganatgtggatcttctggcggccaggaaacttgaacttggccctgcgcagggcctcaatcacatgctccttgttctgcagcttggtgcggatggacatgataacttgg

SEQ ID NO: 5439 - DNA, 428 bp, Homo sapiens
ctgtcaaacttggcctgggcctgctcccctccaatgccctggctgaagagcttggtgcagtcactctccagtgtcttcttcagagtggagatgttttcactgcagacttccacgttgttcagagtcaccaggaaggacatcttcgcctcgtcagtactctcgatgccttttgtgtcaaatttgccttgctggaggctgctgtgcatgatgttcacggcacttgtcaccccgcgctggatgtcctggaaggtggtggcaggaaagcccatccgcagcttattacacagaacatccctgaagtcagactccagctctgtggtggcgaggttgatcatggcacagagacagtcaatgctggagctggacagagcccgcccaatgcacttcttaacaatgtagaagacatcatccaccatgctggatgtcag

SEQ ID NO: 5440 - DNA, 360 bp, Homo sapiens
ccagaactgttacaaggccaccccttgcttcaagggaggttagagcagtgaatattcagcttctcctttctctactgtagaggtcagcgaggatgaagagagccagaaatgggcattgggtcagtcaagccatgcttctgacctgcaaagcctccatatcagacccaaaaattcacgagtaagtaagtaagagcttcaaagaacttctctccctcagccagggttaactataaaatgacccaaatatgcttaacagaccaaaaaaaaaaattggctaatgaatggaactatttacaactgtatttttgcaaatagaatcaaaagctagatattgaattaaatgaattgtttctacagttt

SEQ ID NO: 5441 - DNA, 333 bp, Homo sapiens
  misc_feature (1)...(333): n = g, a, c or t
aaaagaaatgcaaactgcanattatanagtgcagctacacatatatataatggggtggatagtttatagtgtgctcattgctgctttgttattattagngttgagagttcctgtgctgtgtggaattcaacactaatctgctgtaagtatggagctgggtatgtggaacatttgcagggaagtttgtttctncgcttgtttttccaggggtattcnagatgacattgnagaggaagatgaccaantgagttcctatgcagtatttctatcttttattttnatccacaaagnctatnctggggacaagctagagcttgccttcactcaaaatgg

SEQ ID NO: 5442 - DNA, 333 bp, Homo sapiens
cctgaggtgcacaagcccatcagtggaagatatgaggtgtttgaccaggtcactcaggagggcgctggacatgacccagcccctgagggccaagcagactatgatcccgtcactccatatgtcacggaagctgagtctgtggttggagagaacaccgtgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcag

SEQ ID NO: 5443 - DNA, 231 bp, Homo sapiens
  misc_feature (1)...(231): n = g, a, c or t
ctgcagaatagcaggtnagagggatcccagacttgaccaaatagccagaactggctacggttctgagaaatctatggaagcagtcttgctatgggcggcagaggagagtgaaaacagtcttcaaaatttaatcgtagaataattctatcaaattaagccctttattagagctgaaaaaattgagtttaagagcacagctagtttagcataaagtgcagattatacagtttt

SEQ ID NO: 5444 - DNA, 206 bp, Homo sapiens
gccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggagggagccggcctgctgggcagcgtgg

SEQ ID NO: 5445 - DNA, 384 bp, Homo sapiens
  misc_feature (1)...(384): n = g, a, c or t
aaaagatactttgnatncaattaagaagagtttttaagaaaaaagaggaaggttctggcatggggagctctgcaacccactgctgggtgccagaagcgagctgtggagcggaagatgaagatggcaccatgtgtctctaaaccacaaatggaaccactgatttctatgtgtatttgcatttgctgtaatgtgtgggaaatctgaaggttacacancacaactgtccacagcagatggccctcgaaggggatgaggtttagaaccaggcagggcctggaaggactggattttacatggacatgggggacattgcanaganaaaggcatccaaggtgttctnacgaaatccactacaattgtncaagaaaatgaanagctgtgatt

SEQ ID NO: 5446 - DNA, 557 bp, Homo sapiens
  misc_feature (1)...(557): n = g, a, c or t
aaaaaaggcattngaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagcatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaa

SEQ ID NO: 5447 - DNA, 496 bp, Homo sapiens
  misc_feature (1)...(496): n = g, a, c or t
aaaaaaggcatnngaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagcatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaa

SEQ ID NO: 5448 - DNA, 229 bp, Homo sapiens
ccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgagg

SEQ ID NO: 5449 - DNA, 137 bp, Homo sapiens
aaacactgttataaaatgtagccaaagctcacctttgaacagatcccggtgacattctatttccaggaaaatccggaacctgattttagttctgtgattttacactttttacatgtgagattggacagtttcagagg

SEQ ID NO: 5450 - DNA, 221 bp, Homo sapiens
ctgtctccacccaggaaaaggaaagccaggtacacttctcatcacagtaagactagcctaacaggggaaaacagatttacatgtttcgttcattagcatattagggaaggggaaaccttttgggctctggccccgtggttgggaaacccttcctaagagcatggagccacactctggccttgatacagtagatgggacttaacacactctgatgctcaagg

SEQ ID NO: 5451 - DNA, 234 bp, Homo sapiens
cctacagatgaaggccaaataatccccaaacagccctgtttgatcacagaactaccattcataggaaattgtatgtaaaaacacaggactgtttctgggggcttatccaataaagaaaacaaacaacaaaaaacaaaccccaaaggattagatcagctactgcctaagcagattccacgtggactatattatcaacatttaatgggaacaactattcaaagctcccactcattt

SEQ ID NO: 5452 - DNA, 492 bp, Homo sapiens
  misc_feature (1)...(492): n = g, a, c or t
ctggtacacggcagggtcagggttctggatatcaggtaaaacagtcaattgtgtcccagatccaaaggtcagttgccttgcagaaccagaagactccatgtcacccacgaggcagtagtacacagcagtgtcgctcagggaaacccggggcaggctcagagtgctggactttctgtcggcagggataaacagggaggccacttcgtttgtaacttttgtcttgtatccttgaataataaatcgtggtccttggctgggaaactgttggtaccacgtgatataatcatttgtagcaatgttgttgtggctacaggttatgttcacttcttgtccttcatatgagtccatggagatgggctgggtggtcttagcaaggctcaaagtactcagggtcaggaacacgatcactctcgccacttgcctcatattctaggtgcaaactaggacccaggttctaggctcttttgctgtgtctganctgcaatgagccca

SEQ ID NO: 5453 - DNA, 218 bp, Homo sapiens
  misc_feature (1)...(218): n = g, a, c or t
cctcttgaaaaaccttaatcacagttaantgatggcatgggcaatgaattttaatcatatttaggaataaaatactagatattagtgtataacaattagatatatgttaattgagcactacaaagcctgaaagcttaacaaagtggggctataactagtaattttttggtaaaaatatagtgatctttttctacagggtattattataagggacaaat

SEQ ID NO: 5454 - DNA, 271 bp, Homo sapiens
  misc_feature (1)...(271): n = g, a, c or t
aaatttaacagcgncctcttgaaaaaccttaatcacagttaagtgatggcatgggcaatgaattttaatcatatttaggaataaaatactagatattagtgtataacaattagatatatgttaattgagcactacaaagcctgaaagcttaacaaagtggggctataactagtaattttttggtaaaaatatagtgatctttttctacagggtattattataagggacaaattatacgttgtaaattagattaatgaattttgtgagtttt

SEQ ID NO: 5455 - DNA, 297 bp, Homo sapiens
aaatgactgtgctgcccctttcacatcaaagaactactgacaacgaaggccgcgcctgcctttcccatctgtctatctatctggctgacagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttgttcaaatgattttaattattggaatgcacaatttttttaatatgcaaataaaaagttt

SEQ ID NO: 5456 - DNA, 369 bp, Homo sapiens
aaaagtttttcttctgtaattgttgaacgggtgattattattaactctagataagcaggtactagaaaccaaaactcagaaaatgtttactgttagaattctattaaattttaagtgttgtattctttttcattgggtgatgtcagggtgataaccagacattcatggaaaggcatgcagtttgtccattgtgacagtttgtttaataaaaccacatacacactttatttaagattaaaatctaactggaaagtcagcttggaaaatggacatttccaagtatgtttggtgagtcacagatataaaaatagaaattctgatgagaggtttcagtttttaataccaagtccttaggagtcttaacattgg

SEQ ID NO: 5457 - DNA, 437 bp, Homo sapiens
  misc_feature (1)...(437): n = g, a, c or t
aaattgtatgnncncacaagttttggacatgtctgaagtaaaagctaaggtacagtcactggaccttattttgggtgcacttcaattatgactgtgactttagtggtgggttagtatggtttattgcaatgatgcttttttaagccctttaatacagatgatgggtaccatggatgccagatgaatacatatttcaactagtattttacattcattccaaaagtgcctattatatgccaggcactgtcctattccacaaggatatataacagtaaatgaaccagataaatccctgccaccgaggaacttacatgaccaccagttaaaatcaaaacaattggaagagtaatgtaagaataaggatggtaagaatcatcagactggtatacgccattaccagaagcacagantgagattataagcctgttagaacacag

SEQ ID NO: 5458 - DNA, 207 bp, Homo sapiens
ccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctgg

SEQ ID NO: 5459 - DNA, 390 bp, Homo sapiens
cctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaag

SEQ ID NO: 5460 - DNA, 610 bp, Homo sapiens
  misc_feature (1)...(610): n = g, a, c or t
aaatttgaacatgtactgtgacacttttgacacttttctgaagatttatcccgtttttctagcctttaaggtaatgctgaaggaatacatatactttaatatcaccttttttagaaacttaaaattgaatcaaaataatcagttttaaggaagctttttctcctccttccttttttgtagaggaaagaacacttgataaaaattagatttgttcttaaaaacacccatgattaccatcacattttcagcctgggagagattctcaaggaggtgatatagatcgcaatgatgtgatttatcaccctcaagaaaattcactaaaggctttttctccccaaagatcatattgaaagtaatcatttggagtaaattagaattattaactttaataagcttttatggaatcatgtactggatttactaattctcaaaatctttcactataaagatattttgttgaaacttactatttggcaaaagtttgcactgagcgttaactgctttcaacagtcttggcagattgagagtttgtggcagggaagagagggcactagtctcttcattaagattataaatttnataaaacaaaaaccaaatggagatctggaat

SEQ ID NO: 5461 - DNA, 314 bp, Homo sapiens
  misc_feature (1)...(314): n = g, a, c or t
tgaacataacctgtatccacaanaacattgctacaaatgatnatatcacgtggtaccaacagtttnccanccaaggaccacgatntattattcaaggatacaagacaaaagttacaaacgaagnggnctccctgtttatccctgccgacagaaagtccagcactctgagcctgccccgggtttccctgagcgacactgctgtgtactactgcctcgtgggtgacatggagtcttctggttctgcaangcaactgacctttggatctgggacacaattgactgttttacctgatatccagaaccctgaccctgcc

SEQ ID NO: 5462 - DNA, 236 bp, Homo sapiens
ctgggcttgccttggagacctgcccctgctcagttctgttcctgttctcctggccctgggtggcccctactcgtcctctgtggtggatgtcagcatccctttgtcgatcagatgagaccgcagcgtgttgaagatgtggagctgctgatctggccgtaaagtcaggaactgctgaatcagtttgcttgggttagggcctctgataaaactggcgatgtatacattgacaaaggtgg

SEQ ID NO: 5463 - DNA, 292 bp, Homo sapiens
ccagcagccaggagggaggtaggctgatgtgatgggatgggatcttgccctgggttggtctcatggtgcagaagagcagtgttggaatcattctaatgcttcaggatgcctcatgtgccccatggagctcagacatcaggaggtgctgggactctatttagccgttcgatgatgcggttgttgtccaggaggtcagatgccggcagcttcatcccctcgcagagctcttgcatgtggagaagcaggccctttcgtgtagggctggggtaaggagctatgggaggcggcgagg

SEQ ID NO: 5464 - DNA, 284 bp, Homo sapiens
ctgagacccctgccctgtgagcccttctatccccacaagttgtcaggacaatcccttgtggttagggggaggggcggggagagagctctatttctcagccagtgccgagctaccctccctcctgggctgtgatttcatttgtgcaatgggggtgtgcaggagtcactagcttctcggggcctgtcccgcacatacacgcacttatgcgacatccagacatttgctacattttccaagggcttggcctctcccctccagcctccagaagggagggcaggacacag

SEQ ID NO: 5465 - DNA, 427 bp, Homo sapiens
ctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcac

SEQ ID NO: 5466 - DNA, 167 bp, Homo sapiens; identical to SEQ ID NO: 3712

SEQ ID NO: 5467 - DNA, 236 bp, Homo sapiens; identical to SEQ ID NO: 3713

SEQ ID NO: 5468 - DNA, 326 bp, Homo sapiens
ctggctgataagaagggcctccatgttgtggaaatccgggaggaatgtggccctctgcccattgtggttgcgtccccccgggggcccttgaggaaggatccagagccagaagatgaggttccagacgtcaaactgactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatcttt

SEQ ID NO: 5469 - DNA, 87 bp, Homo sapiens
  misc_feature (1)...(87): n = g, a, c or t
cctggaaggtgtgcnggagtttggnagaggagtgatctaggtgaggggaatggaaggtgcanagaccatagctgagagggcctgagg

SEQ ID NO: 5470 - DNA, 461 bp, Homo sapiens
ccagagggaaggcccaagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcagcttcgggggtgacatttgtatccggccagccgagcggggaaaggagaccttgtgtcctggcaacagggagagccgggactgggatggccacagctcagcctccaggtgaggagcccagggccctgctcgagctgtgacctccacggtcacggagtcctcggaaaaagagaagttgagcttgttcccctggtagaagatgccggagacgctcactctggagatccccgacagacacacagggtcaaaggtcacacccgctcgggtgaccctgaaccccg

SEQ ID NO: 5471 - DNA, 294 bp, Homo sapiens
ggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccataggggcacagg

SEQ ID NO: 5472 - DNA, 176 bp, Homo sapiens
cttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggcaatggtgtgggggaaatgaacttgagcttt

SEQ ID NO: 5473 - DNA, 247 bp, Homo sapiens
  misc_feature (1)...(247): n = g, a, c or t
cctggaaggtgtgcangnntttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaagg

SEQ ID NO: 5474 - DNA, 345 bp, Homo sapiens
aaaaagaccacatgaaatgctgattctaattgtgtgtaggtcttgaggattaagcacacaaatttcacaaacttctgtttgagtaaacaaactcggccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccag

SEQ ID NO: 5475 - DNA, 369 bp, Homo sapiens
cctaatcttttcttcccacccccacccagccatcctgtgtgccctcttccccttggaggccactgccctaagtgaggatcagcatcgactccaccacagcccactttagtggtgacaacttttaatccacggaagcagtttttcaaagtgaaaactgtttcaaatcacgaagcttaccacttagacaattcagacaaggtaatgctcatttagactgacacaggtatgaaaattccaatcccttcttttcactatcattgtatctgacacacacatcaccttcctaggcactatgacactatcctgggagaagcaaatgtgtacaaagaagcacaatcctgctctctccccacacttcacataaaccag

SEQ ID NO: 5476 - DNA, 315 bp, Homo sapiens
aaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgttttt

SEQ ID NO: 5477 - DNA, 257 bp, Homo sapiens
ccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttagg

SEQ ID NO: 5478 - DNA, 178 bp, Homo sapiens
  misc_feature (1)...(178): n = g, a, c or t
ccagagggaanncccaagagacgtctctgaagccaccgttcctgattattcagaggcagggtccacagtgagtgactcgntggggctggaggaacccanngtgacccanngggggctctggagcgggtccctaacatctgaaaaagtcctcccagggaactcggagctggaacttnca

SEQ ID NO: 5479 - DNA, 344 bp, Homo sapiens
aaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaagcatctaaaactttctcagagggtcatcacacacaagtggaccaccagcctgagtgcaaaattcaagtgcacagcagggaacaaagtcagcaaggaatccagtgtcgagcctgtcag

SEQ ID NO: 5480 - DNA, 320 bp, Homo sapiens
aaaagcctgagggaacctggaggggggctcccactctctaccttctttcctccgagtttgtgactccgagatggacaaagtgtgtgctgtttttggaggctcccgaggcattggcagagctgtggcccagttaatggcccggaaaggctaccgactggcggtcattgccagaagcctggaaggggccaaagccgccgccggtgacctcggcggagatcatttggcatttagctgtgatgttgctaaagaacatgatgttcaaaatacatttgaagagatggagaaacatttaggtcgagtaaatttcttggtaaatgcag

SEQ ID NO: 5481 - DNA, 188 bp, Homo sapiens
ccacagcgcatcactttccttgcaaatgttcactgacagcagcacggtggaaagcatctcgctccagtgtgcgtgcagcctgaaagccatgatcatgtgccaaggccgcggtgcgttctgtcacgatgactgtattggaccctcaaagctctgtgtattgtgccttgtggtgagataataaattatgg

SEQ ID NO: 5482 - DNA, 347 bp, Homo sapiens
ccattcttgcactggcagagagtacactcagtgccatgtttgatccaagaggacccggtgaagcgaaccacattcatttcgtccaggcaagtcttggtgatgtcattgcggatggtgtcagcctggcaagggtctgtgacacagcgcgggcagcactcattctctgggagaatgctgaattcacactccacatctgggcaaggcaggggccaacaatcaacttccccttgctacaaggaaagcagatgtgcaagggcagagggagagggaggaggaaatggagggaggccaggaaaaagcagatgagcacagtgtttactgaatactcaattatttgattgatattt

SEQ ID NO: 5483 - DNA, 319 bp, Homo sapiens
ctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcg

SEQ ID NO: 5484 - DNA, 373 bp, Homo sapiens
ctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagaaggtttactttgcagcggaagatactgattgctgtacccgaaattgctgtgggccatctagaccttttaccttgaggattattgataatatgggtcaagaagtcataactctggagagaccactaagatgtagcag

SEQ ID NO: 5485 - DNA, 490 bp, Homo sapiens
aaaaacagaaaatctttattgtgccataactgatttttagtatacaaaaaacctaatataacctaatttcctggaccaaataatgtaaaataggccaaaatcaagccacagcacaaaggatactattggatatggacctttttgctttggtgaaaacttcaaagtaaggagacactgtcaatcaattccactaaaattgcatttattttcctgtcatagtaaaaaaaggaaaaacagtagcaaatactgggcttcgttttccccctcaacggcacgccttccacaacagcacaggtggttctctgcttcactggcagaaccacacaagcttatcctagagaaaatctgctgtcgtaagtccacaaggaagagttgactgggcccaccgctatagccaatacttccagaatcaccagcccaccttcgtcaaagggctgactgtggcagcaaggggtgtctgtcacattcgtcctggctcactgagcccagg

SEQ ID NO: 5486 - DNA, 241 bp, Homo sapiens
ctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactgg

SEQ ID NO: 5487 - DNA, 232 bp, Homo sapiens
ctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctgg

SEQ ID NO: 5488 - DNA, 506 bp, Homo sapiens
tgctctttcagctttgaacgtcctttcccattctccatcatccacattcacctatcctgcctgccccagttaaaatcctgtttcttctaggaagtccctcatcccacccgcttaccccagggagactgagcttgttccttctcctagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccgcgactgattgcagcccctggtgaaatgagaaccctgtgggtcggaacaaagtttggattatttatgttgcaagtaactaaaatctcaagtgaaactggttt

SEQ ID NO: 5489 - DNA, 282 bp, Homo sapiens
tgctcactcaccctggcacattcagcccccctaacccaccttgaacattgaccaccacacactccctggcacgctcttctcaccctcaacttctgccacctctccctgggcaatactgccagcctttccctaatctcagagctgcagccctgccctgtcactcacctcaaacctgccatgtccctggggctactgaaattccaggcagtgggtgaagaggacgaggaggatgaggagggggagagcctggactctgtgaaggcactgacagccaagctgcag

SEQ ID NO: 5490 - DNA, 326 bp, Homo sapiens; identical to SEQ ID NO: 3635

SEQ ID NO: 5491 - DNA, 480 bp, Homo sapiens
aaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtgg

SEQ ID NO: 5492 - DNA, 307 bp, Homo sapiens
aaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcatttt

SEQ ID NO: 5493 - DNA, 258 bp, Homo sapiens
ctggaaagaccaatagctgactggaaagaagaaaggaagcagtttctattttcaatgtagaaaaaaaatctaatcgctacaaaggtcttgtaaaatcctcaaaacaaggtctagccaagtttattgtttggtaatttttttctttttttaaggggaaaaaaagcaagatttaatgtgaatactactggttacaactaatataacagcttgaaaaaatcatgacacagaagcataaatataatataaaaagacaatttt

SEQ ID NO: 5494 - DNA, 197 bp, Homo sapiens
cctacagggggggactatgtctagagtaggctgaacctgtaaagtggggctcccagataaattgggggcccctgagcaggaaggacctgactggcttaatttgacctggcccaggacagttccctttctgaaagaagggggcattctatgaaacacctgggtagaagtccagcagtgaagagttgggtcagtgtgta

SEQ ID NO: 5495 - DNA, 268 bp, Homo sapiens
ccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatattt

SEQ ID NO: 5496 - DNA, 490 bp, Homo sapiens
  misc_feature (1)...(490): n = g, a, c or t
ttttttttttnntntttttttgcatcaagattcctgtactctaccctanaactaatacatctgaatctctgggaatggagtataacaatcagatttgaaaaggtttctttagtaattttaaggactgaccagtttanacactgctttgttagagtaaaatgattaggtacctagtatcaacctagccatccaaccttatattaataactaggaaaataaagggttggagcctctgtgtttctttgttgaaaaatctgctactattattagatctgngaaaacaattgaaaattcggttattatcaccttaaaagtacaaaacctatagattttgaaaatgtaattatttttctgtaggcatagttaaaaagattttgtaaatgttataaatcagtttntttataagcggtttatttanataaattttgttatactganatgattcactaatttttctaaatatnaatggttcagcctcttanttattttt

SEQ ID NO: 5497 - DNA, 489 bp, Homo sapiens
  misc_feature (1)...(489): n = g, a, c or t
gccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacanaaggatgtaaaggatggaaaatacanccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtagg

SEQ ID NO: 5498 - DNA, 159 bp, Homo sapiens
  misc_feature (1)...(159): n = g, a, c or t
cctcctgcagnntnccgcacagcaaaccgcacgctatggctgacagccgggatcccgccagcgaccagatgcancactggaaggagcagcgggccgcncannaagctgatgtcctgaccactggagctggtaacccagtannagacaaacttaatgtta

SEQ ID NO: 5499 - DNA, 528 bp, Homo sapiens
ccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacga

SEQ ID NO: 5500 - DNA, 406 bp, Homo sapiens
cggccgaggtaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcccgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttagg

SEQ ID NO: 5501 - DNA, 377 bp, Homo sapiens
cgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacag

SEQ ID NO: 5502 - DNA, 367 bp, Homo sapiens
gttttttaccgccttgtctggcactatgaccacgcttcagggttgcttctgggggtcttggtccctggatgtgccatttccttgcccttctgaccctcacacttcttccaaagtcttgagcagagttgggggccaatggtagcattgctgtcatctctgggaggagagtgagtatacaagtcagtgacagttcagccaggctcccttgggtttgggaagaggcactgcccttctgtgctgtggatcctgcttgtctgctctggagtccccccacccttgccaggagcttcacaaaccagagacgggctgtcagcaagagctcagacaggatgtggtgcaagtgcaggtgcacgagtttaaccctcag

SEQ ID NO: 5503 - DNA, 381 bp, Homo sapiens
ctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccggtgctcagcctgcccagaagcccttctctgatctcagcaagatcttagtagtaaagctaacggatccattgaaattcatactcagcatctgtgactactagacaaagcccatttactgaaccataagtgtgcactttt

SEQ ID NO: 5504 - DNA, 264 bp, Homo sapiens
ccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtga

SEQ ID NO: 5505 - DNA, 279 bp, Homo sapiens
gtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctca

SEQ ID NO: 5506 - DNA, 406 bp, Homo sapiens; identical to SEQ ID NO: 5500

SEQ ID NO: 5507 - DNA, 270 bp, Homo sapiens; identical to SEQ ID NO: 2914

SEQ ID NO: 5508 - DNA, 497 bp, Homo sapiens
ctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaagttaactacagaccattgtttctaataagcagagagatctattttagtagtaaactgaaggtttagttgtgagcttcagattttgtgaactccagatgttgtgcggtgttttttttttttttaagacaacaactaaaaaaatgcaaggaatatgtacactg

SEQ ID NO: 5509 - DNA, 286 bp, Homo sapiens
aaatgaacacattccaggcaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcag

SEQ ID NO: 5510 - DNA, 419 bp, Homo sapiens
ccttctaattagtctaacttaaacggacgggattcacctaacaaaagcaagaagaaaagcacaagaacaggtgtcttaatgcatttggataatttatttggggtgtgtgcgtgtgtgtgtgtgtcttggtggaggtgggggccgtgttctcaccaagccttttcataatcaagtttgctttgcaaactttatggccttacacccagcagaacagtccttgctaataaaaggaggatgccctgtcacagttctctgtaaattatcatgtgttgggaagttctgttgatgcttagtttgatcttccatggtggacacatctgttctgtatgtacaaggcattacatgtgtgttttagcggatgggaattgaagcctttccacagtccttgtgctctgagatggctgttgagctctgctcag

SEQ ID NO: 5511 - DNA, 264 bp, Homo sapiens; identical to SEQ ID NO: 5504

SEQ ID NO: 5512 - DNA, 275 bp, Homo sapiens
ctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatgg

SEQ ID NO: 5513 - DNA, 335 bp, Homo sapiens
  misc_feature (1)...(335): n = g, a, c or t
cctgcttcacttgcanataagtttattataattctccagaaatgtgcaggatgtgcattagcaaattgcactgtacttttcactccagcctgggtgacagagcaagactcccgtctcgggggcttaaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagttt

SEQ ID NO: 5514 - DNA, 294 bp, Homo sapiens
ttggcatttcaagcaggaaatgaaatgcttgctttaatggcaaagcagcgttaacatttttcctgtcgtgtagcagagagtacaagaatcatttcagcaaagcagtgactcaccatgagacgttatctccgtggagctgcgttttgacttttcccactctcttactcatagaaggaggacaaaggaacgaaatgaaatcatgctcacaatgaactgttcattacatcaactgatctctctctctctctcttcctctctttctctttctcccataccccaaggcaaaattttttt

SEQ ID NO: 5515 - DNA, 93 bp, Homo sapiens
ttttttttttttagataatatatattaaaaaataaacctccaattcagggtataaaaacagagcgaaggcacttgggggtgggggtggagggg

SEQ ID NO: 5516 - DNA, 188 bp, Homo sapiens
cctgggacctggcctgcacccagtctgtggcccagggaggcatggcaccctagcagcaaagcctgggcaaaggctgagccataccagacacagtagcccaggctacacagggcagagctgcgagtgctacctagccctggggccaaggcgggcaccacaatgctgaagagggcactgcccacagccag

SEQ ID NO: 5517 - DNA, 286 bp, Homo sapiens
aaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcag

SEQ ID NO: 5518 - DNA, 356 bp, Homo sapiens
ctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactca

SEQ ID NO: 5519 - DNA, 405 bp, Homo sapiens
ccttattttgtcatactaagtgtctcctgtaattttcaggaagatgatttgttctttccagaagaggagacaaaagcaagatagccaaatgtgacatcaagctccattgtttcggaaatccaggattttgaattcgagatgaaacaaccagcaatcacagttaaatcttaactttgcctgcactctttgtaggaatgatcagaaatttatctttatcattctgagtgcttcaggagtacaataggaagaaagatactggagaaagcacaagtgtaatcaccatgaagtctgacaacaggagcccattatttgcgtactgtcccaccctgtatcatggttctctgggaacaagctttatgattctcattagagtttatttgttgattgtcagtagttgcgactttt

SEQ ID NO: 5520 - DNA, 208 bp, Homo sapiens
aaaataacctaaattagaactacatataaacagggagttttctcatacattcagaacccaagcaacagcaactatccttaaagctcaaaactgattacagctaacatcaggtccgacgtgacttacgtaaagctgaacccagagttagttcaagttaagattttacgaattttacaaaacatgaactttgatcttggcctctgtcttt

SEQ ID NO: 5521 - DNA, 488 bp, Homo sapiens
cctgcttgatccataggctcacatttgatcccaactggcggctgcttcttggcattaactttggattcccaaccagtaaatcttagcaagatctgagtttctccaggtatgatattattttgtttgaccatccttatcttcaagggctgtgggatctggcagctcttcatttggcccacaccgtgtgaggttgctcttggtgcaccgaatggggaagtttctacatcagtacctcggagagtccactggaagccctggacagtgggaattggtggcacccccagcatggaggccaagaacacacagcactgaagctccaggacaccctcaggaggacggtaagggacggtaaggtgagagcctgggtcaccaggaaccttcgcctgcatctaaacaggatttgctttcagattgcctgtaggtcccagctacttgggggctgaggcaggaggatcacctgagccttgggaggtcaaggttgcggtcag

SEQ ID NO: 5522 - DNA, 236 bp, Homo sapiens; identical to SEQ ID NO: 3713

SEQ ID NO: 5523 - DNA, 287 bp, Homo sapiens
cctctcctgtgggttccagaccctgttccagcaacaattgctgggacacctgggccgactgctccacctcgccaggccctggccctctccatctcagccctgacagccacccagtgataaacacagcaggcttcctaagcaatgtgacgcaccagaggggtggtggtacacgctccccttgaagtcatctgaaaattagagaacagatttgcctcagagctgaagagagaccctattccaagcatgaatggccttgacaatgttcctgcccagtgagcgacccttgg

SEQ ID NO: 5524 - DNA, 312 bp, Homo sapiens
ctgccgggcctgcttagctcctccctaggcagaagctttgttccagccccacttccacatcccaactccacagtcaggatgggaggcacatggttgctagcaggggaaagaatactgtagttccagcctctgctcctttcagtctcagcctggatggtggtcactcatccctctgcagctagttcctcacttgtcccagcccaggagccaggagggcactcaatcacacccaaaggagcaggcagtgtgacttcagtcatcttcagatgactcctcttctgcctcttttagccactggatgaacctctgcag

SEQ ID NO: 5525 - DNA, 269 bp, Homo sapiens
aaaaatgaatttcctgagtattaatactaaaatactgttacatgatcagctcttgatataattgaagagatttcagatacctgatgagtctcattctcacactaattcagaaccttggaaggcactgagtgttcaaaaaaggtagctcttaactgaggaccctctgttgaaccattgtgcgcacccctggctcttgggcagtgtagtagcaggaagacagggttgttgccattagaaatggaggctttaactctccctgtcccccattt

SEQ ID NO: 5526 - DNA, 329 bp, Homo sapiens
aaagtaacgttactgctatatccttaggcacggtaagctgaggatattgtgagtgttcgcaaatatacagagaccaccctcacatgtagaaccgtagaatcctagagttggggaaaagaggtcttgggggacatctggacggctcccctccagagtagaaccttctcccccgtgggttccacattgctctgtggggggcagagcatggtacggtgtgcaagaaacaagctctccaagtcacctccccccatacctccatctccttatctggaaaaggaggggagtcatccacatgacctttgaaagcatttccagctcagttactttgg

SEQ ID NO: 5527 - DNA, 346 bp, Homo sapiens
ctgggcccgggggaccactaccaccaattcgcggagaccagtagtggccccgaatgtctagctgcgctgttatttattggatacaaagcaaaaggggcagggtaaagagtgtgactcatctccaatgatatgtaaggttacgtgggtcacgtgtccactggacagggggcccttctctgcctggcagccaaggcagagagagagaggaagagagagagacaggcttatgtcattatttctgcatatcagagacttttagtactttcactaattttgctactgctatctaaaaggcagagccaggtgtacaggatggaacatgaaagtgggtggaccaggagcgtgg

SEQ ID NO: 5528 - DNA, 142 bp, Homo sapiens
cctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacag

SEQ ID NO: 5529 - DNA, 470 bp, Homo sapiens
  misc_feature (1)...(470): n = g, a, c or t
aaatgatctgccaaatctctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagncttttgaaaagaacttggttgacactgcttttattgtggataaaggagagatggtcnnntaattaatggcttgaagtattattggagtggtttatcatttctgaaactaatcgtggtcagaattgactttgaaaagcattgcntttttacagaagtatattaactttttaggagtaatttctaggttttggattgtaatatgaaataattt

SEQ ID NO: 5530 - DNA, 281 bp, Homo sapiens
tggccccgaatgtctagctgcgctgttatttattggatacaaagcaaaaggggcagggtaaagagtgtgactcatctccaatgatatgtaaggttacgtgggtcacgtgtccactggacagggggcccttctctgcctggcagccaaggcagagagagagaggaagagagagagacaggcttatgtcattatttctgcatatcagagacttttagtactttcactaattttgctactgctatctaaaaggcagagccaggtgtacaggatggaacatgaaa

SEQ ID NO: 5531 - DNA, 319 bp, Homo sapiens
ctgcatttcagggctttctatcgatgggcgtgcctgcgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttgg

SEQ ID NO: 5532 - DNA, 404 bp, Homo sapiens
  misc_feature (1)...(404): n = g, a, c or t
cggccgaggtaaanctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttctta

SEQ ID NO: 5533 - DNA, 391 bp, Homo sapiens
cctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagggccagaagatgaacagactgaccttgatgagctgtgcacaaagtggcataaaaaacagtgtggttacacagtgtgaataaagtgctgcggagcaagaggaggccgttgattcacttcacgctttcagcgaatgacaaaatcatctttgtgaagg

SEQ ID NO: 5534 - DNA, 277 bp, Homo sapiens
ccaggatggtttcgatctcctgacctcgtgatccaccggcctcagcctcccaaagtgttgggattacaggcgtgagtcaacgtgcctggatgtaacagttctcagtttagcagttatccgtccagttctttttcaattgatctgtgctttttaacccataaaaataggatagatagtagtatctgtctcacaggaaaagaacagaagtgaaatgcaaagtgggtaatgttttcctttttctcgttcctaagagctgagacctactgcagaaacacag

SEQ ID NO: 5535 - DNA, 274 bp, Homo sapiens
caggtaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtattt

SEQ ID NO: 5536 - DNA, 261 bp, Homo sapiens
  misc_feature (1)...(261): n = g, a, c or t
ctcttttttttttttttttttttttttttttttncggctaattttgttttttaatganaaacatctganttgtacatatcacaaacagcttcaagtttctgtaccaacccccggcccccacccccgccggggaaaccttnactntgtanagcctaaaggatgatggaaaaagggcnaggaaagcanaaagagaancncancatantacaaactacnccgcgcggnttatttaggatttggaaattcaacatgctcagggac

SEQ ID NO: 5537 - DNA, 198 bp, Homo sapiens
ccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgccagccaggaggaagttcaca

SEQ ID NO: 5538 - DNA, 546 bp, Homo sapiens
ccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacaggttaactgcctaacagacctgcccgggcggccgcccgggcaggtaaatttcaccagttaaattaggtcaaatggaaggaactcaaatgagtattgcccaatcagagcccattatttgtaagtcatcagtaaccttaaaactccacttagacctaattattgaaaacttgcatataatgaagtgaaagaatttccattcatcaacctctcaatcccaggttttcaaagaaaaacctatctaaggaatacttaccaaaatcagataa

SEQ ID NO: 5539 - DNA, 236 bp, Homo sapiens
cgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctgg

SEQ ID NO: 5540 - DNA, 322 bp, Homo sapiens
ctgctcatgctgcagaggagacagctagtcaggaaccctggagattcaagacaacttgctggtcccctttgcccagggctgtggtcctaatcacagtccttcacctttcccagggttagcctgtgtttcaaatgcatatgatctgcgctgagaggacaacagggggtcaggaacctggggttctctggggggcagactaagacgactccgggatccagacccttctgcaccttcagatgggagctccaggcagctaaggggccgaggagaatgggcagagatcatgctacaaggggaggttctggggatgaggcagtaatcc

SEQ ID NO: 5541 - DNA, 415 bp, Homo sapiens
  misc_feature (1)...(415): n = g, a, c or t
aaacgattttgccttaaattgttgctaaatgtttatctacacatgctgtcagaaataaccttgttaagaaggtgaagctggtgtctcagcaaatcagaccccttggagaaggcgtcgaatggcctgtgccccgttttcctttttctctttccgcaccatcaaaaggaaaagtgagaaaatagcagaaacattagttaaatcctgaattataccccataacctacaggaataatctcactacactgaaagctgacaatatttgtaggattttttgaaataattaggatcctaattattaataaactggtaattttggctaggtttacatctttaactaataatactttcaattaaaaaccttnnngaaaaaaacananggttgcttttnactatttatggnttacctgacttacca

SEQ ID NO: 5542 - DNA, 498 bp, Homo sapiens
aaattgaaatgaataaagttagcaccttgcttgttgatgtgaaatttcttcaactccacaagtgttaccattcataaatctaatttccatgaatggaaagtggaggaacatgtgttcaaatgcctggctgaagggtgcagcaaggttcttaccagccaagaggtggggtgatctgtccaacaccacccggagacaagggataaaaagtagggatatcaggagctggaggatgtctggacatgccttgtttggagttgacatctgatgggatgtgcgacgggtgtgatcctggagaaaagtgctcgtcactgtaagtgatgaggggggtgagaggatggaccgcatgggatggctgcaccacgggcactttatttgatgttctcgggatgggtggagaaagagatccatttgacatgtatgggtcgttattcatatttggcatcattatgtacccggaataactcgagtaggagggtcccttgttgtagaggacctcgg

SEQ ID NO: 5543 - DNA, 245 bp, Homo sapiens
ctgaacggtctggggtgagttggaggtcaaaggaggttgaagggttcgggggagaacaggacggtcggcgtgcagagttcctggagtgctggggggcctgagatggttgtatgacgtctggaggattcaggagggtgtatggggtctcaaggacacagcagtcccgcttcctcccctttcccacaggacccccaaggaagtgggagatgtgatcgccctgagcgacatcacctcctcgggggcag

SEQ ID NO: 5544 - DNA, 491 bp, Homo sapiens
ccctatagggcgaattgggccctctagatgcatgctcgagcggccgcccgggcaggtctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccag

SEQ ID NO: 5545 - DNA, 452 bp, Homo sapiens
aaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcaggatggtcacactgaccttgcagagttctgagaatcagagacagaacataaaagg

SEQ ID NO: 5546 - DNA, 338 bp, Homo sapiens
aaagaaatacagaaaaagaatgttaagtattctcagtccaacgtgctttgcatcatcaacaaaatgacaagtcaaagtattttgcagggatcagatatcaatcaacctccataacaagttaggtatatcaaatactgctgtaaaacccatccagcaaaaactgattattgtggatttcagtacaaatttccaagttgtcacacattactgatgatgatcagggcaggcatggaattctgctgacttgtttcaaacactgtaacttggtccgataacttggcaaataccctaggagttccaaggttataaacacctgtatgaacaaagcatgctttcag

SEQ ID NO: 5547 - DNA, 488 bp, Homo sapiens
  misc_feature (1)...(488): n = g, a, c or t
caattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagnagtggtcagtcattttccatgagggatggactaggaaaaatgaantgtntattataaaggagagttcctgtaacttaaggagcaa

SEQ ID NO: 5548 - DNA, 549 bp, Homo sapiens
ccaagtctacttttgaaataagacatggagttttcttgcataacccagggctgagctgctcagttaggagtcagagttggcaacatgagaggaagaggaggaaaaattatcctctctgcacattaacttgctctggaagctctcacataattacacctagaagttctaagggtcatataagggtctgatctttgggtcatatgtcaaaacagagcagctctgatgataagatctctctctctccacatccccatctcctttgtcatctctatctctgcacatatatttctcaacttgctttgctcaaagcagcctatacgttctggataaaaacctcataatccttatgttccccacgtttcatttcagaatttatcaaagagtatggcatgaatctaactgttcctttcactttccttgctcttgtagatcaattattacctaccgaacacaaggattagaatcataatgtgagatgtaggattatctaattttacaaaccttcaactcgaaaaacttcacattccaaatactgacggtggacctcgg

SEQ ID NO: 5549 - DNA, 273 bp, Homo sapiens
ccttccaattcaggccacatgtacctccagatactatgtggctggctgcctctgcctttttgggcaatctcagttccaaatattctatcatgttgtcatgccagcttttggcttgggaaatatggtcagtatgtctgtggggaaactgattctgtgtgccggccgcagaggaaggactctgggctggaggaaaggggtagggctcagcgccagtgctaggactggttgaactgtagggtgcagccctggctagtgaccacaccccatgtccag

SEQ ID NO: 5550 - DNA, 207 bp, Homo sapiens
  misc_feature (1)...(207): n = g, a, c or t
ccagagggaanncccaagagacgtctctgaagccaccgttcctgattattcagaggcagggtccacagtgagtgactcggtggggctggaggaacccagggtgacccanagggggctctggagcgggtccctaacatctgaaaaagtcctcccagggaactcggagctggaacttncaggcagcttcgggggtgacatttgtatccg

SEQ ID NO: 5551 - DNA, 291 bp, Homo sapiens; identical to SEQ ID NO: 409

SEQ ID NO: 5552 - DNA, 293 bp, Homo sapiens
ctggcctctcctgacgtgttcctctttaggagcaacaggtgaaaaaatgatacggttctggggcaggcccatgttttgtgcatactgttgaatattaggttctcctactgctggaaaacgcaacagccagagtacactattgggaacacgcttcagaatgtttgcccacatctgcaaagtagaagggtcaattttatacaactgattaaagttacagtatacgatggcatcttctggtaacccgtactgagaacgggtggttacaataatggtacggggaacctcctctccag

SEQ ID NO: 5553 - DNA, 399 bp, Homo sapiens
aaaatgactgtctgactcaccatggtaatttttcacaaattaaaaacacattttgggttgtgcaacagtgttctcatctttccaggcaggcagattattttaatgctgttatacagggaattgggactctcggattttcttttttaacctttttatgcctttcagtaggggaagtttccttgaaagttagagagctgcaaatctctaagtatcaatgtaaagaagccgatgacccaattcggaaggtggttcaagtgttctgtttgtttacaaaggcacagaccacgaccatggacacacccagtggaagtaaccacacccggtgtgttcctagaagctcatctgtgacagttcaacaagaacttactattctagaaaagtattacacaaagttatttt

SEQ ID NO: 5554 - DNA, 245 bp, Homo sapiens
ggagtgcgcttcccagggcaccattcgcttaaagtgtgttaatgacttgtccagcaagtttctttaccttcccacacccctcttctcaacgtccccccagagtcctcaggggggccttcgacctgcaaaagcctcacaggagtgcgaggggccccagctcccagggcggccgatggagcctcacacggtcaccttctccatcacgctttcagccacgtggacttcgtctgcctggacggtgacag

SEQ ID NO: 5555 - DNA, 472 bp, Homo sapiens
ctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatga

SEQ ID NO: 5556 - DNA, 215 bp, Homo sapiens
ccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcag

SEQ ID NO: 5557 - DNA, 156 bp, Homo sapiens
aaaagataagccatttctatcaccatcccctcagtgcccagaattccagatgggaagtgataccgttttagagttaaaatttccggcctcacgcgtgtaatcccagcactttgggaggccggatcacttgaagtcaggagcgtcagaccagcctgg

SEQ ID NO: 5558 - DNA, 250 bp, Homo sapiens; identical to SEQ ID NO: 2938

SEQ ID NO: 5559 - DNA, 335 bp, Homo sapiens
ttgaagacatgcacattttgttatgtctatgcagccctcagagcagtcacaggaatcagtaaacatgctggaaaagttggttagattatatgctcgaggccacacagtctttctgtacttaaactgtgggagctttctactgtcaatttcattacagaaagaaatgggcactgattccactccattgctaatatccacatcagaaacaacttctttttgctttgggtaattccgagccaactgaacataggtattgaaagaaaagttatgtggagtgctgaagaatgagagtttgtctttgcatgtcgtctttggaagtgacatttgattggcag

SEQ ID NO: 5560 - DNA, 380 bp, Homo sapiens
ctgaggaggttcctgaggatgatccactgctcactgagcgtggtcagggagcgccgctgtcggacgagcatcttcatcaaatgtgctgagaaccctctgcacctctccacgttgcccatgcccatttccttggcaggagttgctagtgctgcgttaagcctggcatgccgtgcaagagagcgataaaaatacttctggcatccatcccatgaagacgagatttctgtaagcagcctagaatcagcctcctgagtgctgctgacgatggacaatgcgctctggagatctaatgggtgaagatgaagcatctcttgagggttttttgaacgggcccaagcaagacctttgcgatacgacaaaccaatttttgcaaggtgttt

SEQ ID NO: 5561 - DNA, 331 bp, Homo sapiens
aaatattgctaagaaagaacttggagagagaagttggtgataccggagacagcaggcaacagacagagtgagaggcccgaagaacaagaggaggagggagtctcttctgggagcagaaggagtgtcgacttaaatattagggagccaaagatgaacctcgcagagaacctgcaaaacccagttgcagaaatacctgcccacacctaaaaactcagtcactgaaagtctgaagtcaaatgattatgtgaaatcttagtagtgggtacatgtggtttcattagattattctttgtatctatatttgtactatcttataagcactataagtttt

SEQ ID NO: 5562 - DNA, 293 bp, Homo sapiens
ccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcttgatgaagaagctagccttctgaacctcgcctgaagccagcctctctgccaagtcactcaggtcatgggcattgttcaagcctgagtggcagccgctcttgctcac

SEQ ID NO: 5563 - DNA, 342 bp, Homo sapiens
  misc_feature (1)...(342): n = g, a, c or t
ctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccagagggccaggaactcgtggtgactgtcactgctcggtgcctggcgctgtctcagccagtagatgcgcatgttactgagggagattttagcctcncanggacancatcaccatcttgnnggtttgcacctttatgtangcagggggtctgctgngaggactgagtt

SEQ ID NO: 5564 - DNA, 201 bp, Homo sapiens
ttgaggtttggaaggtggaggtaaacttgaggccaccttcttcactttggccgtcttccgctgccagagctgtggatgagcttgactctcctccctctcacacctgacatggaatctatcagcagatcacgtgtgtgctacccttgaaatcagtatctagaatccaatcacttcccagtgcccctgctgttagcggcctgg

SEQ ID NO: 5565 - DNA, 258 bp, Homo sapiens
ttgagatttcccaggactggctttaatttgaaaaatctgattggggtctcttcccgtatcagagaaggaacagcccaagctatgaccccagggccagggaattcagtccccaccagaccctgtcattccatcactagggggtaattccaggctccccctgccagccctgagacaggaggacggatgtgaagttgcccaggactagattctgtctctccaaagtggcccaagccctgttctctgtactagggaagccag

SEQ ID NO: 5566 - DNA, 348 bp, Homo sapiens
ccaggtgccggccctggccccctctaaggccaaactcccccctgcagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtgg

SEQ ID NO: 5567 - DNA, 383 bp, Homo sapiens
  misc_feature (1)...(383): n = g, a, c or t
gtacaagcttttttnntttttttttttttttttttacagtcttcaaatattttttattggaaggccatgcattgccttcatttattgnatttcaaatcactgtacatttacttttgtgaaaacactgcctgcattttctagtacaaaaaaaacctaaaaattgtttcaggaatgtagagaaatatccaacttaaatagcgaaaaagtgcaccataattactgctgcactgcagtcatttctgcaattcccatgtttcttaaataactatcttgtcagataacacacaatataaagagcaattatgaaaaacagacatttacatatacttctaaagtcttattgggaatatcctgttggcattggataaccaatcataggtgca

SEQ ID NO: 5568 - DNA, 206 bp, Homo sapiens
  misc_feature (1)...(206): n = g, a, c or t
ccagagggaagncccaaganacntctntgaanccaccgttcctgattattcagaggcagggtccacagtgagtgactcggtggggctggaggaacccagggtgacccagagggggctctggagcgggtccctaacatctgaaaaagtnctcccagggaactngganntggaacttccangcagcttcgggggtgacatttgtatcc

SEQ ID NO: 5569 - DNA, 383 bp, Homo sapiens
ccaactgctctttcaactccaagcttttcttctcctaaggaaagtgttccaagaagacatctttcagaaggaacaaattcttatgcgacaagacttctaaataatcatcaagttccacctcagtctgaacctgagagcaacagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtgg

SEQ ID NO: 5570 - DNA, 128 bp, Homo sapiens
ccaagtcccttcaattctctgtgcctcaactttctcatctgtaaaaaactatctcgtcaggaaaataataggttacgaggttggaaaggctcacgggtgtgcgggcactccaaaaaaaagaaaaggac

SEQ ID NO: 5571 - DNA, 251 bp, Homo sapiens
aaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttagg

SEQ ID NO: 5572 - DNA, 111 bp, Homo sapiens
ctggcctgcgtctgtcccagagtcctgcctgcggggccttgtgttagctgtgttgtgcctggggagactgttgctagtggaaggtgcctctggagatggggtggggcccag

SEQ ID NO: 5573 - DNA, 300 bp, Homo sapiens
ctgttgaacactgcagaaatctcccctgatagcaagctgcttgctgctgggtttgacaactcctgtataaaactttggagcttacaatccaggaagttaaaatcagagtcctgtcaagtagacatgtcccgcatccatttggcttgtgatattctggaggaggatgtgtgaataccgttttttcttccctgcacctgccttcctagtttgcttagaatgtccttaccaaacacgacatatcttagaatggacttcctaattttcctcatcatatagctaaagccagactaatgccatgta

SEQ ID NO: 5574 - DNA, 242 bp, Homo sapiens
aaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagattaattagtggcttttt

SEQ ID NO: 5575 - DNA, 170 bp, Homo sapiens
  misc_feature (1)...(170): n = g, a, c or t
gttggtgangctgccagcatgtgcgatgagacgtgcacctacctggagagagagtcaaggaagcagtcagagaaatgaactgctgacctgcccagttgcacgacagccctgctccccacctccccatcaagcacaactagggaagacatggtgggtcacgaaatacagca

SEQ ID NO: 5576 - DNA, 365 bp, Homo sapiens
ctgcaggggcaggcggattcagaactttttttgcattttcccgctggactgtaggtaacccctgaggagactcggtcctgctgacctggtttgcgctggctacagaagtctgcttgggttgtgtctcgcatgctttgctttgggaagctggcatttctggagctccctgtgcatcaacggctacttgactgactgaggggattaaggtgggcaatgctatgttcaagatctggagacctggaatgtgtgcctgaggggcggggctgctttgtgatgaagggtttgcagtcagaacctgcagtccgacagcattcagagccagtcctggtggatggacttgtggggccatatttgtattggctagg

SEQ ID NO: 5577 - DNA, 248 bp, Homo sapiens
ccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagttaaagtctcaaaaacaacc

SEQ ID NO: 5578 - DNA, 334 bp, Homo sapiens
ccttcgtgcagtttgcttcacaggaaatagctgaaaaggctctaaagaaacacaaggaaagaatagggcacaggtggggatggatggttggttggatatgtcacttttcttatggtaaacaattaaatccatattctctctgcttaaaagaagaaattaatgttttgtagtcctaggtaattgatgttttgccatgatttccaaacttgtgtcagtcccacgttacacgcaaactaaattttaggtttgaaatttgtccctagttaattggtctgcttgacaattttgtgagtcttattaaccccaatcaatagagttgagagactatggcttt

SEQ ID NO: 5579 - DNA, 168 bp, Homo sapiens
  misc_feature (1)...(168): n = g, a, c or t
ctgattgtcagagccttagacccagcacgccttggattanctctgcagagtgtcttggttgagagaataacctcaccgtacccacatgacacgtgatttggaaagagactanaggccacacttgataaatcatggggaacagatgtgttccacccaacaaatgtgata

SEQ ID NO: 5580 - DNA, 303 bp, Homo sapiens
  misc_feature (1)...(303): n = g, a, c or t
ctgcggcccanacctcagccaccagcaccaatgcaaaccctctctctgccacgagcagcgccctgggagccctcacgagtcccgtggctgcttcaacccccaactccactgctggtgcagccatgaactccttgacctctcttgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccagg

SEQ ID NO: 5581 - DNA, 627 bp, Homo sapiens
  misc_feature (1)...(627): n = g, a, c or t
cctgtgcacgaggtgaagtccaccttggtctgaaagcagaagatggtgactgaaatggataccaccgcagtgatgatcattgcaatgatgacggctttggtttggtacatactggaaatggtgcccgtcatgaagcccatggcaaaagtaaaaagggtcagcagaatgatgttccatgggaaacggcgtctgggtccctggcagcaggcaaggatcaggtaggtgacaacgaaggcagcataggacacgtagtagacagccacatttctcctcacaaaggcgctgacaggttccacaaaggtgaagatagcaatgatggacctgcccgggcggccgcccgggcaggtgtgctcaacattatctgctgcagggcattctcagacacagactgagatattcaggatgggatccgaagcacctagaacctggtagccttagaaagctgggctgacctaagggcagagttggtgtttctgcacgtcatcctcctcgtcatcctcatagtcatcctcatcatctgagtactgctggggtgggcggactggaactcggctgcggnccacacctgccgccaggtctncttcctnctgggacaaagaccanggcagttacaaacaagtgctgctc

SEQ ID NO: 5582 - DNA, 421 bp, Homo sapiens
ctgccgtgttctgggactgtctcatggggcaatgtgtcctcacccccagcagtgccagcccaggtcagaaggcttcattcagaaggggggtgtcacagcacctggctgagcccccatggaggatggagacccacagatacacacaaacacacagagacatctccaaatctctgactcagactcgcacacaggcacacacagacgcacgctcaacacagacacacgcaggcctttattctattacacagagtagggctggggccagggcaggtcattctcaggctgcgtcagaaggtgcagagcgttcgggggacacaggccgaaccccaaagtgataataagttacggggggatttctcaggctgttgtcaggctggagcaagggcaggacgccatgtgaggaccccagagccacttccag

SEQ ID NO: 5583 - DNA, 262 bp, Homo sapiens
gccagggctggggggaagagctaggcttaatgaacagagcttgaggggaggagcctggactggtgggaggagctaggtttgatggacagagcttaagggacagagccaagactgatgataggaggagctaggtttgatggacatagcttaagggaaggagccaagactgataggagctaggcttaatggatagcgcttgaggggaggagccagacctcgtgggaggaactaggcttaatagcgcttgaggggaggagccagg

SEQ ID NO: 5584 - DNA, 301 bp, Homo sapiens
ccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttactgcag

SEQ ID NO: 5585 - DNA, 189 bp, Homo sapiens
ccagagatgggagaaataactaatttagttttattgtctctttttattgtcccaatagttgaaattgcccacaaccacagaaggcagagttatcctcgttgaagcaagctaacacaaatgagttccttttagcaaacttctctgtcttgcccattctttggatcatagcacaagtttttgagagatcag

SEQ ID NO: 5586 - DNA, 395 bp, Homo sapiens
  misc_feature (1)...(395): n = g, a, c or t
ccaacagagcaagaccatgtctcaaaaaaaaaaaaaaaaaaaaaaagtaggcattctattanacgtcagacccatgatcacatcactcattgtacggcctctggaaaactccgagatacactggtgagtgaatgggaatgggaagggcttantattattatgaaaaattctgacccagtgaacctcctaaaagggtcttgagcacccttagggagcctgcagactgcactttgagaaccaccactttagctggctgggtgaatactaaaattagtctagctaattttttgtattttttgtagaggcagagggtttcaccatgttgcccagactggtctcgaactcctgggctcaagtgatccacccaccttggcctcccaaagtaccctctcttt

SEQ ID NO: 5587 - DNA, 174 bp, Homo sapiens
cctttccttgagctgcacgtgaacctgtgtgggcaggcagcgtttgcaggcgtgtttacgggcaggcagcgtttgcaggcgtgtttaccggcaggcagcgtttgcaggcgtgtttacatgcaggcgtagcaccatgtgagaccactggtccagggtttcagaggtcctgctcag

SEQ ID NO: 5588 - DNA, 204 bp, Homo sapiens
  misc_feature (1)...(204): n = g, a, c or t
ctggaggccanctttgccagaactgtcaacaaagaatatccaggacttgcagacccagtgtttcgaaccctggtgtcccaaattctggaccgggctgagcctctgctttcctccagcctgtcctcggaagtcgtcactgttttccagtattacagttacttcaccagccacggcgtcagtgacctggagagttacctgagccag

SEQ ID NO: 5589 - DNA, 155 bp, Homo sapiens
  misc_feature (1)...(155): n = g, a, c or t
cctcagtaggganngccttctctactatgataatgctcctgctcatccttctcatcaaacaagggcaattttgtgagagttttgatggaaaattattggcatcctccttgcagtcctcatttggctccttctgccttctttttatatccttattt

SEQ ID NO: 5590 - DNA, 467 bp, Homo sapiens
ctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttgg

SEQ ID NO: 5591 - DNA, 319 bp, Homo sapiens
ctgggggaaagggagaagacaggggtcccctgagagcctccagaaggagccaggcctgccgaccccttggttgagggcctctggcctgcagcactgtaagacagtaggtttctgtggtttaagccattcagtctgtggtcacatgttacagtagccctaggaagctaatgcgggggctgctggtaccctgcccactccttgactggtgcctactggcccagctcccacctgcggctctgctcgaaactgtccccactctgctgtgctcaaaaggtcagagtgccagggaatcaaggcccagccctttctcagggagcag

SEQ ID NO: 5592 - DNA, 278 bp, Homo sapiens
ctgctgagggggagcctggtaggacatgctctcatccatgccggggactgggggctggttcagagtcccttggtgttggggtgcggatggctgctggggtgtggctgagccataggagccggccatcccatactgggaaggggagccatagctctggtacatgctcatgggatagtagtagctgtaggggtaggcatagttgtactgctggtaccactggtagtactgctgctgctgcaaagctgaggcttctgcctgggacacgtactgtgcactgg

SEQ ID NO: 5593 - DNA, 313 bp, Homo sapiens
ctggaaaaaatgtacggacatggatgaagctggaaaccatcatcctcagcaaactatcgcaaggacaaaaaaccaaacaccgcatgttgtcactcagtactgccgtaaccctgatggtgacatcaatggtccctggtgctacagagtgaatccaagaaaactttttgactactgtgatatccctctctgtgcatcctcttcatttgattgtgggaagcctcaagtggagccaaagaaatgtcccagaagcattgtagggggttgtgtggcccacccacattcctggccctggcaagtcagtcttacaacaagg

SEQ ID NO: 5594 - DNA, 382 bp, Homo sapiens
ccatttcattctgttctccatggactaaaatcacatgaggcggtttcaaagcacgaataaattcactggtttgctggtaatccgtgtgagctgagaaagaaatgtaatcaacagacattttcagtggtaacttctgtccagacatagtagtgatttcttcaggttcagacatgatgtgcttggcaagtgtcccttctacacagtatcccgctataatgacaccattcctcttatcagtacaccagctttcaaataattctctggataagccactttgcatcatgcctggggaggccattacaacactgggaccaatgtcatcaaaatgatccatgctctaagagagaaaacagaatgggaaaagtatgttagctaccagcag

SEQ ID NO: 5595 - DNA, 548 bp, Homo sapiens
  misc_feature (1)...(548): n = g, a, c or t
ctgaaaggaggtggatggggacagagcaccaaggggaaggggccctcggcccaaggggggaggaacctagcccccaccccgctacagctccccactgaattcacagcacagagaacacctctcgcccaacaactccacatggaggtataccaagtccaggggtcaaaggagcaggtggatgacagatgggcaggggcagtgaagatgacagcaggctcaggaggggaggtggcagaaacttcctcctacccatgggaggagacgatggggcgactgatattgctgttggtggtcatggcattcagctcccacctgatatcatgaggcaaacaggactggtctaggttatactgaatcacggccagtttgcacagagtcttcagactagggctaaagtccaaaatgtgtaagtcagaatgatctataaggtcaaattcatctcccaggacctgcccgagcggccgcccgggcaggtcctgaangacccanggccctctggctggatgcgtttgcctatcaggacccagaattacttacagacctgttta

SEQ ID NO: 5596 - DNA, 386 bp, Homo sapiens
cctaacttgggtggagagcccagcctgagcaccagaattagttgcttccacttgtgcagcctgctgaagagccggactcaggttgaagcagctttcctcccagtcttcactgatctccacagggagaaaacagaagtccccacaagtaccaagctcttcctgagactgcagccaccacacctcgggaaaggggaggctgggaggagaggagtacactgtcccggtgacccacaccaaggtggctccaagtgtaaacaaagccaataagagtgagcactggccctgagccccactatatgattgggtcaaaaggctcctttaattcaggagagttgggcccacagagtcttgttatcaggattttgctggttggcctgccttccagg

SEQ ID NO: 5597 - DNA, 184 bp, Homo sapiens
  misc_feature (1)...(184): n = g, a, c or t
attctgtnctccatggactaaaatcacatgaggcggtttcaaagcacgaataaattcactggtttgctggtaatccgtgtgagctgagaaagaaatgtaatcaacagacattttcagtggtaacttctgtccagacatagtagtgatttcttcaggttcagacatgatgtgcttggcaagtgtc

SEQ ID NO: 5598 - DNA, 266 bp, Homo sapiens
ctgctccgagggcctatcttcagccaggatgcccacagagagggacgccagtgcggttactgcctccacttcttctttgtcagcccctggcactctaggcacccaggagtctggacaggaggccaggcgctgcatgcagccccagtatttactgtgcacccggatcacggcctccagagagcggatggcattgaggttgggtttctgtttccagccttcttctgaaaggggatccaccctgttacccagaagagcagccacacagg

SEQ ID NO: 5599 - DNA, 237 bp, Homo sapiens
ccacattgacagtgtttccccagatgtcatactgaggttttcgggccccaatcactccagcaatcacaggcccatggtttatgccgacgcggaggcggaaggagttgaaggagtgcctgttgatgccgtccagcttactcatcagggcgatgctgaactccaccatgacaccaatgtgggcatgctgccgctccagctcctggttctcgtgccctgaggcgacgctgagccctgcag

SEQ ID NO: 5600 - DNA, 284 bp, Homo sapiens
cctccagtgtctacaatgttgatggtccccttttgttcagtcaagttttaataaaaataaaactgttctacagttaattgcactttgttcagtgtaaatttccaatgaccaagagcaggttaaacgatgtgtgtggtctattaaactgtggtcactcgtgctaaggcacacttggcctggagtgagttactgtttgggaagccaaagatagatcaagtgcaggagctgatcatacaatgttttctctctaacttacttacctgaactttaaccccaccccattt

SEQ ID NO: 5601 - DNA, 350 bp, Homo sapiens
gggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccagg

SEQ ID NO: 5602 - DNA, 191 bp, Homo sapiens
  misc_feature (1)...(191): n = g, a, c or t
ctgcaatccacttaggatttcacacatgatcttcaaacactctgcatcggggatcatagggtcaaactgaccagcaatgtcaaaatcacactggcagaactccctataacggccttggactatggntgggctctctcgccgncacacctttncaacannataacgtttnatnttcttcaccttattcatgg

SEQ ID NO: 5603 - DNA, 343 bp, Homo sapiens
cctttgcactccgctctttccactcacatgtcacctcagggctgtccccggcctctcctttcccatctctcccagtacattatggtccctccttcctagcatctggtgctatctacggtaggcatgtttagctgctggtacgatccctcctccactgaaatatgggcttcatgtctggcccctgtgggactgccagagcctggtcctcagtcatgtttagttgggctagtgaatcaactcttggtcaaagggacaaaagcagatgaggagatgtggcttcaatcaggatcagtgtggaacagtgagacctgcgcatggcactgctaggagggatgggttccac

SEQ ID NO: 5604 - DNA, 115 bp, Homo sapiens
atctaggactgccggctaagtggacacactccttgacctcctaccaggaactttggtaaaagctagctttggggaaggggttgggtgtaaatatgagagggtggagggagaccag

SEQ ID NO: 5605 - DNA, 378 bp, Homo sapiens
ctgagagtagtcgactattacagagccggccatcttgcactgcgctgatatccaagctcattttgggattataagtatgtggataaagagattcaggaagatgtttacactcttgggcacaatctaaaagccagtgctcggaaacaatgtgtactcctctttcttttacagatttatactcccgattagtgtcatttggccgcccttgatagatgaaatgagtcactgtttcatcaaaactccacctgtaatctgctcctagagaggctgcgatcccatttagttcactctgcttcttactgagttttttactaacacataccactacttgtgaagtggctttggggcttcttccttctctgactgggcctctttcgg

SEQ ID NO: 5606 - DNA, 371 bp, Homo sapiens
aaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggggcaagcccctcacaatgcag

SEQ ID NO: 5607 - DNA, 158 bp, Homo sapiens; identical to SEQ ID NO: 3737

SEQ ID NO: 5608 - DNA, 95 bp, Homo sapiens
  misc_feature (1)...(95): n = g, a, c or t
ctgaagacagcggcaatgctgacaaatgctaagaagataattgataaatacatattgatatagatgaggcangctgntacttggcantggaatat

SEQ ID NO: 5609 - DNA, 279 bp, Homo sapiens
  misc_feature (1)...(279): n = g, a, c or t
ctgaattatctatncatcntctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaaacatttataaattaagaagaa

SEQ ID NO: 5610 - DNA, 152 bp, Homo sapiens
aaaaagctattagtatttattaatgaattttactgagacatttcttagaaatatgcacttctatactagcaagctctgtctctaaaatgcaagttggccttttgcttgccacatttctgcattaaacttctatattagcttcaaaggctttt

SEQ ID NO: 5611 - DNA, 273 bp, Homo sapiens
  misc_feature (1)...(273): n = g, a, c or t
gtctgcaattcccattctnnatggtattgtttgtagcagttagagattttaattttgatggtatctaatttatcagtttttcttttttgtggcttgtgattctggctttctaattttacttaacctgggaaacacacacacactccagccaagttaaatacatttttatgtaagattctaaatcctgtgcatacttatttgtatacatattcnnatttttttctgtanaatatgtacctagaagtggaattnctggctcgaagaatgtatttt

SEQ ID NO: 5612 - DNA, 392 bp, Homo sapiens
aaaacttacgaattgtttatttccggaattttccatgtagtattttcagaccacggttgacctcaggtaactgaaacagcgggtaaggggggacaactgtacttccaggttctgcagcctgagaatgagagaagggactgtgcaggctgaaggcgtgggggaagagccagggccctggggagcagacgtcagggactaaactggaaggcaagcaggaagaaccgtgacccactccaaaccgccactgaagattgatcccaactgcaagccggtgccaagccccgcgtccacggaagtcacacagcctatgacgccttcctctccaaatggaagcaaagaggagaagaggctgctggagtcttcaattgcagccgtgagcaatctccaactgg

SEQ ID NO: 5613 - DNA, 354 bp, Homo sapiens
cctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtgg

SEQ ID NO: 5614 - DNA, 266 bp, Homo sapiens
ctgtcaggtggagcctgcaagcctgggagcatctgcatgacccataccacaccctgcccaggagcatatattacctggtctctgggtctaccttaaccatccgatgccgattgcgttgccggtcccaatactcatctagccggtgggacgaaaggtgcatgacatggcaggcgaggcggcttggggtgctggggtccggagtaaccatgatgctgaagcagtgcatctcagcccgcccccccgcagacaccacatgggcagtcagg

SEQ ID NO: 5615 - DNA, 300 bp, Homo sapiens
  misc_feature (1)...(300): n = g, a, c or t
ccagcactggctatgtagtanagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccag

SEQ ID NO: 5616 - DNA, 231 bp, Homo sapiens; identical to SEQ ID NO: 257

SEQ ID NO: 5617 - DNA, 240 bp, Homo sapiens
ccagcctacaatggggatgttgtgtttctgttcaccttcgtttactatgcctgtgtcttctccaccacgctggggtctgggaggaatggacagacagaggatgagctctacccagggcctgcagggcctgcctgtagcccactctgctcgccttagcactaccactcctgccaaggaggattccatttggcagagcttcttccaggtgcccagctatacctgtgcctcggcttttctcag

SEQ ID NO: 5618 - DNA, 252 bp, Homo sapiens
ccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacag

SEQ ID NO: 5619 - DNA, 79 bp, Homo sapiens
  misc_feature (1)...(79): n = g, a, c or t
cccccccccctttcctttttttttnnttttttttttnnttttttttttttttttttttttttttttttttttttttttt

SEQ ID NO: 5620 - DNA, 260 bp, Homo sapiens
atcgaggccgagctggggccgatgaagatgacaaggggcctagggcaccccgcccacctcagcctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcag

SEQ ID NO: 5621 - DNA, 269 bp, Homo sapiens
ctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtgacactaggacatctgtccaggaggctgggcggaggtgggcaggatgtgagaggtggggagtactggctgtgcgtggcaggacagaagcactgtaaagggctctccagccgcagctcag

SEQ ID NO: 5622 - DNA, 485 bp, Homo sapiens
ccactgcagtgaagttttacaggtctagtggttaggggcatccaggggtgtcccttccaatgtgaaagacaaactgttgcatcttgcatcctcatgcaaggaaggaagcacactgcctggtgagcctgtttgagttctgacatcacattctacatgtaggtgtattgctttgacccacactctaggtgacataggaggatgccagctttgagtggagcctccacaggaaaggacactgcagcagatccaggccatggcgcagtcaccatccttcagaccccctggtgctgaaagtgccagtggtggggtaagatttggggtggagctgaaccaagcaccagtaggagagtcacagtggagggcctgggattctggagtaaggccatgtcatccacagcacagaaatatgccccatccaaagcagagaaatatgttggaagcaacttttggcatgttactgtaggccctgataagatagaatgctt

SEQ ID NO: 5623 - DNA, 463 bp, Homo sapiens
  misc_feature (1)...(463): n = g, a, c or t
ctgaaaaccataantgtcagcggcaggagatcaatgtccccactcatgcagtgaggcagagagtgaatttcaccttcccctacttttttagtctattcaagccctaatggattgcatgaagcccaccaacactgagaagggcatgtgctttactcagtccatcaactcaaacactaatctcctccagaaacactttcacagacataccccgccatcatgtttaaccagctacctgggcatcccatggcctagtcaagtcgacacataaaattaaccatcacatagtgttccccacatacaatggccccacaaacaggaactaaacaattagcaaagctctatggctcaattctagaattgagggtgttaatctgttttctgttaaggaactctaggctctatgtaaactgaaactgtatcaaaatgctgacactaaaattagaaatgggaagaagtagctttt

SEQ ID NO: 5624 - DNA, 193 bp, Homo sapiens
ccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacag

SEQ ID NO: 5625 - DNA, 308 bp, Homo sapiens
  misc_feature (1)...(308): n = g, a, c or t
ctgacagttctccnnggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattcnncaaaagggactatccacggtgaagaggtggaacagganaanatancggtgtttcgggatgcaagccggttcattctcaatctcacaagcgtgaagccggaagacagnggcatctactt

SEQ ID NO: 5626 - DNA, 167 bp, Homo sapiens; identical to SEQ ID NO: 5425

SEQ ID NO: 5627 - DNA, 404 bp, Homo sapiens
ccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctgg

SEQ ID NO: 5628 - DNA, 504 bp, Homo sapiens
  misc_feature (1)...(504): n = g, a, c or t
tgctctttcagctntgaacgtcctttcccattctccatcatccacattcacctatcctgcctgccccagttaaaatcctgtttcttctaggaagtccctcatcccacccgcttaccccagggagactgagcttgttccttctcctagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccgcgactgattgcagcccctggtgaaatgagaaccctgtgggtcggaacaaagtttggattattttatgttgcaagtaaactaaaatctcaagtgaaactg

SEQ ID NO: 5629 - DNA, 517 bp, Homo sapiens
aaaaaagagccgtttgtccacttccagttcttttctgataatgaaaaacttaatccaatccaaaacagaattgctttgtcacgtatcaggttctgtgtgtgtatcaattcatccttatctcgaataagcagcaggctggattctttggtggaacaatcagctagactgttattccaagggttgacagtgtgagaaaataacaagcatttctctcggagttgctgccaatatattgggcagtttaagagacccggtctctctaaagtaaaaaacagaaataagaaataaatgttatatttctaacctatccctgacacaccacaaccaatcacacacacacaggtcattataaatgctcaaagtttttgattatcactgtgagaacaatgaatttgttataaagttgagatttttgagacctactgttcattctagtaccaagaattgggaattagtgaccagttatcttgagcataaatggaatcataaaatattaaaataggaaaacaccatcaga

SEQ ID NO: 5630 - DNA, 386 bp, Homo sapiens; identical to SEQ ID NO: 5435

SEQ ID NO: 5631 - DNA, 408 bp, Homo sapiens
  misc_feature (1)...(408): n = g, a, c or t
aaacattccacctnnttctcgcatgtgcaggtcaagtgtacagtagtgaaaacaacatgcaatgtcttcactgcagaatcataatacagctaggacattggtgttcttcccctcccaccccaaattaaaaactaattgctaaaaaaaattgcattgccaaacggcactggagtgaaagcttggcggtactctacgataaatgctcantttccagtgcatgaaataaaactatagcaaatgggaggctttggtggcatccaaagaagaaaaaggcaaaccanggggaaagagctgcagtctaaagtttggtctttacctgcccgggcggncgcccgngcaggtnctggtttagaggtgtggtgcttttggcagtgagtattgccttgaattcatggcaatgaattcaat

SEQ ID NO: 5632 - DNA, 374 bp, Homo sapiens
aaaatactgagcggtattgaatacttcgaagcagaacaggcaatgtgcagccctcatttatgagaaaaccctcaggaaactcccagggtgatgcttggagaagctgtgagttgagctgaagctggagaacttcctccagagcaaagggcttaagaaagaaagaagaactctaagctgggtctgctaacatcactccagtttagatggatcttggcagagagacatgcttgttcctctggattggaaagatgatttactctcgggaatcttctctgtcagcctgtacatctaaaggcatgaagcactcaattgggcaattaacattagtgtttgttctctgatggtatctctgagaatactggttgtaggactgg

SEQ ID NO: 5633 - DNA, 231 bp, Homo sapiens
  misc_feature (1)...(231): n = g, a, c or t
ttctctcttgtttcctctctatttcagcctagtatcanaaggccaggcgagactgcaacactgctcatcgccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagttttt

SEQ ID NO: 5634 - DNA, 284 bp, Homo sapiens
ctgtgtcctgccctcccttctggaggctggaggggagaggccaagcccttggaaaatgtagcaaatgtctggatgtcgcataagtgcgtgtatgtgcgggacaggccccgagaagctagtgactcctgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcag

SEQ ID NO: 5635 - DNA, 279 bp, Homo sapiens
aaaaattaattaacaaatgaagtatacatttccttccccaaaatatcaacaaatgtaaaaaatataaaatatctgaggccatgttttatcatgtcaaggcaattgtcccagaatgtaataaaacatttgaactgaaaacatgcacatattagagttttttttaattaaagaaagaagaacttttacgtagttgtgcatgaacaccaaataataattacaggttgttttaccagatgactattgaataatattgcttataaaatttgttggtacactttt

SEQ ID NO: 5636 - DNA, 433 bp, Homo sapiens
ctgtccagtgagtactctcctagtactggatacaaaggaagaggccacggcccacgatcttctgaactcacaataggtggaggctggggctctggcgccacctctgcggaatcccaagcccgcttcacacagccaagaaaatgttgctccatccctcaagcctcagaccaacgtttgcgctgatcaaggagggagagtctctgcactaccatcagcctgagtatttatgctctgcagagcccgtgggcggaggccagtcagatattaagaaactcagtagtaacaaatgcacgaaaattagtagacaaatgaaaaacgataacattttagagagtacatagaaccaaaacgaaccgtaattccgacagaaaaacatggcgagaaaagaaaccgaaatgaaatgacactaagcaaatcttgaagagaactagcg

SEQ ID NO: 5637 - DNA, 175 bp, Homo sapiens
ctgagtgtggttgatttccttcccaccactccccagcccaccaagaagtccaccctcaagaagagagtgtgccggttacccaggccagagacccagaagggcccactttgtagccccatcacccttggcctgctggtggctggcgtcctggttctgctggtttccctgggagtgg

SEQ ID NO: 5638 - DNA, 315 bp, Homo sapiens
ccaagggtccctccaacgtggctggagaagcggtcagtgtcacgcagaaggagccggagcccctccccacggccatcccagaacaacaggccgatggtcactttgtctgggtcactgagcagcaggagacccgtcttgtccatggtcatcttcaggccgggcatcactgagaatagcgtctccttccacttgtacgcagagcttcttcggttccgagtcaccaccacgtgttcaggggatgcgtgaacccataccagggggttcttgaaggtcacttcgatccatgagaacccagccttctccctctcatactgg

SEQ ID NO: 5639 - DNA, 284 bp, Homo sapiens
aaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttaaaaaaa

SEQ ID NO: 5640 - DNA, 342 bp, Homo sapiens
ccacttgtgtgggtcctcacaagcaaagagagcactaaacttgacattgggggtccaccactccaaccttgctttctgaaggttttggtgtacattgagccccagaaggaaaggagagtatctgtgagtgggggcctcccttgacccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccag

SEQ ID NO: 5641 - DNA, 181 bp, Homo sapiens
ctggttggggagggcagcaaaacccacgtactccttgtccatgactccgccagccatcactgcacctgccgtctctccccacttcctctggtggggcaggaagctgagtgcggcttcaaccctccatccttcacacatctggattccaagtcccactgtagctccatcatcgtggtgagac

SEQ ID NO: 5642 - DNA, 551 bp, Homo sapiens; identical to SEQ ID NO: 258
  misc_feature (1)...(551): n = g, a, c or t

SEQ ID NO: 5643 - DNA, 71 bp, Homo sapiens
  misc_feature (1)...(71): n = g, a, c or t
aggtggaagccacagccattangtgtccccttgttggggggcggcgggagtgctggatttttgccctgtca

SEQ ID NO: 5644 - DNA, 231 bp, Homo sapiens; identical to SEQ ID NO: 259

SEQ ID NO: 5645 - DNA, 406 bp, Homo sapiens; identical to SEQ ID NO: 411

SEQ ID NO: 5646 - DNA, 296 bp, Homo sapiens
ctgggccacagacttgtccaggtcaacccgaaagctctcagcacaagaggttggttcctcaggggaagggtcttcctcttggatcaagtccaaggtcagcatcccatccgaggtagaggtggaagccacagccattaggtgtccccttgttggggggcggcgggagtgctggatttttgccctgtctcgagtgggatgggcaagatagctgtcctcctcaacggtgacctgaagagatgtactgtgaatcatgaatgctcttcagcgactcgctgtcccaacccagcatcccgagg

SEQ ID NO: 5647 - DNA, 238 bp, Homo sapiens
ctggcccctgcttcccctagggcacatgctggaagccctgggccgccaccagaggtcctcagccctcctgcctgggctatggctccttcctggtttgggagccatagtggagctttcctctctaagctcacccagctcaaactgtgacaggagaatcttcttcgactgccaagagcggtccaaggcaatggtcagccactgcagcctcctgagatatttttagagactggacctgagg

SEQ ID NO: 5648 - DNA, 470 bp, Homo sapiens
ctgctcctgcatctgtccaggattggtggctgtcagtgggagagacatgggaagatgctccctccaccttcctgggaccaccttgttgactcagcagccttcctcgccgcccaccatgctatgccttcctggatggaggccctgagggtggcttttggttttcctacccctgtacccctccaagaaagctctggcacactgcagaggccagcaactacttgtcaaatgaatcaaaggaaagtcaagccggagccaagggtcagaagcaggggcttgcttccccgaagtccagcccttctttgggctcccctttcctttttgacacctcctgcttggttggcagtgaggtctcccaggtctgggggatccttgccactgcttctgcacccagccctggctaagcggccttgttctcatcaaagctgccgagacctgcagggtactcagcttctacttccactcctacacag

SEQ ID NO: 5649 - DNA, 448 bp, Homo sapiens
tgcagctcagacacagcaaaagagcctagaacctgggtcctagtttgcacctagaatatgaggtactttgagccttgctaagaccacccagcccatctccatggactcatatgaaggacaagaagtgaacataacctgtagccacaacaacattgctacaaatgattatatcacgtggtaccaacagtttcccagccaaggaccacgatttattattcaaggatacaagacaaaagttacaaacgaagtggcctccctgtttatccctgccgacagaaagtccagcactctgagcctgccccgggtttccctgagcgacactgctgtgtactactgcctcgtgggtgacatggagtcttctggttctgcaaggcaactgacctttggatctgggacacaattgactgttttacctgatatccagaaccctgaccctgccgtgtaccag

SEQ ID NO: 5650 - DNA, 323 bp, Homo sapiens
aaataaccctgaccaccacatgcttgctatatcatgtgcatgatgagggaagccataaactatttcaaaggcaactttctagctatcgggtacgatgtcctctgggagagaccatggtgggtgacagggacagaggacgatccctgaggcaatggtaagtcaggtgttaggtagcaagggaagcagcctgggcatcaggtagagttgtgcaataaagtctgtgttttaagttcccccttcttcatttgccaacacaccaaccaggtgagcccacctttatgagtgactttggagaaagatgcttttcccattgctactgcagg

SEQ ID NO: 5651 - DNA, 163 bp, Homo sapiens; identical to SEQ ID NO: 3801

SEQ ID NO: 5652 - DNA, 165 bp, Homo sapiens
cctcagacaccaggatgttggccgcccgcaggtcgcggtggatggaattcatgcgctcaatgtatgccatcccttcagcaatctgcgccgacatgtcaatcagccttgggagtgacaatctgctcccttcatctgtcttcaggaaatccagcaggcatcctctgg

SEQ ID NO: 5653 - DNA, 561 bp, Homo sapiens
aaaaatgcattattccctcatccaaaagaccaccactttatcttaaagctacttggctttacaaaaaataaaaataaaatagaggattaggggaggaacagacaggaagaaaagaaattaaataaaaaatgaaagaaaaaaaaaggaccaatggaggatgaaggatggagaggaaacgcaggggaaggagagagaacgagatatggaaaggcaccaaatgtccaaatccctggacaggcagatgggctccttggtactgcagattcaccacagctacagacactgcagtgatggcactcagggcacgagccagaggggcagcctcagcagggagcagctcactgagcactgaagctggaatggcactaataacgtggtcagcctccagactgccgtcccttagagataccttccagcgcccttctgcctggaggctgagcccacagaccggctggcctctgagaacactgacccccctactagtcaggtgggtttcaagggcctgaggcaacatctctagacctccacgaagtgaccactggctccagcgctcagccaagg

SEQ ID NO: 5654 - DNA, 404 bp, Homo sapiens
  misc_feature (1)...(404): n = g, a, c or t
aaaaagcatatnccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcanggagcagtttgccctactagctcctcggacag

SEQ ID NO: 5655 - DNA, 357 bp, Homo sapiens
ccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccag

SEQ ID NO: 5656 - DNA, 201 bp, Homo sapiens; identical to SEQ ID NO: 5564

SEQ ID NO: 5657 - DNA, 207 bp, Homo sapiens
ccagagggaaggcccaagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcagcttcgggggtgacatttgtatccg

SEQ ID NO: 5658 - DNA, 265 bp, Homo sapiens
ctgtgaaacagaaggcactttgtgctagaattcagagggtctctcaagagagaacgccacagcagagagacccaatccgcctaagttgcaggcgaccctttagggtggggaggagtatcccccaggaaggcatctgcaaaggaaaaaattgtaatcatgattccaaggcaaaatggctaaagttgggagagaagaaataccaagagagaagacaaaacatggctgtgccaaggactgaggagtgagctttacaaggacttgtcag

SEQ ID NO: 5659 - DNA, 277 bp, Homo sapiens
ccacttgctgcctaaaccaatcacagcttcagttttgttttttgtcaagtgttggagttacaagtagacacctctctgtgcctggtattgctcaggttcagacttggctgggggtgagggggccaggcagaaatcagttaagaaggccattccaggtgtaaatgcctcccggctctacagggggtaatatttactgtcgtcttttcccttcccaggttgattactgacctgtttgttgtgaagatgctgctgcaataagcacaaacagaactcatgg

SEQ ID NO: 5660 - DNA, 269 bp, Homo sapiens
actgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggagaggtcctgtttgcatctgacccatctcaactggcccagcatcccaacttctctgcagcgaaagggtggcgccccgcagcctcgggagg

SEQ ID NO: 5661 - DNA, 247 bp, Homo sapiens; identical to SEQ ID NO: 2583

SEQ ID NO: 5662 - DNA, 244 bp, Homo sapiens
cgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaagg

SEQ ID NO: 5663 - DNA, 448 bp, Homo sapiens; identical to SEQ ID NO: 5649

SEQ ID NO: 5664 - DNA, 365 bp, Homo sapiens
ctacagataacatacatgataatatctgatttcaggacaaaagagtaattctcaatagcaagggaatggagtagggtagacagctagtaattaaactcacttgtatgttaaaaataaattaaggaaaaaaagaaaatgagagaacatattactaaataaagaaagcatacattaaatatttactatagtttcacactaagggaataaaggaaatgcaatagagtggcctgaaagataaaggatgagatgtgtaaagagacagggaaagatgtgtcatttttttactatgagcagcagtctgagaagataaaggaatcgagttatgggcaaacatgatgtttgatcagtgctatttgttttgaagg

SEQ ID NO: 5665 - DNA, 303 bp, Homo sapiens
ctggagatggcagccattgtttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggctgcctggaggcagtggctgagccagaaagtaacacagagctcatgcttggagagagagagtcttgg

SEQ ID NO: 5666 - DNA, 396 bp, Homo sapiens
aaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgcgtcacaagtctcagttcttagg

SEQ ID NO: 5667 - DNA, 158 bp, Homo sapiens
ccttctagcatggcatcaattccgatataggttcctgtacgcccaacaccagcactgcagtgcaccacaatgggaccactgaagaaattgctgaaggcattcactctccttctcagtttgaggagcaagtgaggatcctcaggcaccccgtggtctgg

SEQ ID NO: 5668 - DNA, 151 bp, Homo sapiens
acataaaattaaagtgtgtctcaaaaccagacagccatcttgtctgccatcactgagcaaattacagatggactcaatacaaatttgcccacggggcttgcttgcaatactatttcacaaagctgactgtattcttcatcttcataaatgg

SEQ ID NO: 5669 - DNA, 364 bp, Homo sapiens
gtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatattt

SEQ ID NO: 5670 - DNA, 115 bp, Homo sapiens
  misc_feature (1)...(115): n = g, a, c or t
aaanccatntataatccaccaccacctgttttttgggggacctgggacacatgaaacacananaggaaatttcatgggtactggatgaaacaaggaaggaaatgtttttgctcac

SEQ ID NO: 5671 - DNA, 587 bp, Homo sapiens
ccacatccctaaatgtcaacggcccctgaaacaaacaaacacaaacacacacacacacacacacatttacacgtgggcaaaatttatcatttgaattaaggtcaaatgagaaagtaaagaaaattcgttctgacttacaggaatgactgaaattatccaacaattttcaacacagaaatattctctaatgtattctctaactctgagagaagagaatggtataagatctacaacaccactgtatatatacttttattaatagtaaagtataaagctaaaggcataaacacaaacatgtacattttttagtgctatatttgccacacaaagaatgagttgtgtatatttttcagacaaaagatatgttgagttagaaggcacctctcaagttttaatgtgaacaataaactggagatcttgtgcagattcttttttcccagaagatctgaaataaactctgagtttctgaatttctaacaagttcactagtaatgccaatgtgtttggcccagaaagaatattttgtcaatatccagtaagtggaagaacctgtgttttactcaatttttctgccctgtaaacaaaga

SEQ ID NO: 5672 - DNA, 334 bp, Homo sapiens
aaagccatagtctctcaactctattgattggggttaataagactcacaaaattgtcaagcagaccaattaactagggacaaatttcaaacctaaaatttagtttgcgtgtaacgtgggactgacacaagtttggaaatcatggcaaaacatcaattacctaggactacaaaacattaatttcttcttttaagcagagagaatatggatttaattgtttaccataagaaaagtgacatatccaaccaaccatccatccccacctgtgccctattctttccttgtgtttctttagagccttttcagctatttcctgtgaagcaaactgcacgaagg

SEQ ID NO: 5673 - DNA, 225 bp, Homo sapiens; identical to SEQ ID NO: 3741

SEQ ID NO: 5674 - DNA, 317 bp, Homo sapiens
cctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttgg

SEQ ID NO: 5675 - DNA, 548 bp, Homo sapiens
ccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatatgtttatttatatctttatgattttattctctctctctattctcatggcactttcataacattatggctaa

SEQ ID NO: 5676 - DNA, 357 bp, Homo sapiens; identical to SEQ ID NO: 3776

SEQ ID NO: 5677 - DNA, 175 bp, Homo sapiens
  misc_feature (1)...(175): n = g, a, c or t
ctgagttcccttccccaaggtcagctcggggctcccgacgatcatgcagaagtagatgccactgtcttccggcttcacgcttgtgagattgagaatgaaccggcttgccatcccgaaacacagctatcttctcctgttccacctcttcaccgtggntagtccnttttgnggaatc

SEQ ID NO: 5678 - DNA, 346 bp, Homo sapiens
aaattaaaaagatataaacatgtcaaaggaatgaaacctagatgttttattatgtgtgaattatgagcgcttacctggccttgtgtataacgtataaaccttcacctgttgcatgtcattcagtctctgcagcaacattccttgtgtccatgtgggtgtttctatgtgtgactgtgaatatctgtatgtaaatggcttgtctcttgggtgcatttgtgggggtgggtatccaccgctattatcattgctttctttttcagaaagtgtttccaatctttgcttcattttactcaacagaaatgaggaggttggtttatatttcatgtcttttctctttcagatacag

SEQ ID NO: 5679 - DNA, 416 bp, Homo sapiens
  misc_feature (1)...(416): n = g, a, c or t
gcagaataaaaccancnnagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctangacgaagagaggagtacaatgttttggacaagagacgtggccgggaccctgagatggggggaaagccgcgtttagcttttgttgcc

SEQ ID NO: 5680 - DNA, 270 bp, Homo sapiens
aaaaatagctttggcttggaacttcagaagataggaaattttcgttattttatttattcttttttttttttttttttttttgagacagcgtctcactcccttgcccaggttggaatgcagtggcatgatcttggctcactgcaacctccatctcccatgttcaagtaattctcctaccttagcctcccaagtagctgggattacaggcatgcaccaccacgcccagctaatttttgtactttcagcagaaacagggtttcaccatgttgg

SEQ ID NO: 5681 - DNA, 278 bp, Homo sapiens; identical to SEQ ID NO: 260

SEQ ID NO: 5682 - DNA, 312 bp, Homo sapiens
  misc_feature (1)...(371): n = g, a, c or t
aaaatctcttnttcctcaggagtcagcttggctcccttcttgcggcccgggggcagngcatagngggactcgtaccactgtcggtacggnntgctgtcnnatgagcacgatgcantncttcaccagggtcttgnnacgaaccagctcgttattagatgcattgnngacaacatcgatgatccttgttttacgagtacaacactctgagccccaggagaaattccccacgtncaacctcagggcacggtatttcttgttacctccccgcacacggactgtgtggatgcggcggnggccaatcttggtgttggc

SEQ ID NO: 5683 - DNA, 220 bp, Homo sapiens
  misc_feature (1)...(220): n = g, a, c or t
aaaagatactttggattcaattaagaagagttttnnagaacaaaagaggaaggttctggcatggggagcntctgcaacccactgctgggtgccagaagcgagcntgtggagcggaagatgaanatggcaccatgtgtctcntaaaccacaaatggaaccacntgatttctatgtgtatttgcatttgcntgtaatgtgtgggaaatcatgaaggttacac

SEQ ID NO: 5684 - DNA, 209 bp, Homo sapiens
tgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtgg

SEQ ID NO: 5685 - DNA, 201 bp, Homo sapiens
ctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccag

SEQ ID NO: 5686 - DNA, 379 bp, Homo sapiens
ctgcagggcaaggacggttcaaaagtttgtgcgatttaattgctgtcatagcctgctccgccctgggatcgctggacaaggagcggccaaaggtcctgtgtgactttgtgacacacacatcatcagtcttgactgtgctggaacaagtcctccgcagcagcttatgcgttttggagattccgtcctgctcagatttcagtttggatttgcttttgccacaaccagggggaggataacttggcgacctgcgcaaagtagaaaataaatgcaggggagacttcactttcttctctgacaactttttattgtgcaggcaattggatttttctttgctctgtttccactgctgtgtaacaaatgtctgcatgatttttttcag

SEQ ID NO: 5687 - DNA, 225 bp, Homo sapiens; identical to SEQ ID NO: 3741

SEQ ID NO: 5688 - DNA, 357 bp, Homo sapiens
ctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcag

SEQ ID NO: 5689 - DNA, 236 bp, Homo sapiens
aaacagctctaagtgtcagtactcatagtggcatattacaaagtaataaacagtgcacacttgagggcaaaccgcatattgagctatggaagagctcactgtgattaagatgagatcaaacatcatagcagaacattagcaaattttatctgaattctgtaatgaacatccatgctgcaataacattaaaaaagcacgggagcctattccaaaccagcgagaacagttttgtgcaa

SEQ ID NO: 5690 - DNA, 270 bp, Homo sapiens; identical to SEQ ID NO: 2914

SEQ ID NO: 5691 - DNA, 289 bp, Homo sapiens
aaaattacattttatttctctttatgaatatttgctttttgttttttgtaaaaaaaaaaaaggttcattttacatcttcttcaagagtcttgtgcctcctggtaagtgcattggtttgtttcacagtactctccacgaccaaggacggttcttattgctggaaggagtgagtggatgtccacgccagggcggggctggaggacataagaagaatcggggccctggcaggaagcctggggcctgtgctccaacaagagcaaggaggctgaaggagcagaccggggctcag

SEQ ID NO: 5692 - DNA, 226 bp, Homo sapiens
  misc_feature (1)...(226): n = g, a, c or t
ctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgttnngttttgtatcttgtttttctgatcggagcatcactactgacctgttgtaggcngctntcttacagacncatgaatgtaa

SEQ ID NO: 5693 - DNA, 219 bp, Homo sapiens
ctgacaagaggcacagtcacagagctatgaggacagtcttatttaggcaaaccattcttatactcatgcataccagaaaaatgtctttgtctcttctgtgacactgctagatgctggagatataacacacatcgctgtccctaccctcacattaggggtagctgtaattatattctggtcaagaactgtgatgctaaatttcaattcttactagctttt

SEQ ID NO: 5694 - DNA, 315 bp, Homo sapiens
ccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtgg

SEQ ID NO: 5695 - DNA, 269 bp, Homo sapiens
ctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacgtctgtccaggaggctgggcggaggtgggcaggatgtgagaggtggggagtactggctgtgcgtggcaggacagaagcactgtaaagggctctccagccgcagctcag

SEQ ID NO: 5696 - DNA, 293 bp, Homo sapiens
  misc_feature (1)...(293): n = g, a, c or t
ccatgttcccccgtttgccctcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatanaccagtggctctgtgttctgatggggtannggggaggatntttacaaatgcnnattcctgagattgttcctggaacatctccgagtgggtgtgggttgtggccctgcgtgtgtgattttgcctat

SEQ ID NO: 5697 - DNA, 341 bp, Homo sapiens
aaattccagccctctattatcacataccccctttaagatttatggttctagtcacagcaagctctctgtaacactcattggattaggcaaagattgagtcaatcatcttgcaaatgtgttaatcttcaaaaataggctataaaagtgcaaaaccatgaaaacaaaatctagattatgtacatatggctcagcttgtgaacaggaaaaaaggtcaatagtgtacactttcctgaaacaaagcacttcattgcaatgccaacagactgatctcaaatgagttctcccttgtaacacaggagctaagacttctatcaaggaggacatcttacgttgcataattt

SEQ ID NO: 5698 - DNA, 352 bp, Homo sapiens
ccacacagactcaccaagccacagacttgtcttccacaggcacgttcttaccttagccacgaagtgaccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcg

SEQ ID NO: 5699 - DNA, 307 bp, Homo sapiens
aaagttaaaaaaactccactacatgccatattgaaagaaaaggttgtttttttttaactgcagcacctttagacaacaaaagattgcatcctgttcaaccacactatataaattataacgtttgtggaaaatatgtacacacaaacataaagcaagtgctctaacagttaataagtgttgtcttggcaagcagtttccagaaacaatactaacaactggtaataagaactgccaccattttgagttttccgttgctatcttcatcaaacaggaagcctgtaaacataagatgttaaaaaaaaaattt

SEQ ID NO: 5700 - DNA, 555 bp, Homo sapiens
ctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaat

SEQ ID NO: 5701 - DNA, 373 bp, Homo sapiens
cctgtctcctgaatgatagctgtaattatcaaacttctgaatgaagctttattgcaccatttacaaggattctccattatggtggtcctgagactactggggcatgctgagctatggctgaagcactgatgttatcttaaacaaatgttttccctcttccaagaatgggtgaaatttatcaccagcatggattcagagataaaatactcaaagggaagtgcttactatgtgcctcatattttaatgtgtctctcctttgtgaaccttcagatgagactgcattcatgaagactgagtgaagactttattgcaccatcacatcactaaggtttttctccaacatgaacattctgatgaagtcgaaggcttgagg

SEQ ID NO: 5702 - DNA, 354 bp, Homo sapiens
ccacgttggtttcactctggggcctctggaaggacgctgagcttaggtcgggccggaaggcgtcaatggcgtgctcacggttgttctggtccagcagcatgaaggtgaccttgttccggaagggccacggcagcagcgcatcatactcccctctcatgatcacgatgaagagcgacagatgggttctctttccagtgccatctccattcaggtacagccgcaggcacaacttgtagccatacttggcagtgtagaaggctggggagaagaggctgacggtcctgccacaggccgactcatggcaccgcctggtgacattggtgatcttccacaggaaagtgccatcgaaggagg

SEQ ID NO: 5703 - DNA, 495 bp, Homo sapiens
aaacggaatgaatgtggcttttgggggcaaaagaaaccaagacactacattgtctttattttctcctatcccagtgcatttgagaaccatgcataagggaatgctgtgctacaaagctgtacccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataagg

SEQ ID NO: 5704 - DNA, 212 bp, Homo sapiens
  misc_feature (1)...(212): n = g, a, c or t
tttttttttttnnntttttttttttttttttgggtacagnanattatttatttctgttatttnngaataaaatttattttatggcttaggatctatgacccctgccttganaggganaatgggataggggagtgaagggaagctggcggnggatggggcaacanaaaanatgcancaggcagggccctctcatacactggagggccacatgg

SEQ ID NO: 5705 - DNA, 322 bp, Homo sapiens
aaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaa

SEQ ID NO: 5706 - DNA, 270 bp, Homo sapiens; identical to SEQ ID NO: 2914

SEQ ID NO: 5707 - DNA, 274 bp, Homo sapiens
ccagagggaaggcccaagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcagcttcgggggtgacatttgtatccggccagccgagcggggaaaggagaccttgtgtcctggcaacagggagagccgggactgggatggacct

SEQ ID NO: 5708 - DNA, 291 bp, Homo sapiens
  misc_feature (1)...(291): n = g, a, c or t
aaaattctttanngagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtccccccccatcttacagaagttgaggccaagggagaatggtaggcacagaagaaacgtggcaaactgctctgtgctttcaaaccaaagtgttccccccaaccccaaatttgtctaagcactgg

SEQ ID NO: 5709 - DNA, 219 bp, Homo sapiens
  misc_feature (1)...(219): n = g, a, c or t
ccatgccacccntgtgcaaacagaggtgtacacacaggagtgcantgatacaggacacanataaacagaatgtacacagccttcaggaaggatctcaagggttccgagtctgaggaagacataaccttgtgcctgcctgcccacctctctctctggtcctgttcatctctcannctctgagacactgaccttcactgctcagntaaaggttccagggat

SEQ ID NO: 5710 - DNA, 284 bp, Homo sapiens; identical to SEQ ID NO: 413

SEQ ID NO: 5711 - DNA, 447 bp, Homo sapiens
  misc_feature (1)...(447): n = g, a, c or t
ccagttctggtagttattaaaccatgcattggaagaccctgctggaatataagatgcagagcacagaaagaaaactaagtgaagaaagaattgtttcggagccttgtaaggaatactcacgtcctccttctccaagctgggctccctgaagttggcaatttcatcaaaacagtatccacttaaaagtacccttaactttttcttccaaagttacacagtagccccaagttctacaatgcccacttcatgttttcctgaggcaccctggagacgccaaaagcatttgagaatgaacgggcctttntttttttttttttttttgagcccaggctggagtgcagtggtncgatctcggctcactgcaacctccaccccctgggttcaggtgatttttctgcctcagcctcccaggtggctgggattgcaggctcccaccaccgtgcgcgg

SEQ ID NO: 5712 - DNA, 325 bp, Homo sapiens
ccaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaattttt

SEQ ID NO: 5713 - DNA, 257 bp, Homo sapiens
cctaaaaagcaggggcttcatgcagatgcagcagggacactcccaccaagccatcctgggctttggtcatgggtcccacgccaagcacttggacaagtctgttaggaaagggggtggcacatgctcttccgccatctggaaaaacatggagatccaagggagggcggaaagggtccttgcaactcagtcagcttagagcctcttattgcttatttagtcagaaaagcctggctgggcctagacggcaaaagatttgg

SEQ ID NO: 5714 - DNA, 227 bp, Homo sapiens
cctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtacagtgtcctgggggtcaacgtgaccagcactgaagtctatggggccttcac

SEQ ID NO: 5715 - DNA, 424 bp, Homo sapiens
aaaatgtcatcaccatctctcagatagcaaatattcttttacatcatctgcacacaaacacctgagaacaaagagtacgatgcttttccccatctaacaagaagccaaggtgccacgaagtacagcagaattgcagtcctagtacctcgctgcgacactgctactgtacttgtttccagatggctaagctgaattcaaggccactaccatattgagctgaatgctcgctcagcaactcccaatgaaagcaagaagcatgtatcattgcccccgtctctaagagacacaaattaaggactgcgaccactttacacccactaaaacctacaagatacaacacaacccaattaccaccttcccttgagaaaaacatagaccgttttcattctgccgtttgttacttaccaatgccaaaattcttagg

SEQ ID NO: 5716 - DNA, 474 bp, Homo sapiens
cggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttctttttt

SEQ ID NO: 5717 - DNA, 373 bp, Homo sapiens
tttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatgg

SEQ ID NO: 5718 - DNA, 274 bp, Homo sapiens
ctggaagccttgttggcccctaagcctttgtttcatgctacagtactgaggggtatgtgtccccaatgcacagccacccgcacacaactcaatgagcttcctgggaaacactattcccccacctccaccttaggtggctgcctcagttttccaaccacaggaatcagtccctcagctcctgcctctagtctccaccccaaaagttcagtcgtctctgtcttggagggcactgtcggccccctcaggttgaagttcaacactcctcaatgagcag

SEQ ID NO: 5719 - DNA, 198 bp, Homo sapiens
ccagctcttacatagttaggtgaggaaagattagagtactatctttaagatgtaagtctggcattgtggaaagatggttccagtttctatgacctaccttggggaagaggaattcaagtttctgtggcttgccttcagggagaatgaggctgagacaggagggcaggattacatcagagaaaaactttgcttctgagg

SEQ ID NO: 5720 - DNA, 165 bp, Homo sapiens
ctgaagtggttaatcatggtgttacaactagacatttagtcctgcttcaattcttgcagagctgaatcaactcaaggaactaaataaaaagaggaaggcaccgaggtaagggattttttttacctgcccgggcggcgctcgagccctatagtgagtcgtattaga

SEQ ID NO: 5721 - DNA, 252 bp, Homo sapiens
ctgagttttatgaccttgagtaaaagtttaatctccctgggtgttcaagctcttttgccagtaaaatgagacaaatagtacctatctcatagggttgtaagaattacatgagatagttgatgaaaagcacttagaacagggcatagtacaccatatgcctactccattcgtttattgaatgtatctttagaaatgtatctttttcaagggcctgacatgtctcagacattgttttgaaatattgaggtacta

SEQ ID NO: 5722 - DNA, 356 bp, Homo sapiens
ctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcag

SEQ ID NO: 5723 - DNA, 154 bp, Homo sapiens
accacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaagg

SEQ ID NO: 5724 - DNA, 288 bp, Homo sapiens
  misc_feature (1)...(288): n = g, a, c or t
ccattctttataggaataatcagtttaatcaagatgagctagcattgatggagaaatnncaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaatttt

SEQ ID NO: 5725 - DNA, 357 bp, Homo sapiens; identical to SEQ ID NO: 5688

SEQ ID NO: 5726 - DNA, 409 bp, Homo sapiens
ctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctgg

SEQ ID NO: 5727 - DNA, 380 bp, Homo sapiens
ccatgatgtaatctgcaatctgctgtaatgctagtaatccagttgggttgtggcctttcttcatctgttcttgaataaggcattccaagtcttcccgaaaggcaggactttgcaggatctgagtaactcgtttcctctgctccatcatgttgaagtcttgtcgtagatcaggagacatgttcctctccctaatgtattctgggtcattttcattgatgcggtcaaaatatctctctttgtgaggcatgctgggaggaggaggagtggtaatcacgccttggctggcatccgagctcatgttttaagtctgtggattactcttgttataaaaaaattgaagtgctgtacatttcttaagctggtttttgtgtggcaattct

SEQ ID NO: 5728 - DNA, 443 bp, Homo sapiens
ctggtacacggcagggtcagggttctggatatcaggtaaaacagtcaattgtgtcccagatccaaaggtcagttgccttgcagaaccagaagactccatgtcacccacgaggcagtagtacacagcagtgtcgctcagggaaacccggggcaggctcagagtgctggactttctgtcggcagggataaacagggaggccacttcgtttgtaacttttgtcttgtatccttgaataataaatcgtggtccttggctgggaaactgttggtaccacgtgatgtaatcatttgtagcaatgttgttgtggctacaggttatgttcacttcttgtccttcatatgagtccatggagatgggctgggtggtctcagcaaggctcaaagtactcagggtcaggaacacgatcactctcgccacttgcctcatattctaggtgcaaacta

SEQ ID NO: 5729 - DNA, 328 bp, Homo sapiens
ctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccagagggccaggaactcgtggtgactgtcactgctcggtgcctggcgctgtctcagccagtagatgcgcatgttactgagggagattttagcctcgcaggacagcatcaccatcttgttggtttgcacctttatgtatgcaggggtctgctgg

SEQ ID NO: 5730 - DNA, 368 bp, Homo sapiens
ccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcag

SEQ ID NO: 5731 - DNA, 282 bp, Homo sapiens
  misc_feature (1)...(282): n = g, a, c or t
ctgtcagaactcatncnnatcccaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaa

SEQ ID NO: 5732 - DNA, 229 bp, Homo sapiens
ctggctaccgactccaccttctccctggaccagcccggtggcacccgggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgagg

SEQ ID NO: 5733 - DNA, 358 bp, Homo sapiens
  misc_feature (1)...(358): n = g, a, c or t
ctggaggctcccanncatactctttggtgagaaatgattaattttatattttcattttgatgagaatcttttcttgtttttaccagttataaaaacaaagctttttctttgttgtgatactgtgcactaagacttagtttcttgagctgatgctaaataaaatgagatcaataggaatattccaggaggtcgtgagaagtttttagaaaggatggcatctacatatatatggagctctgaaaactgttggagagtatgacctgggactgaaactgtggagcacatagccagtgtcacaggctccgagagcagagagagtttgctctgggacctggaatgagtgatggagaaatgtttt

SEQ ID NO: 5734 - DNA, 152 bp, Homo sapiens
  misc_feature (1)...(152): n = g, a, c or t
ctgcagcgcgtgggcgctggagtacatttatctctggaacttgtcattggctttgtttggctctggaaacaaagacttgcctgggcctttccgatgtaaacttccagcccttggtgggtgggggagttnnatgaaggtgccgcgtccnggtg

SEQ ID NO: 5735 - DNA, 496 bp, Homo sapiens
cctgtgctgggtgctgaggctacaggggcacagcaaggctcttcccttgagaagccactgatgtcactgggtcactcgaggtaagcatgtttgaaagggctgaatcaaagaacaaggcaggaagtccacaaggccaacggaaggtcccagagaacaagcagagctcagaggctccgaaggcatcgaggaggagggtcagtattggcaagcaggagcagcccctcagctctggcctgccctcaggccacaccctggcccatgggcttcttgcacacccactgatagggggtgtcacaggtcatgtcattccacttctgctgaatttggacacagtcttcagtctgcccattcttgtgccgccagttgtcagactgattcttttcccaaaacccgaagacaacagggctttatactgttagatgaaggcagcatcccttcctggtgctgtggctcctagggagctgacatgggatgagtctagggagctgacttgaga

SEQ ID NO: 5736 - DNA, 117 bp, Homo sapiens
cctttattctattacacagagtagggctggggccagggcaggtcattctcaggctgcgtcagaaggtgcagagcgttcgggggacacaggccgaaccccaaagtgataataagttac

SEQ ID NO: 5737 - DNA, 328 bp, Homo sapiens
ccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagtgaggggtctccctgggcctcatggtctgtctcttctagcctcctgctcatgctgcacgggcctcccctccatcctgcaccag

SEQ ID NO: 5738 - DNA, 432 bp, Homo sapiens
ggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggccggtgcagatatctctatgattgg

SEQ ID NO: 5739 - DNA, 359 bp, Homo sapiens
ctgtgtcccctctgagggtggcatggtgaagcctgactcccagattggagagtttgccccatagatctcctcctccagcatggacaggaatctgccatccccagactagtactagcaagttgcttctgggccatgggcaagtctgccaggtagacgcccagatcccaaaaggcccatggagggagaggagggaccaatccaggaagccttcctggaaaaaaggggacaacagggaggatgtgaacttggggccaaatcctggtaggccagaaggagccttacttggggaagtgagtgaggatgagggtcctcttctcgggcaccaatttgtccttctccactcggaacttttccagcag

SEQ ID NO: 5740 - DNA, 263 bp, Homo sapiens
aaaatgcatgtattataatcatataatcataactgttgttaattcttgattatatacctagggacaatgtgtaatgtaagattactaattggttcttcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcag

SEQ ID NO: 5741 - DNA, 288 bp, Homo sapiens
  misc_feature (1)...(288): n = g, a, c or t
ctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgagcaacttattccatatgtggaagaagatggctcaaagaatgatgatcgggctggcccacctngttttgctagtgaagagaggcgagaaattgctgaagtaaataaanaactcaaacagaagantcaacag

SEQ ID NO: 5742 - DNA, 194 bp, Homo sapiens
  misc_feature (1)...(194): n = g, a, c or t
cctctgtgccgcaccattgaactgcaccatgtgctacaggggccagaagatgaacagactgaccttgatgagctgtgcacaaagtggcataaaaaacatgtggttacacagtgtgaataaagtgctgcggagcaagaggaggccgttgattcacttnacgctttcagcgaatgacaaaatcatctttgtgaagg

SEQ ID NO: 5743 - DNA, 198 bp, Homo sapiens
ctgggctaggtccaggtgctgggagcccacggtatcgtgaactcgtgatgtcagggttctggatgtccactgtcgccagccccagggagagcggacccactggagggcctccttggtctccacctggatgcaggggcaggggtgggagccctcctcttctctcttcattggctggtgttggtggtgggggtagctggc

SEQ ID NO: 5744 - DNA, 353 bp, Homo sapiens
  misc_feature (1)...(353): n = g, a, c or t
ccacatccacactgagggcctgtgtgtgaccatgctcaccttgcctcaggtctgggaagatccgaggtatctcctggagaagccatctatgatgtcattggggaaatgccgctagcaggactgtacgaggaaatcatggaggccgaggctgtgctccaagatgaggaggacggaagtgtggtgaaggtggacacagaagccgcagtttcaggggaggtgtctaacctcctggagggacagtctatacgtgcggagggaggacacagcagacctgtttctcagggatatgacgaggctgcgtttcctntggaggagatgacgttgtnaagcaacctgaggatgagatacaccag

SEQ ID NO: 5745 - DNA, 286 bp, Homo sapiens
ctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcag

SEQ ID NO: 5746 - DNA, 317 bp, Homo sapiens
ctggtccagaccacacagagctccaaagggcaggagccagaaacattgggtgaatggacagtcacagttgtttatggatgcattttctaaaacaacctctttaccttctttttcttggtccaagtacttctttatgttttccgctctgtccatgtatttggaaattttttctctgagattacatctcttagtattatctttggtacctttcagaacctgcaggagcagatcaatcccctcttggtaacacaccagagcctgcggataccgcgactccgaatctagttctactgcccgctttagcacagtggctgcag

SEQ ID NO: 5747 - DNA, 322 bp, Homo sapiens
ccaaacccctgcacgtggctgccgcctgggttttccaaggagagcacgccggtgtcgcttgctcctgggtttcttttattttttcctgttgttctatttctgggttaaagacagaacattttaagataattttccaggtcaaatacactcatttgatgtttttctttgtgaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtattt

SEQ ID NO: 5748 - DNA, 240 bp, Homo sapiens
aaattaaaattccatttaactaaagatggttaaccccaagaaattgtacagtagttgatttctgctatataatgccagtcctatgccatacaataagaactgcaacattagctgtcacttcctccattgctcttctggaccctaagggatgagggaggggactcagacacaaaacacaacccaaataaactgtgcagtgattcctaatagttataaacccaatctaagttgtccaaacag

SEQ ID NO: 5749 - DNA, 292 bp, Homo sapiens
aaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttagg

SEQ ID NO: 5750 - DNA, 401 bp, Homo sapiens
  misc_feature (1)...(401): n = g, a, c or t
cgtggggttttggctcaggaggacctcgtgggactgctggagcccatcaacacccgcatcactgatccccagnacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgnttcaactgctggaagatgaangctacaaangcttngngggctgagacacngtagagggcttgagttggctacgttcatnctgggatnngcggggccacccanaggctgg

SEQ ID NO: 5751 - DNA, 408 bp, Homo sapiens
  misc_feature (1)...(408): n = g, a, c or t
ccacagtaaaagagttaaaatttcataagtagaagtttagttatttaggcttgtaatttatggctctgtcacctangaattttaagactttgagtttttaccaacccaacttcacagttccaaaatcccaggatttataggaaaggcttcaaaactaactgtcaattctgatttgctaagcatttaagaatgtaaatattaaatcagcattcattttcatttaacatttaacatggaagtaaaaattctcactttttgcctaacaacaaaactagaaaactaagacatctttcaataagttcttaacactcactggacaatttctactgcaagtcatntcaactaatgggacaaagagatgtgggaaccttcccgtagtccaggataggaaccgctngactccttcac

SEQ ID NO: 5752 - DNA, 380 bp, Homo sapiens
  misc_feature (1)...(380): n = g, a, c or t
ctgatatcaaacaccttgcacaccagctcctctccgctgtgcagatgcacggcacgaaaaacgtggtctccctccagaggttccaacaataagtatttcccgatacaagaaacgcaatgcgacaagttcggagtctcgggcgggctcggggagccgaggttcgggctgaaactctggctgggctccgcggaccttatagacgacaactcttcgaaatcctgggttttgttccgcgatctcccatatctcgctattgtgatgggggtagacctgtgtatgttcatgantgtgaggatcgcncacgacaaacaaaaanaaacccgctggagagatgagtcnctggcgagtgcggctgcaggcgcctcggtgccactgatttt

SEQ ID NO: 5753 - DNA, 156 bp, Homo sapiens
  misc_feature (1)...(156): n = g, a, c or t
tattttattcttaaaacttaagcatggtaaaatgttaagctgttttcatccactgatattattctactataaaaagcccttcttgancagatttgatgataaaaangagaacattnctaaggtataattagagaagctgntgcntganaaatcatg

SEQ ID NO: 5754 - DNA, 339 bp, Homo sapiens
  misc_feature (1)...(339): n = g, a, c or t
ctgcgatatctactccagattccttgtaagtcaaactcctgggctgctggaggaaagctatggcacgaaagccgatgtctttcctataaattgctccctcaaactttatagcagctagtcctttcttggcttcctcaagggctgatatgaaattttcccggatggctgtgactgcaagaactctacccccatgagttactactttgccatttttgagggcagtgcctgcatggaacacctccagtcctagagcttgagcctcaggaaaccctagaagagagcatatttgacacatgattncaaatagcaacagtatttcacaccgtgaagtgatttacg

SEQ ID NO: 5755 - DNA, 186 bp, Homo sapiens
ccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcagg

SEQ ID NO: 5756 - DNA, 554 bp, Homo sapiens
  misc_feature (1)...(554): n = g, a, c or t
ccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctgcgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtnatgaagaaagagatatgcnaatgcgtntactgagctgaatgatcccatg

SEQ ID NO: 5757 - DNA, 230 bp, Homo sapiens
aaaaagggagattagaaatgtcagtcaagaagatcaacttttagtctagcattctgacatcaagtgaattcagtgtctgtggtcagggtgtgcaaacttatatgtttaggtggaaaatgtttgaatatcaccctgtggaagggctatagtctggaggtatctgaaaaggtctgacaagaacagcaacaatgtctttgcactaaaatctgaaaattcccaatgtaactttt

SEQ ID NO: 5758 - DNA, 217 bp, Homo sapiens
  misc_feature (1)...(217): n = g, a, c or t
cttttttttttttttttttttttttttttttanacaggaagtanaatttattggtgagtnttaanaggggggcancncattggaagccctnatgagtgcagggcccgccacttgtccagagggccacgactggggatgtacttgaccccacagccatctgggatgagccgcttttcanccaccatgtcttcaaattcatnancattgagcttggtga

SEQ ID NO: 5759 - DNA, 357 bp, Homo sapiens; identical to SEQ ID NO: 3776

SEQ ID NO: 5760 - DNA, 405 bp, Homo sapiens
  misc_feature (1)...(405): n = g, a, c or t
ctgtagctcatatttcatgttggggtcatgccgaacacccatgaagttgtagttccacgaggactgggcagggaccatgaagaagccaaggaaacggtccgacagcagcatctgcaccctctcatagtgtgaaggcaggtagcccttggggttgttgcccttgtctgtgttctggcggccccattcgtagccactgggggtcagcttgtaggccgtcagtgtacaggagcctggcgtgaagctgcatgtgatgataatgntcttctcgccatcccaagatgggttgtcagccatgatcttggcatgggtggtgacatcctggggtgataactgcggggactcattgggctgagtgtggatccaacctaagggttccatctncttgaggtactcatgctggggcag

SEQ ID NO: 5761 - DNA, 363 bp, Homo sapiens
  misc_feature (1)...(363): n = g, a, c or t
aaacaaatccaacnngaaattcttgangcaccttctnatataaaacacaagatgaatgcaattatcaatccatctgagaaaagttttnaatctaaatgaacatcattttttccatttaagtatattttacagaactttaataaggcaagacaaatttnnngaaaaaagatgtagatncaaaaatgatgtaaactaataatttatattaaaaaaccccaaagggatancangtggagatggnacanctcaaacaatgcctttttttaacctaaaacaganttgtgcacnagctgaagatgacaaacancttctagactctgcacagttttggttttttttttaacatctttatattacatgttt

SEQ ID NO: 5762 - DNA, 396 bp, Homo sapiens
  misc_feature (1)...(396): n = g, a, c or t
ctgagaaaattgatggagtatttgctgcctgtcagagtggctcttttgacaaactagaagctgtggtcaaggtaaagtcagcttactaactttggggaaaggaatattaagtcatcataccaaaagttttttttattataggatttaatagatgagggtcatgcagcaactcagctcgtcaatcaactccatgatgtggttgtagaaaataacttatctgataaacagaagtctattatcacagaaaaacttgccgtaagtaggtactttgcacatgtcaatggaacatttaactacctgaaggatgctaatttcttaaatttttctcgtaggaagttgacaaatgcctagcanatggtgctgatgaacatttgcaactcatcagcctttgtgcaa

SEQ ID NO: 5763 - DNA, 288 bp, Homo sapiens; identical to SEQ ID NO: 414

SEQ ID NO: 5764 - DNA, 442 bp, Homo sapiens
cctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcacccttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacag

SEQ ID NO: 5765 - DNA, 382 bp, Homo sapiens
cctgcaaaggctgcgttgtagaggaacacaatgtagaaattgcccagccagttgaagcgtccaaagccacccagcaggtcaaagcgagtgagccccagggttcgagagaagacaggaagtgctgagcttaggaccaggagacagacacagttcccaattatctgcgtcatggcagtgtcgtgccatctgggccgcaggctccggaagagtggagagctatagaagcccacaactgaggacaccattaggtaaaagatgagtacaacctgaatgacggcaccaaaggagcccagcttggagaaggagacctggcctaaggaggtaccctgcatgcctcggggcatggcagcctcatcgatgagcagctccaggatgtggatgg

SEQ ID NO: 5766 - DNA, 259 bp, Homo sapiens
ctgtacaaacagcgagcttcccgccttgtccaaagacgacaagatgatattaaagatgaatcttcggagttttcaagccattcaagtcagtccatcttgaagacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaagg

SEQ ID NO: 5767 - DNA, 333 bp, Homo sapiens
ctgtggagctaggccctgagaacacgaccaccctccctcttccctcagcctcaagccgctgaagccactgctgcttcgccgcctcgtaagcccaatggtcagagctggaggctagacccttcagtgcttgggttgagggccagggtgttagattggttcttggagaaggaacgagggcccaggattcttcagcttcttagtttttgacaaattgagctgaggccccatagtcctcgggagggacagggttgagtgccataagtcggcaaaccagggtaaaggtgacaggcagctcagccaagctgcagggggtggcatatacagaggacctgg

SEQ ID NO: 5768 - DNA, 261 bp, Homo sapiens
ccagtggaaagtctcttggagagactttgaggtttgtgatgacaaatcatgctatcgttaaagttaaatacatatatatacacacctagaatataagcagaatggaaaagttggcagggatgaattcaagaacattagagtgaatttttttcattacagaattgttagttcctttaggaacttagtctcgtagatgtatatatttaattagcataacttggacagcacaagattaatgctttaacttgtttgcaggagttt

SEQ ID NO: 5769 - DNA, 151 bp, Homo sapiens
  misc_feature (1)...(151): n = g, a, c or t
accacggggtgcctgaggatcctcacttgctcctcaaactganaaggagagtgaatgccttcagcaatttcttcagtggtcccattgtggtgcactgcagtgctggtgttgggcgcacaggaacctatatcggaattgatgccatgctaga

SEQ ID NO: 5770 - DNA, 303 bp, Homo sapiens
  misc_feature (1)...(303): n = g, a, c or t
aaatgattatggaataacataatatttagagcagggcagataaatcagttgaacctgcttattttttatttattgtactctttttcctgttgctgttcctttctgcaggagggaaaacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcancagcgtcccagcctccatcaaaacgaaaacggcgttgggatcaaacag

SEQ ID NO: 5771 - DNA, 357 bp, Homo sapiens
  misc_feature (1)...(357): n = g, a, c or t
ctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccagagggccaggaactcgtggtgactgtcactgctcggtgcctggcgctgtctcagccagtagatgcgcatgttactgagggagattttagcctcgcaggacagcatcaccatcttgttggtttgcacctttatgtatgcaggggtctgctggaggactgagttgccatgganaacagtcag

SEQ ID NO: 5772 - DNA, 207 bp, Homo sapiens
ccaggctgtagtaacaggctcgcatgcgctgctccacggtcaggaagtcggggcgatcctcccacttgtagatccagcagtcactcatgagtgcgtacagttcgggtggacactctggtgggcactccatccgcttgccctgctcgatgaaggccatgacctccggccctttcatcttcttgtagggcttctggccgtaggacaagg

SEQ ID NO: 5773 - DNA, 275 bp, Homo sapiens
  misc_feature (1)...(275): n = g, a, c or t
ctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctgntttngtagaagagctngagactgacgagtggcggtttaagcccatcgagcag

SEQ ID NO: 5774 - DNA, 280 bp, Homo sapiens
ccttcatgcacttttgacagctcagtacctgtgagaacagaagtgatgcagggactttttaacccacaatgcatgaggtatatggaaatgtctgtgaaagaaccaccagcagctagagggaccaggcaaagttttctcacagcaactgctgatgaaggatttcccacaccatcttcttccggaagagaggcatctggtgctgagtaaatgtgataggtttgtccctagaaatataatctgcatatttacaagtaaacattccacaatcactcccattcag

SEQ ID NO: 5775 - DNA, 302 bp, Homo sapiens
  misc_feature (1)...(302): n = g, a, c or t
ctgcccggccccagacccatctcttggattgagggtgtgtgggctggaaccagtgggtcactgtggcagcttcatctgagccgaaggtgtgggtcctctgtggctgtgcgattgacctcgatgggagggagcgttcggcccattttccttgttttcagtgctgcggtatcagtcagtgatctgaggaaatcctgtaggggaaggcaggctgcagtgaaaacaggagctggtgaaaccganccctctgcatctgcgaatgtgccctaggtgctgctgctggggacatggatgccgagcggagg

SEQ ID NO: 5776 - DNA, 129 bp, Homo sapiens
  misc_feature (1)...(129): n = g, a, c or t
aaagtgctattcattgatcttaaatgttccatgaactgttaaatttcttaagttacatanttactacaccacatttatgtgtatgttatgtcttaatagtcaangataggtatntacanttgataatat

SEQ ID NO: 5777 - DNA, 466 bp, Homo sapiens
aaataacaggctagatctgttttcccttaccactcattttgcaaaactcaactggcctaaacatttcgctcaatcttgagttctgcaggttggtccctgagagctaggttggccttgggaatttctgctcaattttaagttctcaagaatctgagggcagccgatttagactgaattagagtcatcctataggtcagaaagaaagaatgctagacaggtcaagagggccagaggttggttctgataatgccatatgacctcaggcacatctttttgagttttagtttccccatctctaaaaacggatgattggacaacagcaagcttaacagactttccaccttgaaaatacggcacttctctgacgcttagaccttaagtcctgaagcgttgttttctcagcaaaaacagtgcaaagtccttacaggaatctaaggtacaagccctgggcaaccatgaaaacttt

SEQ ID NO: 5778 - DNA, 255 bp, Homo sapiens
  misc_feature (1)...(255): n = g, a, c or t
ccatggatctcaaggaccccaaccgcccccggttcaccctgcaggagctgcgggacgtgctgcacgagaggaacgagctcaagtccaaggtgttcttgctgcaggaggagctggcttactataagagtgaagaaatggaagaggaaaaccgaataccccaacccccacccatcgcccacccgaggacgtccnccnagccggagtcgggnatcaagcgactgtttagcttcttctcccgagataagaagcgcctgg

SEQ ID NO: 5779 - DNA, 445 bp, Homo sapiens
ccacagttgtggggcagccaaacactccttcagggaaatgggaagagaactggtggctgctagggggtggggcaagtttcctggcagggaggtgtgtcccagggtcctgcacccatggcagagcccctgctctaatatccccttatcattcttatccctgctggaccccaaactccagagatgcccattaccttgttcaccccatgcccttagcctcagaacaggcactgtgaaggtggagccacagagcagcactggtgcggcggggaccgaggcaggaggagggacagcaggcggccctgggggagcctgtgtgttgttgccagcctactctctatctggccccagccgggaagccactcagaaatccctaagaacaatccaaagggagcctagccagatcccgggtgtcacaggacacagtctgacccagggttacgccagg

SEQ ID NO: 5780 - DNA, 338 bp, Homo sapiens
cctccaagttccggaccacggtcacctttttattagacgctctttgtgctagggtgatgtcaattggacagattctccctttcttcacaatgggctcttgtccgggaagggtcacttgataggcaggctgtaatttttccaaacacctggtcagaagactgtcccatggaagcttcatgactgtatgctgttcatttttctctaagatgcagtcacataggatgggatccaatctcacaagatttttgttgtctgcatcaaccaggtcatttttcttggcgtagttaatgacgatcgttcggacctcactgccctccagaaagctccccttcttgtgg

SEQ ID NO: 5781 - DNA, 508 bp, Homo sapiens
ctgcttgtaaccactgtgtttatgtcaaagcattcattttttttaggatatctggaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggggagtagtactttacacaattgcctctcccccacaaatcataattgtttcagtaaaatggttacttggtttttccaagaaaaaactcgtttttactcacttttggcctgtttgtttatttagaaactaatctggattcactccctctggttgatacccactcaaaaaggacacttctgattaagacggttgaaactagagatggacaggttggtatcttttaaggaaaaaatagggtaatctcagacaggagttgatatat

SEQ ID NO: 5782 - DNA, 188 bp, Homo sapiens
  misc_feature (1)...(188): n = g, a, c or t
ccacagttgtttgatgcattaaaagaaaataaaaaanagaaaaaagagaaaagaaaaaaaaaaagaaanaagttgtaggcnaatcatttgttcaaagctgttggcctctgcaaaggaaataccagntctgggcantcagtgttaccgttcaccagttgccattgngggtttcanagagcctttttcta

SEQ ID NO: 5783 - DNA, 372 bp, Homo sapiens
ctgttccttctgtgttttctccagtgtcctcacatcaaatccaggagaattaggagagaggagagcactgacttcagaaagatagcagatgaaaatgtgattcatttttattatgtgaggatgtagagatgtattctgtaatttgacttgatatcaaatattgtcacagagggtgtgtttcgttatagggataattatgtgctgaaagggaaactcttcaaggctattgctgagttctatgttttctccttcccatagcccttattgccttctaacataccatgtaatctagttatttattgttttttgtttgttaactgtttccccctgctgggatataagtctccagagggcaggaatctttgtcatttt

SEQ ID NO: 5784 - DNA, 330 bp, Homo sapiens
ccagacacacgtttgttgagtacctactatgtgtcagtcacgttccgaggtcactgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggagg

SEQ ID NO: 5785 - DNA, 339 bp, Homo sapiens
ctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacag

SEQ ID NO: 5786 - DNA, 429 bp, Homo sapiens
  misc_feature (1)...(429): n = g, a, c or t
cctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagnactgtcagctattatagacttgatcaaaacacaggaaaaggcaactcccaggaactttccgccacgattccaggatggatattacag

SEQ ID NO: 5787 - DNA, 141 bp, Homo sapiens
  misc_feature (1)...(141): n = g, a, c or t
ggtncacaattgngccctcagctccatggcccaggacatccttgggacagaaggaaattttcccaactatcaccacgctggtttcctcatctgggacanaatagngaaaaagagattgtttcaaacagatatcacctaaag

SEQ ID NO: 5788 - DNA, 486 bp, Homo sapiens
  misc_feature (1)...(486): n = g, a, c or t
ctgcatttttgaacaccatggaaccccaagcctttcattttgcctgggccacccgttacctccggtccagtgaactctccaggctggagaaggatctccctttggggggccgcagtccccagatcccctccgttcccgtgcctgggtcctctgcatctcctagttcccaggttgggcgctgccactgggtgctaccgctgggtacatgccagtagtaagtacctgcagcatcgtggatcttcctccagccaggaggcaggccagcctccacctccagactgtggtccccccacaagtcatctacaggaacaccgnattagagaggagggagcatatgatttgtgagttcagaataacatgctgtcataatcccctctccatccccaaaatgggtcagttcttaggctgaagatccaggctcctcaatcttgaagacatcacatgtnaagaccgggttcattcnccccctggtccctacacagagag

SEQ ID NO: 5789 - DNA, 323 bp, Homo sapiens
  misc_feature (1)...(323): n = g, a, c or t
ctggagcgagaggaggaagtcacaggccctgtcattgcgcctctcttcccgcngaaacgtgaanagggctggtgggtggtgattggagatgccaagtccaatagcctcatctccatnaagaggcntgaccttgcagcanaaggccaaggtgaagttggactttgtggccccagccgctggtgcccacaactacactctgtacttnatgagtgacgcttacatgggatgtgaccaggagtacaaattcagcgtggatgtgaaagaagctgnnacngacagtgattcagattgagtcctgaggcatttacttnttnggtaaagga

SEQ ID NO: 5790 - DNA, 146 bp, Homo sapiens
  misc_feature (1)...(146): n = g, a, c or t
tctaatcttggggcctcngacaccccaaatctatatattgaccantggaagttgatgaatttgttatcaaaattcnaagcccccatgggaaaccccctttctttcttgtggnagaatttccagntcctttacagntatttgaaant

SEQ ID NO: 5791 - DNA, 255 bp, Homo sapiens
  misc_feature (1)...(255): n = g, a, c or t
aaacattagtgttcatagcttccaagagacatgctgactttcatttcttgaggtactctgcacatacgcaccacatctctatctggcctttgcatggagtgaccatagctccttctctcttacattgaatgtagagaatgtanccattggtagcangcttgtgttgtcacgcttcttcttttgagcaactttcttacactgaagaaaggcagaatgagtgcttcanaatgtgatttcctactaacctgttccttg

SEQ ID NO: 5792 - DNA, 268 bp, Homo sapiens
ctgttcctgagagatgcaatatagtagtcatcgacatcatccttatcaacagcatcatcactcagacagtggtgaaagtctttcttcacaaggaaaaacaaagataaagaaatacatgagcattaatcagaaattttcaaagcttggattctaatgatatgcattatcattagacattcaaatgctatacatcttctgatgaagcctccttgacagcagtctacacttatttcacattagaatgcctagagaaatcctgactgcccag

SEQ ID NO: 5793 - DNA, 482 bp, Homo sapiens
  misc_feature (1)...(482): n = g, a, c or t
ctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcanagcaaggccctcagggagggtcatcctccatgttttgaaga

SEQ ID NO: 5794 - DNA, 254 bp, Homo sapiens
cctgccagatatttgtgagaaatctgccattcgatttcacatggaagatgctaaaggacaaattcaacgagtgcggccacatgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgcctttttt

SEQ ID NO: 5795 - DNA, 135 bp, Homo sapiens
ctgaagtgtggcttgcgtaaataactgtttattccaaaatatttacatagttactatcagtagttattagactctaaaattggcatatttgaggaccatagtttcttgttaacatatggataactatcttctaat

SEQ ID NO: 5796 - DNA, 205 bp, Homo sapiens
ctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctt

SEQ ID NO: 5797 - DNA, 141 bp, Homo sapiens
  misc_feature (1)...(141): n = g, a, c or t
aaaagtttgaagactctcacaggtaagtgcagctcaggatcctgtgagtgcagcagaaagtcttaagaaatggcaggggctggttgaacccagattttccattggctgancanatatccccagtaggtgtaaaaaatttca

SEQ ID NO: 5798 - DNA, 312 bp, Homo sapiens
  misc_feature (1)...(312): n = g, a, c or t
tttatttggttacagtgaataacctggacaaaatgttgagaagagttgttaaaacaagtttacattaaatatactaacaattacgtttggttacatatttgtaagtgatggttatttagaaaaactgcatagaaatccaaaccttaaatattctgcaaatcaaatcattagcttttctcttctctaataaagtagggtgactagttcttggattaatctanctataacattantgtancactctgattatcttatggaataattctctatctcatntaaccctcacaacaaccctngtaaagtatnatcccc

SEQ ID NO: 5799 - DNA, 131 bp, Homo sapiens
  misc_feature (1)...(131): n = g, a, c or t
ctgctagttgtgcttgctgggataaatcttcgatcttggcttccccaaaaactatgtaagtatctgaagcagggctcttgtagacatctggntttgtgatgacaaagaggatattcttagatttccggata

SEQ ID NO: 5800 - DNA, 504 bp, Homo sapiens
  misc_feature (1)...(504): n = g, a, c or t
aaaagaaattcagaaactaagcggttggagaggagcattggaaatagagggggatgctatgagatgggggttgggagcagagaagaaactgcaggagggcaaagtgtaactagcaatataccttctgtgatgctccagaaacacatgtctgctaagattaacttgattggagtttcttatgaaacaggctgatcatcaagatttttaactcaggtttcagtgaaaaaattggaaacttttacaagaaagatttgagaagtagaaggcaggcagcaaattttccagatattatgcttgcatttcaaattcctgtttcaggcttttcaagtaggcatgcacattcccaaagccatgatatttggctaaatacacaaggaccccagtcgcacaccgccatctcgctgcccggcagaaactgcagttgcagattcctcnacaaggcgggcaatgcccagttcggatccacanancttcccttgacctcttcncccttaacggtttcaa

SEQ ID NO: 5801 - DNA, 252 bp, Homo sapiens
gaaagatggcggctaccttactagctgctcggggagccgggccagcaccggcttgggggccggaggcattcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcag

SEQ ID NO: 5802 - DNA, 420 bp, Homo sapiens
  misc_feature (1)...(420): n = g, a, c or t
ccatgagtgacaggtggcctcttggtgggagaggtggggcagggggaaggcagctcccactagaccagggcagtatttaggggaaggaggcagattggagcagttggctgccaacacctggcctcactcagggagaggggccttgggcctggaagatatctgggtgaggtacccacaccatctgctgcaacctctgtgtatccattatgggctcgcgccattcacaggcatgaattgagcacctagtatgtgggaaaacaggggaaacagagatggcacagacatggtctccatccttcgggggctccagtctanttgggggagatcagagaagttccatttgccactctaggccaagctaggtaagcggnanagccatgaacattgtgggagcttggagganggagttgaccccttgca

SEQ ID NO: 5803 - DNA, 400 bp, Homo sapiens
  misc_feature (1)...(400): n = g, a, c or t
aaactagccacagaccaaactagatctgcattcatccagcgctggaattttatgctaaatactaaggtcctttatcttcttggtcagaagtaggcaacagtaaaagtggtgctttgttgcgccactgaaaccgctccctgggtgggtcttccccgtatcatgtgttggtagcacatgcaaacccctgcttttacggaaaggactgcttggaactttgggacctgtccagggctcatgtgctgtgcctccggataggatgaagctacagatgataaaacagctacgtataaaagcagatggattttgtatagggacatataaataggaaaggtcctggaggaagggacttatgcctgggccccaaagnccagtttacagtcacattcctgaccatacatcg

SEQ ID NO: 5804 - DNA, 265 bp, Homo sapiens
  misc_feature (1)...(265): n = g, a, c or t
aaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattatacaatttatatgcttcacatagcatgtcaacttttgactaagaattttgttttacttttttaacatgtgttaaacagagaaagggtccatgaaggaaagtgnatgagttgca

SEQ ID NO: 5805 - DNA, 223 bp, Homo sapiens
  misc_feature (1)...(223): n = g, a, c or t
cctcggtgggtcttgcggggcagcttcttggtgtgccaacgactggtgacccctttgtagcctttgcccttggtcaccccgatgacgtcgatcatctcatcctgcccaaacacttggttcacaggtacctgctgctcaagcctctcgcggcccatccagcttctcggccacagtncctccgttcacctgnatctccatcaggtgggccttcttctggcgcaga

SEQ ID NO: 5806 - DNA, 430 bp, Homo sapiens
  misc_feature (1)...(430): n = g, a, c or t
anaatatttacacttaaagacaaaacatttccacaattattacaattggtttcactaaatcagaagtgactacacattatctctacttttataccagaaaacaaaatgaagaaatcaacaaaatataattactaaaactccactgtggatcagggataaaatgtgtccaatattaactcacactttcccaataagtataaaaatgaatataacattgcttggacaacttgtttcaacagcgaatcctctattactatttgttcaataacatatataaattcaaaactggcaggtatgaaaaaaggttactttgttttttgcagatactgtacttgtaaaataaagccaaataaagcatatgtcacacataccaaagtcttacattttgcctttctaatacaagcaagtgaaatattaacacatagcattt

SEQ ID NO: 5807 - DNA, 518 bp, Homo sapiens
gataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtaaagtggttcttacgtagtttaacatagctataaattgagtttaacaatttataaactcaagagaataatttttataaaccctgttttccaatctgtcatttacttaaat

SEQ ID NO: 5808 - DNA, 388 bp, Homo sapiens
ccaagcgctcagatcggcaaggggcaccagtcttgatctgcccagtgcacagccccacaaccaggtcagcgatgaaggtatcttcagtctcccccgaacgatgagacaccatgacgccccaaccattggcctgggccagcttgcacgcctgaagagactcggtcacggagccaatctggttgactttgagcaggaggcagttgcaggacttctcgttcacggccttggcgatcctctttgggttggtcactgtgagatcatcccccactacctggattcctgcactggctgtaaacttctgccaagctccccagtcatcctggtcaaagggatcttcgatagacaccactgggtagtccttgatgaaggacttgtacaggtcagccag

SEQ ID NO: 5809 - DNA, 501 bp, Homo sapiens
cctgtaagcaaaattccttccaaatttccagcctctttcatttcattggtcaacttttcgatgtatctatttaactgagtatcactaaggaatttacaagcaaatgccactctgtcacgtactgcaactttgttttcatacaaaactccatcgtaagatcctgtttcacttgtcagaaatgcaaacatgacacacaaatacgggttatttagctgtaatcgcagtgtgctacacatttctctccaaagggagttcttctcatccgtataacccgataaagccattgctaccacattgagattcagatctcctttttcagaagatgccccttcattcaggatttggattgctcggcgaatatccaagttgaacaatgccacagcagcagctctttcccattccccttcttgtacaagggagttcaaaaatggccccacgtctacatccgttcctttctttatccacccacaaagctgtaaagctaagattctctcttcattt

SEQ ID NO: 5810 - DNA, 404 bp, Homo sapiens
  misc_feature (1)...(404): n = g, a, c or t
aaaaaattaactaataaaagcttttatatttaagaactgcaagtgtttcaaaactatgctgttttgtgttgttatagttgtaacatatttctcaattttcctgtttttcttttagtttattgacaagactacctggtcggcctaaattccattttcattcagtttttgggcatttgagatcaaagagtaagtatggnttctacagttacttcatttttctacttatctttttaagttttttctccaaattttgacttcttttatatgtatcatctatactcagcatgaagtccagttttttctattatatacatgttttcaattcgctccctgaagcanncttttaatttcttcatcttcnaataaatgaccatcaccaccttcaatgaatctggngacccttg

SEQ ID NO: 5811 - DNA, 375 bp, Homo sapiens
  misc_feature (1)...(375): n = g, a, c or t
cctgaggtgggtgtggggagagacagcacgttcccgtactggttctggggcccgcttcctgggggaggcgtcactttgaagaatctggcgggagaagaggaagtgcacggtgagggccgacttggaatggaatggcggacccactcaagattctgtccaggccttcagaagttaaacgtgatcacttgtgctgggacagccaatagaggagtctgagatgatcatttccaaggagttcttcacagaggaggtagctttggagctgggctttgaggttggncagtatttgaaacagtanagacggancaaagaacccctgggcagaggaaacagtaagtgcaaggcataaagtgaacgtggagggtgttaccgccg

SEQ ID NO: 5812 - DNA, 90 bp, Homo sapiens
  misc_feature (1)...(90): n = g, a, c or t
ccaggcacaccantgtggccttttgggtgtgggagatctctgcttctgatggctcaaacacagcgacctcgggtgggaacaccttgttca

SEQ ID NO: 5813 - DNA, 222 bp, Homo sapiens
  misc_feature (1)...(222): n = g, a, c or t
ctgacgcagctctgcctctttccgttttgccttcatctgctctttcagctcctctgtcaagcgctccttcttctctttcaacttgtctactgctttctcatcccagcgccgngccttggccttcaggtcactggccccaccagagatcactcctgacttctggaatagggntccatccagtgccactgtcttgtggcgctggtggtctncaaaggcaatgcg

SEQ ID NO: 5814 - DNA, 419 bp, Homo sapiens
  misc_feature (1)...(419): n = g, a, c or t
cctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgnacgtaaaaactctccttttagtgngntattttcttggccttccctttt

SEQ ID NO: 5815 - DNA, 306 bp, Homo sapiens
aaaataatgcttatagtatcagtgaaggcttatggtaatgaataaaagaattctcatgagacagaaacaatgccccaatatctattatcatcaatctatctgtatttttttttataaaaatgcaatctacaactaaccaaaactcaacaggctctcaagtttcaatgagcccctttatattatcaattgtacatacctatcattgactattaaaacataacatacacataaatgtggtgtagtaaccatgtaacttaagaaatttaacagttcatggaacatttaagatcaagtgaatagcacttt

SEQ ID NO: 5816 - DNA, 444 bp, Homo sapiens
aaacaagaacttgctaaagaaacctcatcacaacaacgttttagggcctgatcactttaagtccatggggccattaatgaatatcaaccaaatgtctctttataatctgcaagccgtttttcctacaacaagaaggcgtaacatgtttccttgactcaggtgataacattagaaaagaaatcatgatttgtttcttttgctgtaacaggcagacactgcatttcttgctataatcaggaaagatggaacgactgctgcccttctcttgctgctatcaacagtttttcacgcattatctcaatgcttgaatagtccggcaacttaagatagttcacacaagtcattacagagggcaagaagtcatctgggttttctgttgattcaaacgtctttcggacaattgtcaaaggtggattcaaactccggaatcctccaacaggcaat

SEQ ID NO: 5817 - DNA, 314 bp, Homo sapiens
ctgctcggatcaggcagttctggagccataggagcgggatagaaaagccttcctgatgcaggctttgaccaaggttttcatttgaaaggactaagctaccctggacttgttctgcttctgagcccccttcttcttcctcttcgctgcttcctcaggcaggttttcctcttcttccagatcttcctggcaaaaatctttcagggactccgctccatttggcaagatggaggatgccaactttttctgccgtttccttgtacagctcccgccgctcagccaccagccccagagccaagagtttatccactattcgg

SEQ ID NO: 5818 - DNA, 246 bp, Homo sapiens
  misc_feature (1)...(246): n = g, a, c or t
cctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatanaatgagagcatccgagnttccctaatgaatctggctagttcntgtgtctgggctgangatacnggantgggacatccactctcggatccctcaga

SEQ ID NO: 5819 - DNA, 286 bp, Homo sapiens
  misc_feature (1)...(286): n = g, a, c or t
ccacaagatatgttctagagacgtccatgagtcctcttgctgtgtgggagcggcatccacagacttctggaataattggcctgtgaggaagctcatcaaagctgcaaacagtacaatgaatgcaatagagagccagagggccttattagcctttctgatggaggacttgagatttgttgcccaggaagctattgtgtcataaactgaagagacatcccactttgatggattatttttcttttcagaangacttggcttccttgncctttctactgtttcttctcca

SEQ ID NO: 5820 - DNA, 438 bp, Homo sapiens
gttctgaaaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgcttatttggcctggatggttcaggataatcacctgagcagtgaagccag

SEQ ID NO: 5821 - DNA, 341 bp, Homo sapiens
ccttaggacaatgggggctgtggcatgcgtcaggttacctgccttgatatgggatcgtgacaggcccctccctatgtgcaggagacaagcagcccaagaaacaggagaaaaacccagtgttggtgtccccatagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcag

SEQ ID NO: 5822 - DNA, 443 bp, Homo sapiens
ccaaaaacttcagcataaaaactatcctgtctgtgtattatatatatttattaccaaatttaataaacaaaaaccacttttgaaccaggtaattttatctagtgtgaaaagaaattaatcacatggtcatatactggctagtgctctctaaaagtagacattaaaatatttcataattggagggaatctttggagattagtggcatctaatcttggggcctcagacacccaaaatctatatattgaccagtggaagttgatgatttgttatcaaatttcaaagcacctaatggaaaccccacttcatctctgtgaagattttcagttcctttacagttatttgaaattatttcaattctgtggagccacttcagaaactccaatgggcctttgcaatattaaaatgtggagaatgcattaatcattatttaatcaatgagttt

SEQ ID NO: 5823 - DNA, 178 bp, Homo sapiens
  misc_feature (1)...(178): n = g, a, c or t
ctggcgctcctcccagcagccactcagggaaagaaagtggtgctgggcaaaaaaggggatacagtggaactgacctgtacagcttcccagaagaagagcatacaattccactggaaaaactccaaccagataaagattctggggaaatcatggctncttcttaactaaaaggtctcat

SEQ ID NO: 5824 - DNA, 502 bp, Homo sapiens
  misc_feature (1)...(502): n = g, a, c or t
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgttgacttggctctcacagtttatgcagacattggagagacaatttggttatttcaaacatcacaggatttgagtaagaagacctggttatgaaacaaggctctcataattactagttatgactgttgacaagttaccttttcttgtttacaagttatttggcctctttgaattacttgtaaaatagagatagggattctttcttgatcatggaacatcaaatgaagntatttgatgaaanactttgtcatctggaa

SEQ ID NO: 5825 - DNA, 503 bp, Homo sapiens
  misc_feature (1)...(503): n = g, a, c or t
ctgaagagtcctgtagagtagagtgatttttgtatctccaaccctcctcccaacttgaaacaaattctcaagcttctctggagcatcttttggtcacatgaccctcgatcatggtaacccttttgctaagacacatgtgacaccaaggtttcctctgacactgcttctctagggttcagatgacagcataaaacatcactggtcaaaaatattagatattaagaatgtgggcgtttatgttcgtaacagcaaatactttgtagggtgtgtcacccaaaggagcatttttgtcatttaatatggnccccggggagttagcccaaaatcatacaaataagcctttttctaaagacaggtcaaagttggttaatttaacagttgaggaaccgtctcatgccaattaaaaaattcttacttcccaactattcaatggtccaaaaagcaattaaatgtgaccattcagttntacacacatgcacacacacacacggagacgcgcacac

SEQ ID NO: 5826 - DNA, 333 bp, Homo sapiens
  misc_feature (1)...(333): n = g, a, c or t
cctggcctcttcagagtaccccccattccactttccctgcctccttccttaaatagctgacaatcaaattcatgctatggtgtgaaagactacctttgacttggtattataagctggagttatatatgtatttgaaaacagagtaaatacttaagaggccaaatagatgaatggaagaattttaggaactgtgagagggggacaaggtgaagctttcctggccctgggaggaagctggctgtggtagcgtagcgctctctctctctgtctgtggcaggaggcaaagagtagggtgtaattgagtgaangaatcctgcgtagagaccattctca

SEQ ID NO: 5827 - DNA, 502 bp, Homo sapiens
  misc_feature (1)...(502): n = g, a, c or t
aaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcangtttttttttn

SEQ ID NO: 5828 - DNA, 112 bp, Homo sapiens
  misc_feature (1)...(112): n = g, a, c or t
ctgtgtagtaaagatgccttctggtgaatttgcacgtatatgccgagatctcagccatattggagatgctgttgtaatttcctgtgcanaagacggagtgaaantttctgca

SEQ ID NO: 5829 - DNA, 101 bp, Homo sapiens
  misc_feature (1)...(101): n = g, a, c or t
ttccatttatctttctacagggctgacattgtggcacattcttanagttaccacaccccatgagggaagctctaaatagccaacacccatctgttttttgt

SEQ ID NO: 5830 - DNA, 442 bp, Homo sapiens
  misc_feature (1)...(442): n = g, a, c or t
ccaaggcatcatggtgcgtggtccccttgagagacttgccgttgatggaaagaacctcattgcccttctgaatagtcccttcctgggaggccagcccatttggaaacactctgtgaaccgtaatcaccttgttttctagatctgctcctcctgccaagctgaacccaagaccagcaccttcctccttgtgtaagatggtgacatggatgccgcctaattgctttaatgttgtttcatccagaaccttcacctcctcgatgagtttttttaattcttctgagctcagcagggagataacggactgaccagactgaagggaactgtggtccccatcatcgtcttccttggcttccgtgagaccctctgtatattctctcagctctgaaaggttgagcgagaaccctgtgtccaaggcagatgtttcagnaagaaccatttgcag

SEQ ID NO: 5831 - DNA, 123 bp, Homo sapiens
tacagttgtcctgatttcttattgaatttgttagactagttctcttgtcctgtgatctgtgtacaattttagtcactaagactttcctccaagaactaagccaacttgatgtgaaaagcacag

SEQ ID NO: 5832 - DNA, 285 bp, Homo sapiens; identical to SEQ ID NO: 321

SEQ ID NO: 5833 - DNA, 160 bp, Homo sapiens
catttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattattt

SEQ ID NO: 5834 - DNA, 523 bp, Homo sapiens
ctgtgcttttcacatcaagttggcttagttcttggaggaaagtcttagtgactaaaattgtacacagatcacaagacaagagaactagtctaacaaattcaataagaaatcaggacaactgtagactatataaaaactgtcttagaaaattatttacaactttatcatagtgtaaatactctaaatgtaaaataaatctatggattttatacaaaaatactctaaagtacaaatgtaagttaaatgctgaataaaacattttcaccttttccagtggatgctattactaagactataatctaggtgtcaaaacttaaagtgataaccacaaagcaatgttttcttaatcactcataattttacatttgttagtagtcatcacaaggtttagagttccactgaaaaagtctcatttttacaaatgcaactcataccactttccttcatggaccctttctctgtttaacacatgttaaaaaagtaaaacaaaaattcttagtcaaaagttgacatgctatgtgaa

SEQ ID NO: 5835 - DNA, 315 bp, Homo sapiens
aaattgaatttcatcactattctgtgtattctatttatcactattctaaatgactcatggttggctaattgattatcatgtaagcaagctatttgaagaaattgattacatatatttatatatagggggtaactaattaatgattacttgattaaattgctatgtgaactgacaactatttataaatcaatgcaatagactgttgtttgaccaaattattttactgaactgacaagtgggtttttgatttgtcagttgcttggctgaactgatcaagtcgatagttgcttgacaaactcaccaactttagaatgg

SEQ ID NO: 5836 - DNA, 527 bp, Homo sapiens
cctccatgtgggtggctatcctttatcaagatcccccccagggggaggaggattattagtcacattatcaaactcccctccaacccctttctctgcttagaggtatgtgtaatgtgtagtagaaagaccgaatccccacccaaaagtccttactgctactcatgtttttaaccttctgttctttaccctactccctaataatgaccgccatcatttatctactgcttaatggatactaggcactgtgctaagggttttatgttttacttcaatcttttcatcggctttattttgatagtttgttttatagaggaggaaacagacttaggtaagttacaagatgacaaggttactaccttgttcagttagtagtcagcagctagtatatccaaagatagtacgggtcagaactaggattataaactcagggctacctgaaactcacaacttcaggcatctttgatttcttcttttcacccacagccaaattctttcaacctaaaattgtatccattctgttttcaccg

SEQ ID NO: 5837 - DNA, 491 bp, Homo sapiens
cggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagagggggccccaactaccagtggatgcccttctcagggaagatgccctacccac

SEQ ID NO: 5838 - DNA, 452 bp, Homo sapiens
  misc_feature (1)...(452): n = g, a, c or t
cctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccananaaccccaggttcctgaccccctgttgtcctctcagcgcaggtcatatgcatttgaaacacaggctaaccctgggaaaggngaaggactgtgattaggaccacagccctgggcaaaagggggacccagcaaagttgtctt

SEQ ID NO: 5839 - DNA, 574 bp, Homo sapiens
ctgggaccataatttgtacagaaacactggatgtgattaatagggagtaggcgagattatagcaaaccagcagaaatggaactctgctaaatgtgcatccgtgaatgctcccttgaatgtggctgtgcaggattcagggtttgcagaaattctcaggacctcagacctctgtcctatgactaatgttactggcagagcaaataatctaaaggttttggttttgtggattaccatctccgtgctgtgcatctgaaggccagtgctgtgctggcaggaaaatagggactgagaaaaagcagatcctatactatagggactgtagtatctatgacgtagccagccattctttgctcccaaggcaagaagaaagagatgacggagtcaatatagggttgccaaatcggattttctaaaatgagtaggaagttggatttttatgtgcaacagtttcttttaatgctttgttgatatgtgattgtcatgcaataattattcatatttggtaagttttgtacatatattatgtacactcagggaaccaataccataatcatgataatgaacgtatccatcc

SEQ ID NO: 5840 - DNA, 577 bp, Homo sapiens
ttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacgcagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttga

SEQ ID NO: 5841 - DNA, 560 bp, Homo sapiens
  misc_feature (1)...(560): n = g, a, c or t
taaactgtggcgggatagttttcgggtccttgtccagtgaaacaccctcggccgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtggttgttccaattagctttgttgaacaggcatttaattaaaaaatttangttt

SEQ ID NO: 5842 - DNA, 443 bp, Homo sapiens
ccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctgtggatataaagggaagggaaacaggataaagagatcacaatctagacatggttcggagttccccctcatactcaagctgtaattcaccgcacatgctttgatagactgtacgctatagattagctcgctcggattttacttatgccgtccccgtgtgccacccgattctcacggaaagtagcctatttcttactattaacactctgacatcgaaattaagaaacctagacgactcaacccttgctctaactttcgcaaaacgcaat

SEQ ID NO: 5843 - DNA, 197 bp, Homo sapiens
  misc_feature (1)...(197): n = g, a, c or t
ctgctggggattctngtccatctcctgcttccagagccagctcacattgccggaggcgctgttcatgtagcagtgcattttcaccgtgaagccccgtttcctggctatgaaacgtgggctctgccagatccgcgaacaagcactacctttgggattccggtaccggtcctccgatctggctgctggtactggctcag

SEQ ID NO: 5844 - DNA, 605 bp, Homo sapiens
  misc_feature (1)...(605): n = g, a, c or t
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgttgacttggctctcacagtttatgcagacattggagagacaatttggttatttcaaacatcacaggatttgagtaagaagacctggttatgaaacaaggctctcataattactagttatgactgttgacaagttaccttttcttgtttacaagttatttggcctctttgaattacttgtaaaatagagatagggattctttcttgatcatggaacatcaaatgaagttatttgatgaaatactttgtcatctggaaattataaatataactaaatgttaattattatttgaaatttgggcacctcatggnggcattttctatggncatttttttcttttctcgcataatggctaaaagt

SEQ ID NO: 5845 - DNA, 99 bp, Homo sapiens
ttggagatctaggcagtgggttaagccagacccctaaagtgaccctttcctcttctgccctattcttctcagaccctcagaaagacatccaattttttt

SEQ ID NO: 5846 - DNA, 621 bp, Homo sapiens
  misc_feature (1)...(621): n = g, a, c or t
nctgntggttaacaagnggatcgtcatgttcagtantttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttggattagatgttctctatcatttaataatatacttgnggactaaaagatacaagtgctgtataaaatcagccaattatgttaaactagccatatctgcctttattggg

SEQ ID NO: 5847 - DNA, 591 bp, Homo sapiens
  misc_feature (1)...(591): n = g, a, c or t
ctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgctccacaaactgaggtagataatgctatgctgtcgttggtatacatcatgaatttttatgtaaattgctctgcaaagcaaaattgatatgtttggataaatttatgtttttaggnaaaataaaaactttt

SEQ ID NO: 5848 - DNA, 643 bp, Homo sapiens
  misc_feature (1)...(643): n = g, a, c or t
agtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtaagttgtgatagttcatcagattccaaaagttcatcatcttcaagtaggtgganggatagttcttagtggacttca

SEQ ID NO: 5849 - DNA, 313 bp, Homo sapiens
ctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagacgaaa

SEQ ID NO: 5850 - DNA, 354 bp, Homo sapiens
acaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttataa

SEQ ID NO: 5851 - DNA, 414 bp, Homo sapiens
ccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtgtggtctcttctcacctcagtttttctgacacagcgaatcgagggctttgg

SEQ ID NO: 5852 - DNA, 513 bp, Homo sapiens
aaaccataagaaaaacacaacagttttgggctgctgataaattaattcctctctgttgtaaacctaaaactaaacaaaaacaaaaatacccagagcagatggggagagggtgggaggcggaacacacactcatacacacacacacactcacgcacacacacaagcagtacacgttaagctctgcattcccactataggggttggtcctccagccacggagccagatcctactgaaggcaggggggaggcgggaagggatgtgtgtctgtgtgtgggatcttcataaagtctttggtgctaataaaggctgactgaagcagcaagtcctgaagccccagatccagaaagcaactcagggcgaagagagtagtatttttgctcatcctcataggagggggcttgcctcaccccagagctagggtcaaactgacccaggacccagggagtatttaatttgatttcagtacttgcttcattcccataaatcatgagaacatgatgcttttcaaattt

SEQ ID NO: 5853 - DNA, 581 bp, Homo sapiens
  misc_feature (1)...(581): n = g, a, c or t
gtggcctcttggngggagaggtggggcagggggaaggcagctcccactagaccagggcagtatttaggggaaggaggcagattggagcagttggctgccaacacctggcctcactcagggagaggggccttgggcctggaagatatctgggtgaggtacccacaccatctgccgcaacctctgtgtatccattatgggctcacgccattcacaggcatgaattgagcacctagtatgtgggaaaacaggggaaacagagatggcacagacatggtctccatccttcgggggctccagtctagttggggagatcagagaagttccatttgccactctaggccaagctaggtaagcggcagagccatgaagcattgtgggagcttggaggggggagtgagcccttgcagtcagggagaaggagtcagcctggggagacttccagaaagtagccctttgaccctgaggaggtggggatcagtcgtgatgaaagtaatagccattcagtagccccttgtaattcaccctgagccaatgcctggaggcaggagaaagtactcaaggctctggtgcctggaccacaa

SEQ ID NO: 5854 - DNA, 267 bp, Homo sapiens
taatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttgtgaacacgttggttggctggattcagtaataaatatgtaagg

SEQ ID NO: 5855 - DNA, 615 bp, Homo sapiens
  misc_feature (1)...(615): n = g, a, c or t
acatctctgcttctcatgctgctggncagcagcctctctccagnccaaggtgntctggaggtctattacacaagcttgaggtgtagatgtgtccaagagagctcagtctttatccctanacgcttcattgatcgaattcaaatcttgccccgtgggaatggttgnccaanaaaagaaatcatagtctggaagaagaacaagtcaattgtgtgtgnggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggaggttgcattcttattcatcagggaggaaagtttctttgaaaatagntattcanttataaggaatacaggattattttgattatatcttggtggttnaaggtt

SEQ ID NO: 5856 - DNA, 396 bp, Homo sapiens
ctgggattcctctgccagcagccctgccgatccctgggcccccggcagctccagcaagtggaactcgagcaataccagtatctttgggaggaggtccctctactgtcattgagaccagattctcccctcgcagcagcaccagaccgaggactcgcttctcttccctttctgcttgtttggagttctttggcttgatctttctgaactcatcacagtcacagaggatcaaattcatgtgcttgtcaaaagccttgaaggtgccaatgaagatccggccgtcctgcaggatgcacctcatcctgtaatcaatatgctgcagcatcttgctgctcttgcccaccgtcatggtggcggttctgatggctctgatacccgccggattcgcctcctcagagg

SEQ ID NO: 5857 - DNA, 361 bp, Homo sapiens
ctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcggacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacatttt

SEQ ID NO: 5858 - DNA, 321 bp, Homo sapiens
ctggcttccgagaggcaattctgtccttggaagccaggtttgaccatctgtaatcagccttgtgagaagtctcgtttgagggggccagggatggaacgggagggcgcatatcgtatgaggtatgggcattgtgttaagctgggggaagttgcagcttgtcctgaattacatggagaggaataaagtgggtgagtaggaggagccatttcatctgaaagcctgaggtccctctggtcccctcgataaaccccactggtgtcccaggccacaggtaacaggagaatagacatttaatgtcacagaatgtcagagcaggcaagg

SEQ ID NO: 5859 - DNA, 298 bp, Homo sapiens
  misc_feature (1)...(298): n = g, a, c or t
ctgtggtggcgccttctggagaagagcagagatacacgtgccatgngcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacag

SEQ ID NO: 5860 - DNA, 317 bp, Homo sapiens
cctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatgg

SEQ ID NO: 5861 - DNA, 551 bp, Homo sapiens
  misc_feature (1)...(551): n = g, a, c or t
ctcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaaganaaagattccccgatgctgatatttccactaanaacacctgcattcttcccttatccctgctctggattttagttttgggcttaattaaaatcttttccaggaaaaanaacttccccatacaaataagcatgagactatgtaaaaataccttgcagaagctgatgggggcaaactcaagcttnttcactccaggaccct

SEQ ID NO: 5862 - DNA, 349 bp, Homo sapiens
aaagaatttctttataaaatttactgtctaagattaatagcattcgaagatccccagacttcatagaatactcagggaaagcatttaatcttagacagtaaattttataaagaaattctttaaaagtaggacttaattctcctccgtagtgagtttttaagcagaggatatctactacatggattcctttgcctcttgacaggctcaagttccatctgcctcccaggcagctttttgagtctttcatagaagcctgcttttaatatatgccataattttcttcttaattcaagccacatgttcaaatttaaggcttaaattctcattccattgttttctaagaaatttt

SEQ ID NO: 5863 - DNA, 504 bp, Homo sapiens
cctgaaaataattttcagataaagagactccaaggttggctttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaatttt

SEQ ID NO: 5864 - DNA, 462 bp, Homo sapiens
  misc_feature (1)...(462): n = g, a, c or t
aaacaaattgcagagaatagagaaaaaaataggttatttacagaaaacaatatctacatatgtacttagaggtacaaatttggtgacagaaaagacttcagtatatgctggcatcttagaagcagttctcaaagagcttagttttattttcttgaattttaagaatgcctaagatccttcttcatcctcgatcttgggagccaagtagtattttaagtgtcccatatccgcaattttatactctacaacaaggggtacatctgcagacatactgagtgtcaccgttgaagagagtggagtggcttttgtaaagaagttcaggtacctcagtgcaaaagttagttgaactggttcattcatctctatggnaacagcttcctcctctttatcgacattacttgtcttgtgacaatttaatgtttccatttccaagttctccacttgcagaaaatttcactccgt

SEQ ID NO: 5865 - DNA, 342 bp, Homo sapiens
cttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacag

SEQ ID NO: 5866 - DNA, 395 bp, Homo sapiens
  misc_feature (1)...(395): n = g, a, c or t
ccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctanacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgnaagggctcactccctcctccaagctcccacaatgcttcatggntctgcgcttaccta

SEQ ID NO: 5867 - DNA, 494 bp, Homo sapiens
  misc_feature (1)...(494): n = g, a, c or t
aaacgcttcatgacagggtaattcatgtccaacatatcaaaaacatatttatagataactttagaaagaaaatacatactttttttgataatcacaagtagcaatgagattttctatattattttcagtctcactttagaaatgttttaattgtctaaatttaatcaattcatcgattaaaggaaagacaataaaatagtaaaattacatgtgtttatatataagtgtgtgtgtttcaaataacaaaacacaggttgtaaactaaaatcactggaaggcaaattgaagacaaaagtgatgctggtttaagttgtttggttcttcacataaattccagtttccaagttgtggtttacaactctagtaatatccagatagataattcaaccngcacttttttcttctattcctggttttctcttggtcacactgnaattttttgnctttttaccggaactggantaaataaaataaggacttcccagtcttaatac

SEQ ID NO: 5868 - DNA, 366 bp, Homo sapiens
ctggaagagggaacttccgagcccccaggggcggggtaaggcaaaaagggaacagcagtgttgaaagtgggaggccaggactgatggggaggagggttcccaaactccagagcagcctgaccagggctgggggtcttgggcaaatatctgaggctgcccatcctcacccaggacacccccactgagccctgaggatgaggggtgcccgtgggcagaagaagctctggacagcagcttcttggggtctggagaagaactggatttgttgagcgagattctggacagtcttagcgtgggagccaagagcgcaggcagcctgagaccgagccagagtttagactgctggcacagaggagacctggacag

SEQ ID NO: 5869 - DNA, 462 bp, Homo sapiens
ggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggcccgccgtggccg

SEQ ID NO: 5870 - DNA, 518 bp, Homo sapiens
ctggacgctggcctcctccagtccatcccaaagtctccacccgccgggagctgtcacagcccctggctccgctgcctgcccacgccgggctcagagcctggagtttctcgtctctctgccaaggcaccagggctcagcagtattcagaataatcttcctccacgtagttggcagggaaccagccaacccggccatagatctcccctcgccaccagccttgctgtcccttcttgttaaggatcttgatgatgtcaccctccttgagcgacagctctgatcggtctcgggcgcagaagtcatagcgggctttggctgtaccaaaatactttatgcttcccactgctggcctgctgatggttctcttttcaggctccttgaaggggaactgcaaggtggtgtccagagacttgaagcaatcctttagagagttctgctggtaaaactccaccagctccgtaagcccccggaaagcctttttctctgtgatccggtgcagtccttctgctgtcatgatttta

SEQ ID NO: 5871 - DNA, 494 bp, Homo sapiens
ccttttgggttaagccttacattcatgaagaacctcaagggtagatttttgagagcattccaaatgaatggtctctggtcaaatgaatgaatggtcaaatgaataaatctgccctcacagagatacaaaaggaaaaggaatataattcataccatttggtttaagccttacattcatgaagtacctcaagggtagatttttgagatcattccaaatgaagtcgaatctgccctcacagagacacaagaaaggaatataattcatacactattgcatttttaataaatcttttgaaatttgcagaattagattgtattgtgtattttcggttaaatgataattgaatgtaaatatttagatgcagcaccatattttataacccagctttagcatttcttcatattttaaggaaaccccccacctccttcttttaagggcgcttcttgctctctgaaatgccctgctaaatgcttctcttaattatttgaataagg

SEQ ID NO: 5872 - DNA, 418 bp, Homo sapiens
  misc_feature (1)...(418): n = g, a, c or t
ctgccttgtgtgggactgagaggcaagagttgttcctgcccttccctttgtgacttgaagaaccctgactttgtttctgcaaaggcacctgcatgtgtctgtgttcatgtaggcataatgtgaggaggtggggagaccaccccacccccatgtccaccatgaccctcttcccacgctgacctgtgctccctccccaatcatctttcctgttgcagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttcnaa

SEQ ID NO: 5873 - DNA, 225 bp, Homo sapiens
ctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccagg

SEQ ID NO: 5874 - DNA, 340 bp, Homo sapiens
  misc_feature (1)...(340): n = g, a, c or t
ctggggggtccgggaaaggggttgggccatgagccaggcagctccgaagcagtcactgaggccagggagcctgcacccaggtcatggggcgacctggctctcactcctggcctgggtgctcacctacagaccacttcacttcccctgtccgcagcgtcactatgtcctcataggtggctgtctggtcaatgtccaggccctcgtaggcgtgatcttcctccatgccagccttgctgtcatccttgtccagcagcaggaagataggcacgatgatgaagaggatgatcagcancgtctggatcatgatgataccatccttcagcgtgntcctctgcttcag

SEQ ID NO: 5875 - DNA, 592 bp, Homo sapiens
  misc_feature (1)...(592): n = g, a, c or t
ctgttgactcagattcggcattttaattacattgtttccaagtatgatattctgagagtgtctatagcacttagtgtctgcttcatataaactaccagttattatatatttatgatgcaagtagttttccaaatgtggtgaaagtctgagtctttttatccccatgggtaaaatctgaatctggctctctgtgtctctcagtgcttgtttattgctggtcagagagtaaattcttgataaaagctgttgacttggctctcacagtttatgcagacattggagagacaatttggttatttcaaacatcacaggatttgagtaagaagacctggttatgaaacaaggctctcataattactagttatgactgttgacaagttaccttttcttgtttacaagttatttggcctctttgaattacttgtaaaatagagatagggattctttcttgatcatggaacatcaaatgaagttatttgatgaaatactttgtcatctggaaattataaatataactaaatgntaattattatttgaaatttgggcacctcatggnggcattttctatggncatttttttcttttctccata

SEQ ID NO: 5876 - DNA, 392 bp, Homo sapiens; identical to SEQ ID NO: 67
  misc_feature (1)...(392): n = g, a, c or t

SEQ ID NO: 5877 - DNA, 118 bp, Homo sapiens; identical to SEQ ID NO: 311
  misc_feature (1)...(118): n = g, a, c or t

SEQ ID NO: 5878 - DNA, 496 bp, Homo sapiens
  misc_feature (1)...(496): n = g, a, c or t
atgggaagcccganaattggttcctatanacccggttcctgatgaattcccaggccaaaagaaccaccctgacaaattttgggttctgaaagtcttattattggacaagtatttgcatagcntagaagaaggaaaagggatttactcatcctgtagggcagcttagttgtcttgggcaaaagctgtataatggtaccacaaaaacagttacatggtggagttccaattacacagaaaaaaatccattcagtaaatttccaaagttgcagactgtttgggcccacccagaattgcactgggactggacngcccccactgggttatactggatatgtggacacagagcttatgctaagctgcctgatcagtggacaggtagctgtgtaattggcaccattaagccatctttnttcttagtgcccataaaaacaggnaaacttctgggcttcccagtctgtgcttcctgtgaaaaatgaagcatagccatnggtgattg

SEQ ID NO: 5879 - DNA, 310 bp, Homo sapiens; identical to SEQ ID NO: 462
  misc_feature (1)...(310): n = g, a, c or t

SEQ ID NO: 5880 - DNA, 356 bp, Homo sapiens
  misc_feature (1)...(356): n = g, a, c or t
gtagcaggtggtcagtatgcgtccacagaggtctcggggatcctggggggtgtagctgatctggttcacgatggtgcggacatcagccagcacttcctcatttccactcctcacngcttngnagacctggcagcacatggagtagatgaggcaggcggtggctgcgctgtccaccccgccactcaagggcagcaaaaaccctgcctgttgacttcntcttaaaaaatcccagagccagcaggnaggtccaaggcttatctcctcctcagggctgtggtatttccactcgatgggctcagagatgggtgccagcaagtcctcgtggnaccganagggcaaagtccaccttcactctg

SEQ ID NO: 5881 - DNA, 368 bp, Homo sapiens
  misc_feature (1)...(368): n = g, a, c or t
ttcagtagatgggactttcccggcagagccaatgaaaggccctattgctatgcaatctggtccaaaaccactcttcaggaggatgtcttcactggtgggccccacgcaaangtttnttcatngaggggaatctaagactttgggggctgtccagattatgaatgggctcttccacattgccctggggggtcttctgatgatcccagcagggatctatncacccatctgtgtnactgtgtggtaccctctctggngaggcattatgtatattatttccggatcactcctggcagcaacggagaaaaactccangaagtgtttggncaaangaaaaatgataatganttcattgagcctctttgctggca

SEQ ID NO: 5882 - DNA, 454 bp, Homo sapiens
  misc_feature (1)...(454): n = g, a, c or t
ccttgcctcagatccaaggtcactcggaagaggccatgtctaccctcaatgacactcatggagggaatgctgagagaagcattcagatgcatgacacaaggtaagactgccaaaaatctttgtcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgnggtaccctctctggggaggcattat

SEQ ID NO: 5883 - DNA, 221 bp, Homo sapiens; identical to SEQ ID NO: 310
  misc_feature (1)...(221): n = g, a, c or t

SEQ ID NO: 5884 - DNA, 294 bp, Homo sapiens; identical to SEQ ID NO: 3020

SEQ ID NO: 5885 - DNA, 412 bp, Homo sapiens
ctggggcttccattcacgactttctggtccctggcaggacagagcgggatgccaccagcttgtccaaagggaagttccaggagctcctggtgggcatcgttgtggagaatgacgcttgccccgggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgccaaaagaaaactgagtggggaataccctgcaggttcagg

SEQ ID NO: 5886 - DNA, 127 bp, Homo sapiens
  misc_feature (1)...(127): n = g, a, c or t
ccttgcctgtgaagctcattgggatgaattgcactctaatgaagcaatacattgagtttgtggcagacagacttatgctggaactgggttttaccaaggttttcanagtacagaacccattttgnct

SEQ ID NO: 5887 - DNA, 464 bp, Homo sapiens
ctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaaagcactccgggagaaactgcgcaccgggaagaccgactcaagggccaacttccga

SEQ ID NO: 5888 - DNA, 410 bp, Homo sapiens
  misc_feature (1)...(410): n = g, a, c or t
ctgccaccaactcaggactcaggggctcaattctcttctttggagcatattctgtagctcttcgaagcctgccaagtgtagcttccaaacttttaagtggtcttcttttggggggctttggttgntcgtacatttactgtgcttaattcaactttcatgcccttaataatgcctaacaagtctttttcgtattttccttttcactgtcttggctctctgaagtctccttggaagtctcctcagttcgaacagactgcttatctttcttgctacagatcacactgttagtgccaaaatatctttggatgttattttttgtccgggccaacancnctnaactgcggtacctgactgttccgtgccgaacagtgagtagcataatcgcagccgctgatgtctccgggcttcca

SEQ ID NO: 5889 - DNA, 262 bp, Homo sapiens
  misc_feature (1)...(262): n = g, a, c or t
aactggatgatggtcttcagcctctttctgtcccttctgtccctcacagcactagtatttcatgttgcacacccactcagctccgtgaacttgtgagaacacagccgattcacctgagcangacctcttgaaccctnggaccagnggtctcacatggtgctacgcctgcatgtaaacacgcctgcaaacgctgcctgccggtaaacacgcctgcaaacgctgcctgcccgtaaacacgcctgcaaacgctnctgcccacacn

SEQ ID NO: 5890 - DNA, 446 bp, Homo sapiens; identical to SEQ ID NO: 68
  misc_feature (1)...(446): n = g, a, c or t

SEQ ID NO: 5891 - DNA, 544 bp, Homo sapiens; identical to SEQ ID NO: 633
  misc_feature (1)...(544): n = g, a, c or t

SEQ ID NO: 5892 - DNA, 106 bp, Homo sapiens
  misc_feature (1)...(106): n = g, a, c or t
aaagtaagaaaatagttgctaccgatagggactttgccaantccaattatcttctaggattgaaaggtgcattttccccataaaaaaggcnaggaaaacccactgn

SEQ ID NO: 5893 - DNA, 270 bp, Homo sapiens
  misc_feature (1)...(270): n = g, a, c or t
atgcccgaatttcagtttggcacttacagcgaatctgagaggaaaaccgaggagtacgatactcaggccatgaagtacttgtcatacctgctgtaccctctctgtgtcgggggtctgtctattcactcctgaatatcaaatataagagctggtactcctggttaatcaacagcttcgtcaacggggtntatgcctttggtttcctnttcatgctgccccagctntttgtgaactacaagttgaagtcagtggcacatctgccctggaagg

SEQ ID NO: 5894 - DNA, 130 bp, Homo sapiens
  misc_feature (1)...(130): n = g, a, c or t
ctggagagagatcaatatgctgaacaaataaaaggagagagggcccagtggcagcagaggatgaggaaaatgtcgcaggagggccctttccccctgtgctttgggcangtnctgccattgaaaggangga

SEQ ID NO: 5895 - DNA, 329 bp, Homo sapiens
  misc_feature (1)...(329): n = g, a, c or t
cctacgtaggccaggaggcaccaagtgagtatgtgtatgtcggctgattaaaaatgaanacagcggctgagcacagtggctcacagcagcactttgggaggccgagctgggtgggtcacctgaaggtcaggagtttgagaccagcctgggcagcactggtggtgcctcagccatggcctggaccgttctcctcctcggcctcctctctcactgcacagattctgtgacttcctatgtgttgactcanacaccctcagtgtcantggcccccaggaaagacngccaagattacctgtgggggaaacaatattgggagtaacaatgtacac

SEQ ID NO: 5896 - DNA, 240 bp, Homo sapiens
  misc_feature (1)...(240): n = g, a, c or t
ccagcctacaatggggatgttgtgtttctgttcaccttcgtttactatgcctgtgtcttctccaccacgctggggtctgggaggaatggacagacagaggatgagctctacccagggcctgcaggacctgcctgtaacccactctgctcgccttagcactaccactcctgccaaggaggattccatttggcagagcttcttccaggtgcccagctatacctgtgcctcggcttttctcan

SEQ ID NO: 5897 - DNA, 278 bp, Homo sapiens
  misc_feature (1)...(278): n = g, a, c or t
aaatatgctgcatagactactggaccatattttgtagccattaaattttcaaaagactgggcccactgtaatacttcctccaaagtaaggtttgaagggggcctcttagattcatctctgnacattttacaactccaacaattccgcctgctcatttttctctaaaatgagaagagaaaaggcagcgntagaatatcatcaagcttcaaataaacaatgatcatttttttctcatgttggtggtataatatgtggaaacattccattgacaaatatat

SEQ ID NO: 5898 - DNA, 307 bp, Homo sapiens
  misc_feature (1)...(307): n = g, a, c or t
tgggaaattttaatattaagtatgtccatgattgaaagaatcattccaggaagtgtttggtcaaaggaaaaatgataatgaattcattgaccaaacacttcctggagtttttctccnntgctgccaggagtgatccggaaataatatacataatgcctccccagagagggtaccacacagncacacagatgggngcatagatccctgctgggatcatcagaagaccccccanggcaatgnggaagagcccattcataatctggacagcccccaaaggcttagattccctcatgaagaactttgcgtg

SEQ ID NO: 5899 - DNA, 400 bp, Homo sapiens
  misc_feature (1)...(400): n = g, a, c or t
ccactcggatcagctcctcgctcacctgaagccaagagaagaaggagagaagcaccaagaatcagctaacctcagaaaggtctgttttggagacacaggaggtactatttccagcagtcagnaggaagtgcacagcaccaatgcgaggaagaaaaacaatcccacttgcgcccaccagctaagggaccagggtctatgaagccccacagtggctccgacccaccatcatggcctgctggaccagggtgttgctgtgctcacacatgttcttcagaatcttgttggctgcattgtgccgggctgtcgtggtagacttagaagccactgtcagtgggtagatgagggcctgggggtggtacccgaccaatgtctgtgagaagctggngaatgaaacgtccca

SEQ ID NO: 5900 - DNA, 297 bp, Homo sapiens
  misc_feature (1)...(297): n = g, a, c or t
ccataggaaaaggatacagagtagagtttcatgaacctgaaacttggtggaaatttgatcctgaagaattagaaaagaggaataaacatggtgtgtctcgaaagaagattgctcagatgtttggatcgttatgaatatcaaatgtccatttctattgtaatgaattcagtggaaccatcacacaaaagcacacaaagacctcctcctccacaggggagacagaggtggggaggctctcttggctcacataatcgtgtctgngtcacaaataatcattaaattagctattttcagcta

SEQ ID NO: 5901 - DNA, 180 bp, Homo sapiens; identical to SEQ ID NO: 69
  misc_feature (1)...(180): n = g, a, c or t

SEQ ID NO: 5902 - DNA, 113 bp, Homo sapiens
  misc_feature (1)...(113): n = g, a, c or t
ccaccctaagcccgacagtggagctccttttccagattcagagctggnatcggagcggggagacctgggatagcaagttcagcaccatcgcctccagctacnaagagngcggc

SEQ ID NO: 5903 - DNA, 113 bp, Homo sapiens
  misc_feature (1)...(113): n = g, a, c or t
cctgaggctggctcatcggaggcgtgagtgttcggccctgccatgcctcacatccccaggatgccgcggcgggaactgggctgtggctttcctgccctggcactgcttgttan

SEQ ID NO: 5904 - DNA, 117 bp, Homo sapiens; identical to SEQ ID NO: 71
  misc_feature (1)...(117): n = g, a, c or t

SEQ ID NO: 5905 - DNA, 278 bp, Homo sapiens
  misc_feature (1)...(278): n = g, a, c or t
tctgagagtagacacttgtggtatgtggagtacagataagccaggggcaggccacggcacgctccatgaaagctaggagggagtgaaatatcagtgatcatcgnaaggaangaggcncacangagnaaggcccaccctgactcttaggactancagtcagaaccaggaggaaaggttttattgctatgcgggtaggnaanaacagattttacttacatccatatagttacttaaagcccagntttctgntaaacatttntcttaatatattgagccaa

SEQ ID NO: 5906 - DNA, 113 bp, Homo sapiens; identical to SEQ ID NO: 70
  misc_feature (1)...(113): n = g, a, c or t

SEQ ID NO: 5907 - DNA, 372 bp, Homo sapiens
  misc_feature (1)...(372): n = g, a, c or t
ccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggntttcaggcaccagtgtctgtgtngttagaactcanaggaagaggcang

SEQ ID NO: 5908 - DNA, 247 bp, Homo sapiens; identical to SEQ ID NO: 72

SEQ ID NO: 5909 - DNA, 222 bp, Homo sapiens
  misc_feature (1)...(222): n = g, a, c or t
aaagaccaatttgttctacctagcattttaactagtttttctgccggctatgttgaatgcacaaattctgtcacgcatgttcattcattgctacataatttggttcttctggaatatttttatgaagctctttggagtacagctatgaaaattaacaactgttaaaggaaataccttttttttttgtaattttttccttgaanaaccaaagtnttttttcaa

SEQ ID NO: 5910 - DNA, 442 bp, Homo sapiens
cctcagcatcgcctggacctgttcttgcttggggcatcccgtcggtcaccaaccatgacagcgaggcgggcctggcctgtgctccaccggagggggcttcttgcacagatgacctgctcatttcaaccccctccagaatcttctggcaggcgcagagcaacaggacgtccattttacagacgaggaaaccgagacacagggaaggttgccatctgcaacccagcccggtttttatcttgtttttctgtgttttaactttttatttagacttacagtttgaaacagtgctagaatcggaagcatgtaaagaaacctgtggaccttttatgcagatacacttaagtttttaacccatgtgccttatcactggggacctcttgcactctctctcatgatttttttcccgaactagatgaggatattgacaaagattcttgcttgg

SEQ ID NO: 5911 - DNA, 133 bp, Homo sapiens; identical to SEQ ID NO: 312
  misc_feature (1)...(133): n = g, a, c or t

SEQ ID NO: 5912 - DNA, 303 bp, Homo sapiens; identical to SEQ ID NO: 631
  misc_feature (1)...(303): n = g, a, c or t

SEQ ID NO: 5913 - DNA, 165 bp, Homo sapiens
  misc_feature (1)...(165): n = g, a, c or t
aggaaaaatcagcagancacaagatccatgggtcttacagaagtctccctggagaagggaaatttgagctggcatgaagaatgggcagaatttggtgatttggaggtcaaggaagntctaaaaaaaccaaaaggaagaaagaggagngggtcactgggaagctca

SEQ ID NO: 5914 - DNA, 150 bp, Homo sapiens
ctgtgttttgggaaaggtgcaacgagctccaggacatagagaagattatggctcagattgaaaggggagaggcgagaattcaaagaagaataagcatcaagaaagcacttgacacaaagaatggaccggtacaaagcaccttttcatcag

SEQ ID NO: 5915 - DNA, 290 bp, Homo sapiens
  misc_feature (1)...(290): n = g, a, c or t
ccacttacctgcacacctgtcctcttgagactgactcagatcctccagaaccttcaaaatggcctgctgctccagcccctatcagctctccttcccctgtgacccttttgtggaaaggagtgcttccttcctgatttcatatttgngaatctttactcttccctgctgaggtgacagaaagaatcagaatgtctcgagtgcctgtgctgtgtcatcacccacagtggggagagacaggcaggaaaacaagctccgacatccccggtagccatgggatggcgatgcacagg

SEQ ID NO: 5916 - DNA, 438 bp, Homo sapiens
aaaactctcacatggcaacaatcatggattattacgttttatatctcctcaggaaaacatagcaccaaacattaggagtgctatggcttcctatagagaacttccatctttggtcacagcgttaagagctctgggtttcacagcctcataagccctctttgaaatgacccatacaaatgtcttttctaatgcatacatacctttttaatgaaactgatccagttgtcctgtcagccctacataacaatagtataaaagtaaattttacatttccagagatgagtgtacagtgagtgaacatgaatgagtccctagaacgagcctgagttaactctactacaaactgcttggttattagcaacccacaagggttacaatataaaggcaaagcaaatttgcatgattcaagaagatctaggagaattttcaaatcttcac

SEQ ID NO: 5917 - DNA, 373 bp, Homo sapiens; identical to SEQ ID NO: 6

SEQ ID NO: 5918 - DNA, 361 bp, Homo sapiens
atcatggccgcagccgctctggggcagatctgggcacgaaagcttctctctgtcccttggcttctgtgtggtcccagaagatatgcctcctccagtttcaaggctgcagacctgcagccttcacttgggttcatgtaggaacaccaagtccctttcaaagcaccacatcttcctctaatcaatatttcttggagtccctagggaatgtcttacatgcattcaaacaatcaccatttctggagatacactacagggtcaccataaactctgctacccttaggttccatcactatggaagctgagtttcaccagaaggcacttttgtcctccattacgaccagcaaagccagctaagccacag

SEQ ID NO: 5919 - DNA, 203 bp, Homo sapiens
ctgctccaggaactgctcctgaggaggcccctgggcctctgcctccgccgccaaccccatcttctgaggatccaggcttttcttctcctctggggatgccagatcctcatctgtatcaccagatgggcctttcttctcaaacacatgcaggatgtgagagtcctcctcggtcacctgctcatggagttgagggaattatctgg

SEQ ID NO: 5920 - DNA, 425 bp, Homo sapiens
aaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtcccgcttctagaaagagtgcagaacaattacgaatagaattgaatgcccgaaaagttcaaaaattcctttacaaaaagaactcaagaaaca

SEQ ID NO: 5921 - DNA, 399 bp, Homo sapiens
  misc_feature (1)...(399): n = g, a, c or t
aaaagcatcagcagtttatctcatgcccactaaactatcctgcctcggtaccctttgttcatactttctgctctgtgtggaatgcccttctttcttcccctgttctttctcttagacccaaggggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacanatttggt

SEQ ID NO: 5922 - DNA, 334 bp, Homo sapiens
  misc_feature (1)...(334): n = g, a, c or t
ctgctgccagtggaatgctgggataaccccagtgtcgggggtcctggggcagcctgtgtactgctggatgcttgctttcaagtactctgctggggtaagactctggggcagtttccatccctttcttgggcttnagcttgctggactggccctgagaactgggaggggatggcttcatgaagtcattttgatgggggatgagnnatagttgctgtagaggaagaggatgagagagctgcttggcctctggaaggtgggaggagctgtcgcaggctgcacaggggctctgaggtcgagttcgtttagttcattgattaagcagtctaccaggtgg

SEQ ID NO: 5923 - DNA, 177 bp, Homo sapiens
cctccccaaccacgtggaactgttcagccggaacttgaggcactggacaactgtctcgatgtcagtgacgagccgggccagatggatatacagccggtcacccatgggaaagatcttctggaaagtccgtggtcaccatctgggcctggatcccgaagcgcctgtctgcagcgatgg

SEQ ID NO: 5924 - DNA, 372 bp, Homo sapiens
  misc_feature (1)...(372): n = g, a, c or t
cgcgggttcctcttgtgcaaaacggggtggcactccaatcgcctgcttggtgattgtggcccccacacacctgtttctacagcgcttaggttcgaacagtaaccctgtaaactaggcactgcttgtcccccgctttactggtgggaaacgggctcggagagaataaatgagctgccctaagcgactgggacagaaccacagttctcagccgggctttctgagcccacgctgccgccccagcagggatcaaatcacacagtgtgagataagcctcaagagcgggtggccttatgctgccactgagaactgattgggttcagttgcctcatcaaaatccctaagcatggttttgttttgtttttgnttttgttt

SEQ ID NO: 5925 - DNA, 424 bp, Homo sapiens
ccttttcaggagagtttagaatctcatagtaaaagactgagaaatttagtgccagaccaagacgaattgggtgtgtaggctgcatttctttcttactaatttcaaatgcttcctggtaagcctgctgggagttcgacacagtggtttgtttgttgtctccagatgccacttcagaaagatacctaaaataatctcctttcattttcaagtagaacaccttactttctggttgtgtagcattgggaataagatatttgtccaacagctccagaacatcattgcagatgtcctgcagttctgcctctatcttctcacggtactctttgcccatctgctgcttcttctcattcctctctgttttctgctcaatgctggagatgacacgccaggaagagcggcgggcgcctaccacattcttgtaggc

SEQ ID NO: 5926 - DNA, 371 bp, Homo sapiens; identical to SEQ ID NO: 74

SEQ ID NO: 5927 - DNA, 314 bp, Homo sapiens
  misc_feature (1)...(314): n = g, a, c or t
aaaaaaggaaacagaaaacagaagaaatcacttaaggagagctgtcattttctattggtgaggattcctgatcttggggaggttctggaaagttcgtctctgtttcttcttcttcctcttcttggattggnaataattncaatgcttcttcattctttggttgggaagatgtttcagttagcccaaccacttcttcttttatttcaatagtctgttcttttttttcttctgctgacagganaactatgntagatttgggtctggancacgttcttttccattcattctcaacgatgccagctattncaanttcc

SEQ ID NO: 5928 - DNA, 310 bp, Homo sapiens
  misc_feature (1)...(310): n = g, a, c or t
gaaaaagccagagaggagagctggggtccacctcgagaatcaaggccatcagaagaacgtgaatgggacagagaaaaagaaagggacagagataatcaagatcgggaggagaatgacaaggnaccctgagagagaangggacagagagagagatgtggatcgagaggatcgcttcagaagacctaggtgtgatgctctaattaaattatttgtagaggccgggcgcagtggctcatgcctgtaatcccagcactttgggagggcanatcacctgagctcaggagttcgagaccagcctggacctccgccn

SEQ ID NO: 5929 - DNA, 352 bp, Homo sapiens
ccatggtcacctgggtggcagcactgttacctggaaactgccactgcctgctcttctgtccctttgcccctttcgtggagcttttctgccagacgccactgagacagatcacaaggtattagaaaggtcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccag

SEQ ID NO: 5930 - DNA, 315 bp, Homo sapiens
aaaaaaccatcatcagagatcagtgtattctagattaagtaaatctggaaagagatgagccctttctaagagagaagaatctcatagctgctttgattgctaggggcatggtggaaaaaggagtgaacctaccatgaaagaggtaatgagaagccagtctatttattaatgaacttttcaaggctacatgtggactgtcatgacaggccagaatttggaagccctaattagtcataggagagtctgtacgcacccactaactcttcccatggacctgcaccgagtgtacctgggcactgtcctaaaaaggtgtgg

SEQ ID NO: 5931 - DNA, 293 bp, Homo sapiens; identical to SEQ ID NO: 75

SEQ ID NO: 5932 - DNA, 162 bp, Homo sapiens
  misc_feature (1)...(162): n = g, a, c or t
ctgacataatggtaaccagtcagaggagggcataactatgaaactggacaccttggttgtcaggttagaaggatggggtgtagggttggtaagaaaagaattcanggaagagcatcnatcaggattatgaagaatttcgncttgagaaattacagaggattt

SEQ ID NO: 5933 - DNA, 157 bp, Homo sapiens
aaattagtattggttaacagatttaacgtagaaaatggacatataaagaatacaaggataaatgtctacatgtaataatggatggtagtgatataatgcatttttgtcatcccatgctgaattcagtaaaaaataaagctaatgacttggagctttt

SEQ ID NO: 5934 - DNA, 228 bp, Homo sapiens
cttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaatttt

SEQ ID NO: 5935 - DNA, 354 bp, Homo sapiens
ctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggc

SEQ ID NO: 5936 - DNA, 265 bp, Homo sapiens
  misc_feature (1)...(265): n = g, a, c or t
ngtccacgctggtctcaagcaatcccgcccaccttggcctcccagagtgcttggattacaggcgagagccaccacgcctggcccccacctttcttttaggtcttaaagccatttgtataggcagtgagcctgttcccatcatcacacagtattttgcatggatggtggcacagagcctttataggaatatggatttttttttgnttttttgttccctcagcataggagtcatttgggaacctggcattatacgtaatgatttttt

SEQ ID NO: 5937 - DNA, 132 bp, Homo sapiens
ccatatgtgtaacctgtaccaaactaagctgttttaaatttacagactacaagcaactgaacccaaatgtctaaatgtacattcttttctgtactacatttcagctaatattgcagaactaatgacaatttt

SEQ ID NO: 5938 - DNA, 244 bp, Homo sapiens
cctgcagagccatggtgaccaaagtcttcccgcttctgccacgtcccttctgcctaccccacctccccatcaagtccctcaaaaagaagtgctcactggggtagcatgctccttgctgtccaggacagtcaccgtggcttcacagcactcttcctgggaggccctggctgaaccatcccgaataaccccagcaggggccacctgccgatggggctgggctgccaggagcagtgagacaggtcag

SEQ ID NO: 5939 - DNA, 339 bp, Homo sapiens
  misc_feature (1)...(339): n = g, a, c or t
ntttttctttaagagacagggtctcactctgttgctcaggctggagtgtagtggcgcgatcatagctcgctgcagcctcaaactcctgggctncagtgatcctccctcaccctcccgagtagctgggactacagtcacctgctaccacacccagctaatttttgtattttttgtagagacggggttcaccacattgcccggctggttgcaaactcctgggctcaaaccatctgcctggcttggcctccaaaggctaggattacaggcatgagccactgtgcctggccataaagcattatactttgtacctatactaaaaggcatctgagatactttcac

SEQ ID NO: 5940 - DNA, 111 bp, Homo sapiens; identical to SEQ ID NO: 630
  misc_feature (1)...(111): n = g, a, c or t

SEQ ID NO: 5941 - DNA, 195 bp, Homo sapiens
  misc_feature (1)...(195): n = g, a, c or t
aaacttttgagttgtagtcagaactgttgttggactgcatagttntcaaaagttttggtacatttctgactttagaaatctggggtaggaatccctttcatatgcatatagactatnttctgagcttttcaacatgttaagtggttctaatgtctgtatagntctttgccactgcatgtattgaaaggantacat

SEQ ID NO: 5942 - DNA, 374 bp, Homo sapiens
  misc_feature (1)...(374): n = g, a, c or t
nggccgatgtctgcaccaacaaaaacctgtccaaggtgcctgggaaccttttcagactgattaagagactggacctgagttataacagaattgggcttctggattctgagtggattccagtatcggttgcaaagctgaacaccctaattcttcgtcataacaacatcaccagcatttccacgggcagtttttccacaactccaaatttgaagtgtcttgacttatcgtncaataagctgaagacggtgaaaaatgctgtattccaagagttgaaggnctggaagtgcttctgctntacaacaatcacatatcctatctcgatccttcagcgtttggagggtcttccagttgcagaactctacttaagtggaaat

SEQ ID NO: 5943 - DNA, 274 bp, Homo sapiens; identical to SEQ ID NO: 313
  misc_feature (1)...(274): n = g, a, c or t

SEQ ID NO: 5944 - DNA, 425 bp, Homo sapiens
  misc_feature (1)...(425): n = g, a, c or t
aaagcagtaagtcttangtatacttacagtatgtctgtaagtcttatatactcagagaactccagccctgcctccttctagctgtgtgaccttgggcaagtgtctcaaattctctgtgcctcgaattatctgtgtctcaaattatctactctgtgagataaggagaataccacctaactcccagcatgttgggaggattaaagctttcttacatgctctactgcatgaacagggcccagaagggcatctgtgttaggccccatccaagtgtttctgatctggntgacccccagaccccactgagaagcaccacagtgtgctatcaggtacctgtctaaaccagggcagaggaacgagcacacccctaccacagncatcaaagggagcggcgactgaagnaagaagcatcttctagagactgatat

SEQ ID NO: 5945 - DNA, 359 bp, Homo sapiens
  misc_feature (1)...(359): n = g, a, c or t
ctggaagaggtgggagcccgcacggtcacaatacatgcagacacagagcagcaatacgaaacagaacagctcagagcggtcagctcctcagcagaagctgcgtgggccgccacttcccctttctgcaatcaccccatgatgtctccaccccacctcacatncagatggggctggatggcagagcagatgaagcctgctctgtggcggggcagcctaactgaaatgcacacctttatgggggaagtggacggacacctcacctcctcatgtttcacaccgtggactgcacttgagtnccagctcttcaccacatccctaggagtcttaagaggaaatcagtctgatttcttcagacagga

SEQ ID NO: 5946 - DNA, 179 bp, Homo sapiens
cctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttcttccag

SEQ ID NO: 5947 - DNA, 175 bp, Homo sapiens
  misc_feature (1)...(175): n = g, a, c or t
ccagtgagctggacctcatgccctacacacccccacagtctaccctaaagtctgccaaaggcagtgcaaagaaggaaggctccaaacgganaatcaacatgagtggctacatcctgttcagcagtgagatgagggtgtgattaagcccaacacccacactctcttcggggagcta

SEQ ID NO: 5948 - DNA, 300 bp, Homo sapiens
  misc_feature (1)...(300): n = g, a, c or t
aaaacaacacaagaagaagaagtcacaaagcaattgaaatgggagcatccgcttggagaattaagacagggtgctcctgagacagacttccaagacagcttctttgaagtgctgtgtgggggtaaatattcttcagcanaaganggcacaggtaagggccccgtgaaacacagttcttaatatcatctttatcttcccttaggataatataccccaanatactttgcatctataagatgtatacatcactgcagttcacgaaacacagtctgctgccaatacatatncatgttgcatggc

SEQ ID NO: 5949 - DNA, 256 bp, Homo sapiens
  misc_feature (1)...(256): n = g, a, c or t
tcgatgtaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggcccacctctacgctgcccctggncctcacctggtgctacagtccctggatcgaccaagcttattattttttagacaagattactgcgcgcntactng

SEQ ID NO: 5950 - DNA, 179 bp, Homo sapiens
cctcctttgggagcacacgaggctaccatggctgcagcaagaagccctggtcttcctgtttacgttcttgtcagaactcgtgccttttgagtctccccggtacctgcaggtgcacattcttcacccacccctggttcccggcaagtaccgctccctcctcacagactacatctcattgg

SEQ ID NO: 5951 - DNA, 246 bp, Homo sapiens; identical to SEQ ID NO: 632
  misc_feature (1)...(246): n = g, a, c or t

SEQ ID NO: 5952 - DNA, 308 bp, Homo sapiens
  misc_feature (1)...(308): n = g, a, c or t
aaacagctctaaatgtcagtactcacagtggcatattacaaagtaataaacagtgcacacttgagggcaaaccgcatattgagctatagaagagctcactgtgattaagatgagatcaaacatcatagcagaacattagcaaattttatctgaattctgtaatggacatccatgctgcaataacattagaaaagcacgggagcctattccaaaccagcgagaacagttttgtgcaaagagtgggtctttgtgtgnttgaactcccaccacgtaagggcaaactcgatatgcatgctaatgacctacaa

SEQ ID NO: 5953 - DNA, 263 bp, Homo sapiens
  misc_feature (1)...(263): n = g, a, c or t
ccacaaagtcttctcaagtgaaagtaggggagaagcggaaagctgctgatgagacgctgtgccaaacaaaggtattgctggacatcttcactggggtgcggctttacttgccaccctccacaccagacttcactcgtctcaaacgctactttgtggcattcgacngggacctggtacangaatttgatatgacttcgnccccacgtgctgggtagcagggacaagaaccctgnggccagaggntccagatgatttggnatnat

SEQ ID NO: 5954 - DNA, 194 bp, Homo sapiens
  misc_feature (1)...(194): n = g, a, c or t
aaaggagcatctcagttacgtgtggcggacaaaaaaaaggagcagattgtgacagaccattcccatcggccaagtggtcgaacccgacatccaagacccagcgagcagccaagctcagcgcaacctccggcttctcgctctgactncaaaagggtgagcacgtcgccctcgcgcacgggccttttacattgcgg

SEQ ID NO: 5955 - DNA, 274 bp, Homo sapiens
  misc_feature (1)...(274): n = g, a, c or t
nncgaggtctggcttgcctgctggcctgcttcctggagataggatgctcagacccaccgctgctcttcaggggtcgtggaaggaattaatgcacttccttctgtcccccaatctctgtcctttacgtgtctctggagctgagcangtattctttttctttcttcatctcagtagagcttttacttttatccagcatttcttagctcggttggcaaactggatatttatgcacctgcatttcacaatccatctccaccgattattcctggacctg

SEQ ID NO: 5956 - DNA, 184 bp, Homo sapiens
gtccaggaaagaaagcaatggagtgctcactcttatgatgcaggcaaaactgaaaatgtgtttttcttctcagggaagtgataagcctctcctgaacttctgcaattctgtgtttgcatgggcttggtatgcctgagctatttctacagcggttaaagtcctgatatgtcaagttgcctctttc

SEQ ID NO: 5957 - DNA, 201 bp, Homo sapiens
  misc_feature (1)...(201): n = g, a, c or t
ccaatttggggtatggtcctgtatgtttttgtaatgtcataatgggagctgcagtgttgtgcaggtatcaaagagcttcccagttttcatgttantaaacttggaaataattntctcatgcacctgatttttagcttctatnttaacaccgattattcttnaactntatgggagtaaatacccatctgtcattaactaaaa

SEQ ID NO: 5958 - DNA, 192 bp, Homo sapiens
gtctggggcccgtggggtcagagccaagcttccatgatcatttgatgacttccaggcaggtgggggtcggagatctccagtaatgagtgacacgtctggggtttccacagctctgactcaggtggtgggagagccacgtggaagggagagccaggcaataagtccgcataatgtgtgaggtggggagccagg

SEQ ID NO: 5959 - DNA, 272 bp, Homo sapiens
  misc_feature (1)...(272): n = g, a, c or t
nggccgangtctgactctagcccaaaagggaacaggagattctggagctgaggggagacccagcaaaggaacaacctggaagccttaccccacagccacaaaacctccccaatggaggaacaatctctaaaacttgattctttagagcccangctgcagcgggagctggacnggctacaggcagccctganacagacagaagccagggagattgagnggagggagaaggccangacttggactctcctagcgcagaccaagccagtgcagag

SEQ ID NO: 5960 - DNA, 235 bp, Homo sapiens
  misc_feature (1)...(235): n = g, a, c or t
gtctggagcagcagatagaagggacagggttgcacttataacaccactatcctcccagccctggttttatcatcatcatcgagaaaaatacaantaatcagcagtgatcaaaggtaagctaaacattccatttaactaacttaaatgngacctggcgtgccgtgccatnctataaatgacataacagaataagactcacttttaattccacctctggncaattcaagaanaaaac

SEQ ID NO: 5961 - DNA, 278 bp, Homo sapiens
  misc_feature (1)...(278): n = g, a, c or t
ctggcggtagaagcgcccggttctcctcggtgttctcggtgccaatggactgcagcccgcttggcaatgctcccagtggactcatctgcagccaggatgcccttgccaggtgccacgatgcggtgagcgatgtcagacagctncttcttctgctccggggtcagtgctggatattggtagggcatggtgctggtagtagcaagttccggtgcttcagaggaaattcttcttggaaatccagacggagnccttggttgtcaagagaaataaatctttgg

SEQ ID NO: 5962 - DNA, 268 bp, Homo sapiens; identical to SEQ ID NO: 314
  misc_feature (1)...(268): n = g, a, c or t

SEQ ID NO: 5963 - DNA, 212 bp, Homo sapiens
cctcctcatcaggacacattccccatcccagaggggggtcggcactcacgattgtgatgttggctacatccttgacaaagccgatggcctttccaggttggaacttgcaataaccatccttgccctggtaggggtaggtgtcttcacccatgatccccttgttgtacaggatatactcgaaagcctggctggggagacccccttggcagccg

SEQ ID NO: 5964 - DNA, 207 bp, Homo sapiens
  misc_feature (1)...(207): n = g, a, c or t
ctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgaactgggtgangtgccanaatccaccct

SEQ ID NO: 5965 - DNA, 221 bp, Homo sapiens
aaacttttgagttgtagtcagaaactgttgttggactgcatagttttcaaaagtttttggtacatttctgactttagaaatctggggtaggaatccctttccatatgcatatagactattttctgagcttcttcaaaacatgtttcagtgggttcctgaatgttcctgatgatagtctctcttgtcgaactgtcaatgttaatctctctaggggactggtg

SEQ ID NO: 5966 - DNA, 211 bp, Homo sapiens
ccaccagaagcctgggaccacaaaggctactgctgaatagaagtaaacagttcatccatgatctcacttaaccaccccaataaatccgattctttattttctcttcctgtcctgcacatatgcataagtacttttacaagttgtcccagtgttttgttagaataatgtagttaggtgagtgtaaataaatttatataaagtgagaattaaa

SEQ ID NO: 5967 - DNA, 206 bp, Homo sapiens
  misc_feature (1)...(206): n = g, a, c or t
ctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctantttcgtgggtgaggggctgaagggcctatgatgcacg

SEQ ID NO: 5968 - DNA, 212 bp, Homo sapiens
cctgggatgcagggagaaaggctgaccacaagttgagacaagatacagaaacaaacaaaaacagcagaaagtccgatcgatggtgtaagtgttgtgttcactgcttagggtgcaggtgagcttgatcgaggctcccagtaaggcagatgtagacgggggctgagtcagcacaggcagagcacagagacctgtggagaaaatgaagggcaata

SEQ ID NO: 5969 - DNA, 224 bp, Homo sapiens; identical to SEQ ID NO: 635
  misc_feature (1)...(224): n = g, a, c or t

SEQ ID NO: 5970 - DNA, 209 bp, Homo sapiens; identical to SEQ ID NO: 76

SEQ ID NO: 5971 - DNA, 220 bp, Homo sapiens; identical to SEQ ID NO: 634

SEQ ID NO: 5972 - DNA, 202 bp, Homo sapiens
  misc_feature (1)...(202): n = g, a, c or t
gaaggaggggaggaaagggagagaggaagagggagagtgaaggaggggaggaaagggagagaggcagagagggggaaggagagagggaaggaaggagagattgagagacaganaaattcctaaggggagctgtcaggtgggctggacatgggccccaggctgcactgctttatccctttgctgtaggaaagtcaagccagtt

SEQ ID NO: 5973 - DNA, 200 bp, Homo sapiens
  misc_feature (1)...(200): n = g, a, c or t
ccacccagttgctggtggacctggcagagggctgccacacacaccacttcaacagcctgctggacatcatcgagaaggtgagagccgttgtacccggggccgggtgctagcgtgccanagctccgtgggcagcaatggcctctgggccctctgtcctcctcttcgagtgaccggatggctgtgttcgtangtgaggctnc

SEQ ID NO: 5974 - DNA, 200 bp, Homo sapiens
ccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagcttt

SEQ ID NO: 5975 - DNA, 181 bp, Homo sapiens
  misc_feature (1)...(181): n = g, a, c or t
aaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttacctcn

SEQ ID NO: 5976 - DNA, 213 bp, Homo sapiens
  misc_feature (1)...(213): n = g, a, c or t
ccaggctggtcttgaacttctgacctcaggtgatcccaccttggcctcccaaagtgctgggattacaggcatgagccactgtgcccagcttaagatctctgttttaatgttaatgctggtcagttgtgtctggattccagagggaggaaggtagaatgaggcatgttgacacctccccttcccatcatggcctaagctggtctttttangtta

SEQ ID NO: 5977 - DNA, 105 bp, Homo sapiens
  misc_feature (1)...(105): n = g, a, c or t
aagagaaccaaacatcangggaaccaaagggtcacaatccccgtggcactggagaatacaaatatctttattagaccaccgataggaccctgagaaaacccttcc

SEQ ID NO: 5978 - DNA, 217 bp, Homo sapiens
  misc_feature (1)...(217): n = g, a, c or t
ttccgcgccgccacaatggtgcgcatgaatgtcctggcagatgctctcaagagtatcaacaatgccgaaaagagaggcaaacgccaggtgcttattaggccgngctccaaagtcatcgtccggtttctcactgtgatgatgaagcatggttacattggcgaatttgaaatcattgatgaccacagagctgggaaaattgttgtgaacctccaagcag

SEQ ID NO: 5979 - DNA, 226 bp, Homo sapiens
aaagaacttgcccaacatctcagaacaaatggaggaatcactattgaaacctaggcaatctgactcaggaggccacagtcttatatactgcattagaaagctttagagagccttttctttttctttgagaccgagtctcactctgttacccaggctggaatgcagtggcatgatctcagctcactgcaacctctgcctcctgggttcaagcaaattttctgcctta

SEQ ID NO: 5980 - DNA, 201 bp, Homo sapiens; identical to SEQ ID NO: 315

SEQ ID NO: 5981 - DNA, 396 bp, Homo sapiens; identical to SEQ ID NO: 77
  misc_feature (1)...(396): n = g, a, c or t

SEQ ID NO: 5982 - DNA, 202 bp, Homo sapiens; identical to SEQ ID NO: 78
  misc_feature (1)...(202): n = g, a, c or t

SEQ ID NO: 5983 - DNA, 183 bp, Homo sapiens
  misc_feature (1)...(183): n = g, a, c or t
ctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgncctganaaatctgaaaaaanaag

SEQ ID NO: 5984 - DNA, 219 bp, Homo sapiens
  misc_feature (1)...(219): n = g, a, c or t
ctgccagacccgccaacgatcacagcgtccccctgctgcaacactgtggtgctgcccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcnaaacttttattaat

SEQ ID NO: 5985 - DNA, 202 bp, Homo sapiens
  misc_feature (1)...(202): n = g, a, c or t
cctaacacccaagctcttccttgcagaagagctgagatgctaaggagaccatctggagtgtcataataagcccttgggatttgctgagctcccacatggctttcttcaaccacctggcccactttcttcaaccacattccactttggaatgcggtgtctttaaggcaccaagtgatcttaanaatgggctctgtttttgaat

SEQ ID NO: 5986 - DNA, 220 bp, Homo sapiens
  misc_feature (1)...(220): n = g, a, c or t
aaatttcccctttcctactacttccacagtgactctgaccttcccgtcgtaagttctctcagccgggctaaatttggcagtttctggttccatttcaagcaattctcgcacaggggaacggggtacatttgcagaaaacttttctattagtggccgcatcatgggatagtacacctgccagactgtctccagtgacatcccactatccatgtaatggnac

SEQ ID NO: 5987 - DNA, 209 bp, Homo sapiens
  misc_feature (1)...(209): n = g, a, c or t
ctggaaaagaaacctatctcagggatatatgacattatgccgagaccgggttcatgcactgattgatttgacaggtgaactgctccatgttgtgggaccagggatgtgaagcaagtacatcaaccttgaaacgcgcgcagttggtttgggagagccggcctgaggaagcccctgccccaaggctgcccacagagggaangattgtgtgt

SEQ ID NO: 5988 - DNA, 118 bp, Homo sapiens
aaaaaaataattcgtaaatgttacagtgttggtgttaaaacacaatatattatgatactcaagtaagaactcagtacctgaaaacaatgacaaaacatgccatgggatgtttatgctt

SEQ ID NO: 5989 - DNA, 182 bp, Homo sapiens; identical to SEQ ID NO: 317
  misc_feature (1)...(182): n = g, a, c or t

SEQ ID NO: 5990 - DNA, 127 bp, Homo sapiens
ctgtcaccttattgggggaaaaatgcctgaaaattagggggcacttcaagtagatagcttctatttcctatatttgtcttatatacaagtatttgcttttatcaaaataattccaataaagcatttt

SEQ ID NO: 5991 - DNA, 241 bp, Homo sapiens
  misc_feature (1)...(241): n = g, a, c or t
aaaaaattaattacttatttttggtggagaccagggtcttgctttgttgcccaggctggttttaactcatggcttcaagtgatccgatcctcctgcctgggcctccaaagcgttgggattacaggcaaaggcccagcccctaaggtcatgtacttaccaggtctggctcctggtctcaggagcccgagctgttctcttcctccccttccccgtcttcactctcagnctgaggccacgcccc

SEQ ID NO: 5992 - DNA, 356 bp, Homo sapiens; identical to SEQ ID NO: 79
  misc_feature (1)...(356): n = g, a, c or t

SEQ ID NO: 5993 - DNA, 149 bp, Homo sapiens; identical to SEQ ID NO: 80
  misc_feature (1)...(149): n = g, a, c or t

SEQ ID NO: 5994 - DNA, 140 bp, Homo sapiens
  misc_feature (1)...(140): n = g, a, c or t
aaatacacattacagtgttttatattatgtaatgctaagttgtaattcagcttttaacaaatctttttttaggtagtaaaaaaaaaaatactcaacaactaataggcccanagtttatttccaaatgagacactaaattt

SEQ ID NO: 5995 - DNA, 292 bp, Homo sapiens; identical to SEQ ID NO: 81
  misc_feature (1)...(292): n = g, a, c or t

SEQ ID NO: 5996 - DNA, 218 bp, Homo sapiens
  misc_feature (1)...(218): n = g, a, c or t
ccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaaaatgaagangagaaaanncaagaggaccaggagcataagaggangagaaggaagactcgccagnca

SEQ ID NO: 5997 - DNA, 110 bp, Homo sapiens
  misc_feature (1)...(110): n = g, a, c or t
ccaagaggtaccatggttgccattagtcagatatggaactgtggaggatttgcttgcttttgcaaaccatatatccaacactgcanagcattnttatggacaaagacnac

SEQ ID NO: 5998 - DNA, 240 bp, Homo sapiens; identical to SEQ ID NO: 319
  misc_feature (1)...(240): n = g, a, c or t

SEQ ID NO: 5999 - DNA, 215 bp, Homo sapiens
  misc_feature (1)...(215): n = g, a, c or t
cctcgagctcccttcagcgaggcaccttacgcatggaataggaggtttcacccacctgaaaccttctaaatacaatatcaatggtgaaaaaccaaaaacaagagagaaaataaaaacaagatcattagtaaaagttcaacaaagcaattgaaattctttggatgtctattacatatgggaatgaggacagtctcaagtctntaatatgggaaaca

SEQ ID NO: 6000 - DNA, 630 bp, Homo sapiens
  misc_feature (1)...(630): n = g, a, c or t
ctggccgatttacaccttgataacaagaagcttggagagatgcgcctgaaggaggcaggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccactttggtctgctctgcagttaaagatcctgacctgttccgtgacctggagatcatcccagccttactccacggggacctctggggtggaaacgtagcagaggattcctctgggccggtgatttttgacccacttctttctacggccactcggaatatgagctggcaatagctggcatgtttgggggctttacagcttcttttactccnctaccacggcaaaatcccaagccccaggattcgaaacgcttcagtgatagctnttactcttgaaccntgaatatttgatcgggtcaaagactcctgactatgagaattggcaatacggctnttgaagngactcgcgaccctaggnatcaccattggctctatgntcac

SEQ ID NO: 6001 - DNA, 341 bp, Homo sapiens
aaaaaaatctcaaaacatgttcaaacacattcagtagcaaagatccaccattggcacacacattaagaaagcacacacactaggcttctagttgggctaattaaaatctctatggctggaaaggtggttggttgtacttaattaagcttttttgaagtgcaaagctatgcataacagatgagcttgaaagctgcagagtttaagatagacttaatttttcatgattttcccaaagccaggtgatgatatttatttaatttgtggcttcagggtgcacctggaagaaacataagatacagaggcagagaccttaatgtaacttagtcagaaatacatttttt

SEQ ID NO: 6002 - DNA, 212 bp, Homo sapiens
aaaacacatcaattctatgaggtaggtattaaccctttcttacagaagaaggaactgaaccccatgaaggctacacataataagtggcagaggtgaaatttgaacccagatctaccaactccaagtttcttttcaatttgactataactgcatttgtgattgcttgtgacataagacatacgagagagtagatttgaattatgtataagcag

SEQ ID NO: 6003 - DNA, 335 bp, Homo sapiens
ccaggtacatgggccggatggcaaagagtgggaaggtgtgcaccttgatcatgatggtcatgaaggccatgtacagcagaaccttgatgaagcctgaggggaggggatgcagaaagcagcaggtcacagggccaggaggcagagtggaggatgctggtccagatcaggagaggcccaggcccctctcacctgtaaacagctctgtgtagagcatgtacacagccttgttgtcccaggggttctcactcttggaggtccacggagtgcagcacatacttgatgaagatggtgagcaccatcgtcatcaggatggcatactcaaagccaaacaccag

SEQ ID NO: 6004 - DNA, 247 bp, Homo sapiens
  misc_feature (1)...(247): n = g, a, c or t
ccaggatggtcttgatctcctggcctcgtgatccgcccgcctcagcctcccaaagtactgggattacaggcgtgagccaccgtgcccaaccatttgtcattttttattgtgggtacactagtgggtgttaagtcatatctgcttgtggttttgattttgcattttcttgatggcttgtgatgttangcttttcttcaaacacttattggatgctcttatatctttcnttacaaaaaggttattttcc

SEQ ID NO: 6005 - DNA, 187 bp, Homo sapiens; identical to SEQ ID NO: 545
  misc_feature (1)...(187): n = g, a, c or t

SEQ ID NO: 6006 - DNA, 367 bp, Homo sapiens
  misc_feature (1)...(367): n = g, a, c or t
ccaacaggacccgcaaaaaaccctgaaaattgagtgcctctgtatgacaggatgggaggtgagacaggtctccttataccctctcccacacattcatgtaaaaatagatagaatggaaaaacagactgcttgtgacaagaagatactaacttacaaacaaaacctaaggccacgcaaggcaaaagtaaagtcacgcctcaaaattcataatatctagagaaacaggtctgttttcttggntggnatggaatcaaagtgcagatagcagacccccttccttnctacctcctccaaactttanncaaactttcacactctcaaccagacctgnccgggcggccgcttcgaagggngaaattccanccac

SEQ ID NO: 6007 - DNA, 496 bp, Homo sapiens
ccagtgcagaatgctccagagccttaatgacagaggcataggagtctgagaacttcgtgtatttgcccacaagggcaatagagcaggtctccagcaagcgatcatatctgtcagccatctctttccatttcatcagcatttttcttggctgcctctcaataggaaggtcaagtcttcgaagaaaataatctacaaccccttgctcctctaacaacaaggggactcggtagatggatgaaacatcgtggacacagatcactttgttcaggctcaacatggcagaacattgatattttctccttcactgatgtgtcaagtggatttgagcacctgcatacaaccagatctggggaaagcccaagtcctctaagttcccgaacactattctgggtaggtttagtcttctgttcccctgttgaacttggctggggaactagactgacgtggatgttacaaaagttctctcttttgaccttgaattggaactgacggaagg

SEQ ID NO: 6008 - DNA, 264 bp, Homo sapiens
ctgtgacactactgagtataatttgcctaattcagcatactggtatttgattggaggacctggaccttcatctaaagacacaagcataaaagtagcaggtacactcaatttcagaagctgtgtcttctctgccacacctaaattggcatacattacaaacaggttgaaatactgctgtaaatgacgcccatgctctgaaacttcccttctcaagagatttagtactgctcttaataaagtggatcactcaagctttaagttgtc

SEQ ID NO: 6009 - DNA, 101 bp, Homo sapiens
tgaaaaaggaactgttcagcaggctgatgaataagatctaagagttacctggctacagaaagaagatgccagatgacacttaagacctacttgtgatattt

SEQ ID NO: 6010 - DNA, 227 bp, Homo sapiens
  misc_feature (1)...(227): n = g, a, c or t
ccagaggaagcacctggngctgaactaggcttgccctgctgtgaacttgcacttggagccctgacgctgctgttctccccgaagaacccgaccgacctccgcgatctccgtcccgcccccagggagacacagcagtgactcanagctggtcgcacactgtgcctccctcctcaccgcccatngtaatgaattattttgaaaattaattcccccatnctttcaaaatc

SEQ ID NO: 6011 - DNA, 132 bp, Homo sapiens
cctgaacaaggacctctgccctccctattcagacccttcgttgcctcacctggtcaatacaaccacttcacctctgaccgcaggggcaggggactagatagaatgacctactgagcctcgtctgtctgtctg

SEQ ID NO: 6012 - DNA, 181 bp, Homo sapiens; identical to SEQ ID NO: 3071

SEQ ID NO: 6013 - DNA, 166 bp, Homo sapiens
  misc_feature (1)...(166): n = g, a, c or t
aaaaggcccacttgccgtaacctcttttggtntattttgcttcccattcagnccanagtttatatgataaaggngttnacttttacttcccagtctccaagtgctaacacataaacacatacatgtctgactgttgcagaactgttcgagctcctaattcagtgtt

SEQ ID NO: 6014 - DNA, 219 bp, Homo sapiens
aaaggaggttatgggctgagagtagattgctgaaagtcatgatttaggaagtgtaaggttactggtaatgacacaccgcaagtgcagctaagggagttgacagttgggatgagtgaaagaaaagattattagtatgaggatttcaaggaatcgagaaagtagggctttggatgagttgtttttgtagaagtcaccaatgatgacaatgggatgctgata

SEQ ID NO: 6015 - DNA, 244 bp, Homo sapiens
  misc_feature (1)...(244): n = g, a, c or t
ccttcagaagttaaacgtgatcacttgtgctgggacagccaatagaggagtctgagatgatcatttccaaggagttcttcacagaggaggtagctttggagctgggctttgaggttgggcagtatttgaaacagtagagacggagcaaagaacccctcctggtggggtcagtcattcgctttcttttcctcctcaggaccanggctctttgaagaagaaaaaaggcccacaaggggaccccagg

SEQ ID NO: 6016 - DNA, 102 bp, Homo sapiens
ctatagggctcgagcggccgcccgggcaggtctgtggcagcgcattagttttggcgcaagcgagcctatgctgcagggtcacttttggctggtcagagaagg

SEQ ID NO: 6017 - DNA, 475 bp, Homo sapiens
  misc_feature (1)...(475): n = g, a, c or t
aaaaaaggtgacttggattaaagtatgcaaactcaaggagtagtacgagcccacttgagtcaagttagcttagttgctaaagagcttgataccaaaattacttttgtttacttgatgaatgggatagttgttgcacagggccactgatctagattactgtcttatttgtcaagtacttatagttgtagaagtagcagtgtgaaaattatcggaatgganaaagggccaatgataaaccaatttattttcaggtaccagcaacttcaaggtttctgccacccactgttgtatacacttattgagaaaacaatgcaaaatgtgaagcatccggttactggacaatttctatatcaggacagcaactgggccagcaaagttgagaaactcactttagacaatgctgctttccctttccttgcatattctggaatcccagcagtttctttctgtttttgcgangtaagtctgttcattt

SEQ ID NO: 6018 - DNA, 270 bp, Homo sapiens
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggacttttcccgcaaaagccaatgaaaggccctattgctatgcaatctggtccaaaaccactcttc

SEQ ID NO: 6019 - DNA, 224 bp, Homo sapiens
  misc_feature (1)...(224): n = g, a, c or t
aaaacagatttcatctagagcttcatttccctgttgagctttcttaaagagttctcttaggactgactgtcggaactggacaggtaaactcaaggttaagttgtcttcaatgaaaatctgtattacctcctgatagttgccagatctcaaacaaatatggacttgactatatggagtcaactgttgagatgtactatcagaagaaggtcnaaaacattccctgc

SEQ ID NO: 6020 - DNA, 214 bp, Homo sapiens
ctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgcttacgtcttt

SEQ ID NO: 6021 - DNA, 173 bp, Homo sapiens; identical to SEQ ID NO: 3082

SEQ ID NO: 6022 - DNA, 391 bp, Homo sapiens
cctcctccctcacacacacgtcgccctgtcagaaggccaggcacactactgcagccaggatgctgggatagcaaggggataggtgctccaaccttcaccttccagaaaggcagggtgatctgaagtgacgtgtagctgagagctggatggggagaatttcactttcccagttgatccagaaaggaaagaaaccccagagcattctcttggaagaacttaaactggctttgggctccagtgcgagcgaatgacttgtggaaaggggcaccatgatgagaggccggggccggtgggtgttgctgtctgggtgaacatctcgtcatctgtctgttctttctccccggcatcatatcccttatagtctggctccaggtaaacagtgtctctgcca

SEQ ID NO: 6023 - DNA, 582 bp, Homo sapiens
  misc_feature (1)...(582): n = g, a, c or t
aaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaanaaagacaagcttgcgaacacatctgttcgatttcaaaacagtcagatttcttcnggaacccaggtagaaaaatacaagaaaaattatcttccaatgcaaggcaatccacctcgaagatccaagtctgcacctcctcgtgatttaggcaatttggataagggacaagctgctctcccagggagccacttgaaccactgaacttcccagatcctgaatataaagaggaggaggaagaccaagacatacagggagaaatcagtcatcctgatggaaaggtggaaaaggttataagaatgggtgccgtgttatctgtttcccaatggactcgaaaggaatgattgcagatgggaagacatcctgtccttttttatggtgac

SEQ ID NO: 6024 - DNA, 284 bp, Homo sapiens; identical to SEQ ID NO: 82
  misc_feature (1)...(284): n = g, a, c or t

SEQ ID NO: 6025 - DNA, 190 bp, Homo sapiens; identical to SEQ ID NO: 3088

SEQ ID NO: 6026 - DNA, 184 bp, Homo sapiens; identical to SEQ ID NO: 3690

SEQ ID NO: 6027 - DNA, 138 bp, Homo sapiens
cctcaggcacttggcctttgttttcacaccaacttgatgggttctactataagatgctaaaaaggtgggttgtgtgtggttcagattggttgatttgtaaccctagttgtgcataagaattgcccagatatttttttt

SEQ ID NO: 6028 - DNA, 434 bp, Homo sapiens
aaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaaggtaaagacagactctagggagaggaaatcctgtgggcctttctgtcccacccctgtcagcactgtgctactgatgatacatcaccctggggaattcaaccctgcagatgtcaactgaaggccacaaaaatgagctccatctacaagtgattacctagttgtgagctgttggcatgtggttagaagccatcagaggtgcaagggcttagaaaagaccctgg

SEQ ID NO: 6029 - DNA, 130 bp, Homo sapiens
aaaagtcgacctgttttgcagaaagtctgctgtttttgtactaaaggctttggaatttggcatttagctaggaatgcacattctttcacctcattcatactttaagaaccacagaagtgactctgcttgg

SEQ ID NO: 6030 - DNA, 232 bp, Homo sapiens
ctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaaagtgggaacgccaccccaagg

SEQ ID NO: 6031 - DNA, 214 bp, Homo sapiens
  misc_feature (1)...(214): n = g, a, c or t
ccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttacctcgn

SEQ ID NO: 6032 - DNA, 212 bp, Homo sapiens
  misc_feature (1)...(212): n = g, a, c or t
ccatgggaagcccgagaattggttcctatagacccggttcctgatgaattcccaggccaaaagaaccaccctgacaaattttgggttctgaaagtcttattattggacagtattgcatagctagagaaggaaaaggatttactcatcctgtagggcagcttanttgtcttgggcaaaagctgtataatggtaccacaaaaacagnnacatgg

SEQ ID NO: 6033 - DNA, 181 bp, Homo sapiens
  misc_feature (1)...(181): n = g, a, c or t
aaaaaaaaaanccttcaaaaataaaaataanagttatttanccttgtgaatattttgaagtaaagtttcttgaatttccgtgatgaactcttcaagcaattcaacttctcagagtcatcactcaaaagttcctttgacatgggacctatcccacggngacaaagcggnttccccctttgtt

SEQ ID NO: 6034 - DNA, 252 bp, Homo sapiens
aaagctcaaacttacagagtctgttgtaaggttaatacatagaatgctagctttttagtcacctgagaatcaggaaattcacatgaacataattccctatactgacaaagaactatagctacctatgggcttgtcaagttcctacgcttcattcagcatgaaattgcacttttcttgatatgtataaattaaaatctatgcaactgtctgtgcttggggttgcctcatatcacatctataaaaacagcattt

SEQ ID NO: 6035 - DNA, 398 bp, Homo sapiens
gaagagaaagacagctctcagtctgagtaaaaccgtattgagagaagaaaagaggttgaaagaatcttaaagacaaattcagattacatgtaacattggtcaaattgaccagaaaatattcttccaaagaagttcttctctaaacaccaaaagtgcacagctactctcagcatgagaaatacaagtattatgagaaagagggcttattctgacaagaaattcctctctgctgctctcccatctgccggccgttggattgggaatctatactggaacacacctgacaacctccaccagcactttttgatgaagaattggaattcactctattcacatagtagaattatatcagagattgcaagatagctaactgaagagctactatgattcttgggtgg

SEQ ID NO: 6036 - DNA, 226 bp, Homo sapiens
gtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcag

SEQ ID NO: 6037 - DNA, 157 bp, Homo sapiens
ggtatgttgtctggttctgattggtatcacatgagctgctgagctgaaatcacagtggtttatttggtgtcttgcaggacccagcctttatatgttaatgtttttccctcattggtatgggatacctacaggatgaagttcagacttcatagcaagg

SEQ ID NO: 6038 - DNA, 375 bp, Homo sapiens
  misc_feature (1)...(375): n = g, a, c or t
cctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcancaaccaaggctggncctgcagaataaatgtgtgtgcccatgatcacacccaggggcacaggccacatacgtttccctgaaaccttgggctccacctccatcccgtccatgtgggagggaacttgggtcccagcagtgtgtctttcagcaccaagtcatgttt

SEQ ID NO: 6039 - DNA, 298 bp, Homo sapiens
caggtcctccatcctgtggaacgtgggaaaactatcttgagtgttggcgtgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacattgctggaaaggggttatgagaaattcctctctgtatgctaactccgtaatacaagcgtttgtgtatttt

SEQ ID NO: 6040 - DNA, 216 bp, Homo sapiens
agtgacccgagacccacgtgcccaagactcccggggtctgaacctaaactttgtacacgttactaacataccagttcgcttacctaaaagggctaggtcatatcttaccacgtagacaaacatttcctctagaaaaaaggagcagcagtgatcctcttggcttccttcagccagtgctttaggacatgcaagtccctgtagtaagggaagtctatg

SEQ ID NO: 6041 - DNA, 224 bp, Homo sapiens
  misc_feature (1)...(224): n = g, a, c or t
gttgttgcctgggctggacgtggttttgtctgctgcgcccgctcttcgcgctctcgtttcattttctgcagcgcgccagcaggatggcccacaagcagatctactactcggacaagtacttngacgaacactacgagtaccggcatgttatgttacccagagaactttccaaacaagtacctaaaactcatcngatgtctgaagaagagtggaggagacttgnc

SEQ ID NO: 6042 - DNA, 558 bp, Homo sapiens; identical to SEQ ID NO: 546
  misc_feature (1)...(558): n = g, a, c or t

SEQ ID NO: 6043 - DNA, 374 bp, Homo sapiens; identical to SEQ ID NO: 83

SEQ ID NO: 6044 - DNA, 307 bp, Homo sapiens
  misc_feature (1)...(307): n = g, a, c or t
ccatttaccagactccgacacaatgggccaccaccagtgtgacagcaggacatcctaatatatggatcttgatttttaagtttcagtatctgaacttcctaaattantaacttttagctgggaaagtatagcatgaaaccagaggttctcagaatgactgtaagatagcttacatttcctctttttgcctttatctccccaactaaaatcaatggggaagaantctgcctatgatctttgaatgagctttttaaggaagaaatattatatattgtttgttaaagnttattgaaataaagaatcattt

SEQ ID NO: 6045 - DNA, 223 bp, Homo sapiens
  misc_feature (1)...(223): n = g, a, c or t
ctgaacgtctgtgggtgagccggggtcccctgggagggtcttcttgcactctgactgcagtcggtaggcactggacgtcagtaaacgaagggaagtcctcaccatatcagacttgggttttttggggaataatgctgccatttctgtaacagctacgtgtatcctctctgagcagggaatataactgtcatgtttattttcttgggctgctcttaaaanctcc

SEQ ID NO: 6046 - DNA, 329 bp, Homo sapiens
  misc_feature (1)...(329): n = g, a, c or t
ccttgcctcagatccaaggtcactcggaagaggccatgtntaccctcaatgacactcatggaggaaatgctgagagaagcattcagatgcatgacacaaggtaagactgccaaanaatcttgntcttgctctcctcattttgttattnggttttatttttaggagttttgagagcaaaatgacaacacccagaaattcantaaatgggactttcccggcagagccaatgaaaggccctattgctatgcaatctgntccaaaaccactcttcaggangatgtcttcactggtnggccccacgcaaagcttcttntgacggantctaagac

SEQ ID NO: 6047 - DNA, 357 bp, Homo sapiens; identical to SEQ ID NO: 84

SEQ ID NO: 6048 - DNA, 202 bp, Homo sapiens
  misc_feature (1)...(202): n = g, a, c or t
aaaatcagattttctaaactacaattgttttagaacactgtatgaagaacttatctagtcatagttatttgtagtcaggattttaacagcttgcaacaggtaatgttttgaatataaatatctttccaaagngttactaatggcaaagagataannttctaggctnctattcttgctgcttgaantcagaactgntgatgga

SEQ ID NO: 6049 - DNA, 437 bp, Homo sapiens
  misc_feature (1)...(437): n = g, a, c or t
ccatgagtgacaggtggcctcttggtgggagaggtggggcagggggaaggcagctcccactagaccagggcagtatttaggggaaggaggcagattggagcagttggctgccaacacctggcctcactcagggagaggggccttgggcctggaagatatctgggtgaggtacccacaccatctgctgcaacctctgttgtatccattatgggctcacgccattcacaggcatgaattgagcacctagtatgtgggaaaacaggggaaacaganatggtacagacatggtctccatccttcgggggctccagtctagttgggggagatcagagaagttccatttgccactctangccaagctaggtaagcggcanagccatnaagcattgtgggagctttcaaggaggnagtgagcccttgcattcacggaagaagga

SEQ ID NO: 6050 - DNA, 130 bp, Homo sapiens
  misc_feature (1)...(130): n = g, a, c or t
aaaatcttgagggattgatctcgcctcatgacagcaagttcaatgtttttgccacctgactgaaccacttccaggagtgccttgatcaccagcttaatggncagatcatctgtttcaatggcttcgtcag

SEQ ID NO: 6051 - DNA, 355 bp, Homo sapiens
  misc_feature (1)...(355): n = g, a, c or t
aaagtcaataaattgttattcgaggaattccatgttgtgatttcttccactgtccatcaaggtcactttagatcctctaaagagctggagtcaaaagatttatcttcaagtttgccctttttaatgaaactgatccagttgtcctgtcagcccataattactttggcttctgcatctcgttttaatatggatatactgatgaagacttcaaaattcaccaagaatntttgggatctaatttcttcaaccaatttacttnaggggcctttttactgtaggtggtggggatctacctggttctcaattttgacncccctctcaacatgaatgagtgtcaaatnacattcattcctaa

SEQ ID NO: 6052 - DNA, 129 bp, Homo sapiens
  misc_feature (1)...(129): n = g, a, c or t
ccttgccgtccttctcgtggaacccttcgggaccaaagaaggctccacactgtgcacataagaagtgttcagggtgccacgtccggtcaagggctgtcnccactttattccaaagatggggccgntgna

SEQ ID NO: 6053 - DNA, 102 bp, Homo sapiens
  misc_feature (1)...(102): n = g, a, c or t
ccagcccgaagtcgatgatgtggatggcatgctgccgcttggtccccgggcggcccaccaggaagttctcgggcttcacgtcccggtngattaggctcttgg

SEQ ID NO: 6054 - DNA, 118 bp, Homo sapiens
  misc_feature (1)...(118): n = g, a, c or t
ctgttgatctacctcctgaatttattcacctttatatatcaaattgcatctctacttgtgaacagattaaggataaatatatgcagaatcggttggtgcgtctngtntgtgagtctct

SEQ ID NO: 6055 - DNA, 372 bp, Homo sapiens; identical to SEQ ID NO: 85

SEQ ID NO: 6056 - DNA, 268 bp, Homo sapiens
aataagtagaaaccaaagcacagctaaaaattccactgctcagtttatacactaacagttctagcgtttgcagtgttaaatactttaggctccagatattatcacctttgatataatcgccttggatgattagttttctgttggagaaacttagtatcttttactcttcattactctgtattgctgaattgaatcctatcctttgtgctcaacttttgtgtgatcttaaagtgagctttatcattctaaacgaatctgtgtctacttt

SEQ ID NO: 6057 - DNA, 202 bp, Homo sapiens
ccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatgg

SEQ ID NO: 6058 - DNA, 125 bp, Homo sapiens
cctcaatgcctacctggaaggttcatggcatgaagctttgctgtattatgttttagcagcagaaactggaattgaagtgtcacagacaaatttagcacacatctgtgaggagaggccagacctgg

SEQ ID NO: 6059 - DNA, 250 bp, Homo sapiens
  misc_feature (1)...(250): n = g, a, c or t
ccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccaccgcgaaggacctggcgtctagagatgtggngtctcggtggatgactctggagatccgcgaaggaagaggctgtggncctgagaaagatcacgtctacctgcag

SEQ ID NO: 6060 - DNA, 116 bp, Homo sapiens
  misc_feature (1)...(116): n = g, a, c or t
ncgcggncgaggtccagccgcacatactgtcatgaactaggtagatctgccccaagggagatggctgcatttgaaattttctgtaacaccctaatgcttagcccattaaaanctca

SEQ ID NO: 6061 - DNA, 129 bp, Homo sapiens
  misc_feature (1)...(129): n = g, a, c or t
gcgccngggnaggncctgcatggctgccagccgggctccgtgtctgnggataagaagggctacatctttctgacccttcgagaagtcaacaaggnggngatcctggacccgaaggggnccctccttgga

SEQ ID NO: 6062 - DNA, 111 bp, Homo sapiens; identical to SEQ ID NO: 86
  misc_feature (1)...(111): n = g, a, c or t

SEQ ID NO: 6063 - DNA, 419 bp, Homo sapiens
aaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttct

SEQ ID NO: 6064 - DNA, 228 bp, Homo sapiens
  misc_feature (1)...(228): n = g, a, c or t
aaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagncctactttt

SEQ ID NO: 6065 - DNA, 193 bp, Homo sapiens
ccaactggagacttactttaccttaaccatgtaaagtatccttaccgtattttttatgtgtacagtgttgtagaatatcagccacctcttaaaagtatcaatcttaaaaagagccatggaaggtaaaagtatgaaaatcttgataacaaaagctttcaatacaaaaacacttattgtacacttatttttattt

SEQ ID NO: 6066 - DNA, 298 bp, Homo sapiens
ctgagacttgaaccttcctttcaccgcgggactgggccaactctgtctgtccgagggtgagtagcacaggacagcactcttccatctgtgcacggccgggaactgatgggggtcgacgtctgcacattcaagagcggccaaaacatcctgatcgagttttgatggctcctctccaaaaaggaagagccgcctggccggttccctggtgacctcgagctgatcctcgtgcctggggctgctgggactcaaggacattttagcgatcctggctgacatttcactttctgtcctcctgtgg

SEQ ID NO: 6067 - DNA, 167 bp, Homo sapiens
aaagatgctcccttgctttttataattcctaactgtaaaatataattttagtacagaacaaacaaattctccttggttggtcacatcattcattattgaaagggaaacttagtatcaaaagaaacaaaacactgaaataaataactaagtaatttactgaaaggcag

SEQ ID NO: 6068 - DNA, 241 bp, Homo sapiens
  misc_feature (1)...(241): n = g, a, c or t
ccttaaaaattatgcacgaccaaaaagaatgatttggtgagagatgtgtagctgattgacaattttagtgtgaattcatattcatttaacccagcagcaatctacataagctatgctttttcccgcctgtatttatgtttcttagcttataaagnnccaatatattatatcttttgttgctttggcagntttaatttagagctctgcgttcacanagatnccacctatagcaaaaactatc

SEQ ID NO: 6069 - DNA, 364 bp, Homo sapiens
ttgatgtatctgagcaggttgctccacaggtagctctaggagggctggcgacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataa

SEQ ID NO: 6070 - DNA, 178 bp, Homo sapiens
  misc_feature (1)...(178): n = g, a, c or t
aaaatgtttaattattttgaaatgtatagggtattaaatacaagcttctaaaattttcagtatctatattggctttctctaacagctctacagcaaagtttgacatgttttttgtgngtgtcatgtatngnaagctgtaatatctgtaggagtgagtcggacattctaaattancagt

SEQ ID NO: 6071 - DNA, 320 bp, Homo sapiens
  misc_feature (1)...(320): n = g, a, c or t
ccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaanananagagagagaggtgtgagggacaaaatgcanacccatttcccttgcctcataggcttctgggatgtcatcacctccagtttgttggttttgtttccaactgttaataaagc

SEQ ID NO: 6072 - DNA, 362 bp, Homo sapiens
aaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgta

SEQ ID NO: 6073 - DNA, 385 bp, Homo sapiens
  misc_feature (1)...(385): n = g, a, c or t
ccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgncctgtaatctgtttctaggtgaagcatactc

SEQ ID NO: 6074 - DNA, 357 bp, Homo sapiens
aaattagcacagaatttataattacccaatcagcattgacatagatgccatcaggtatgcaaagattaacaaaattctattaccaaccttagaggaaaaaaacttaatgacatacagaaatactggcaaatttaagctagaattagctccaggacattttatcttattttcacattaaaagaatagattactagatatcagcagaaatgctgttaaagctattttttactaatagttgttcatattaatgaaacaaaagatcaatagtctctgagctaaatttcacaaaatgaaatcagtgtcttctgatttaactttcaggagtaagaaagggcaaaacccaagcaccatactttc

SEQ ID NO: 6075 - DNA, 226 bp, Homo sapiens
aaataacaaactatacaaataaaaaggagcagaaataatatggaatgtttttgacgaaaacaaacttatggattcaataaataatataaaatgcctttgtgctaaaatagaactcttgtttcttatatatatatagttcagtgatctttatgctatccagaaaaagccagatctattataattaaacatagaaaaataccatttaacaataaaactaaaaaaatgg

SEQ ID NO: 6076 - DNA, 254 bp, Homo sapiens; identical to SEQ ID NO: 4835

SEQ ID NO: 6077 - DNA, 410 bp, Homo sapiens
aaagtatttacccaaagaactcataaaaaggtcaatttggtaaaaggacgttttgacccaagagcatctaatatttaagcttattttattggataagcatatctcttgtccatcacaagttatagaaaagttatatacgactaaaagaaaaagttatctactgtaattataggaagttgtcacaacaggaattcagctcaagaacttcttgcaattactgctacaacgtctataaatgggaaaagcaagcattaaaatagattaataaaatataaaattaagactggaaaatccagagacaagctgtatccttagaagaataaatagttaaaattattcagtaagctgacgtatttaaccattactgggcctgtaaaaaatgcattaaaattacattacaaatagttttt

SEQ ID NO: 6078 - DNA, 143 bp, Homo sapiens
  misc_feature (1)...(143): n = g, a, c or t
aaaatgtgtctttctttgggagagaatcattttgttctttactaacaataatttgaaaattggtaatttaatatcttgtgaatatgaaaatattatggtatagatcagcttctaggagaagttaagngtagcatgatttcttg

SEQ ID NO: 6079 - DNA, 101 bp, Homo sapiens
  misc_feature (1)...(101): n = g, a, c or t
aaatctataatctggttcaagtgcaaatcaggtgctttctgttagtccttccaaaaaaggcatttttaatatttttggcacaaatgaaatgtnatnatgcc

SEQ ID NO: 6080 - DNA, 399 bp, Homo sapiens
  misc_feature (1)...(399): n = g, a, c or t
ccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagngtatttttcttgcttatcatgcactctttccttttcttctcgcccgcttttcccctccttttctttttccttccttctttcctccctttaatataagggagaaatacatggttttttgtggaaatcattatatgnttgctttagattttcttctgtntttaccatcataacacttaagtt

SEQ ID NO: 6081 - DNA, 260 bp, Homo sapiens
  misc_feature (1)...(260): n = g, a, c or t
ccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagngaaatggattgtattttggtttatagtgacgtaaactgtatgacaaactttgcaggacttcccttataaagcaaaataattgntcagc

SEQ ID NO: 6082 - DNA, 352 bp, Homo sapiens
  misc_feature (1)...(352): n = g, a, c or t
nctgaantgnggcttgcataaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattag

SEQ ID NO: 6083 - DNA, 213 bp, Homo sapiens
  misc_feature (1)...(213): n = g, a, c or t
cctagataggggattgtgcggtgtgtgatgctagggtagaatccgagtatgttggagaaataaaatgtgcatagtggggattttattttaagtttgttggttaggtagttgaggtctagggctgttanaagtcctatgaaagtgacagcgagggctgtgagttttaggtagagggngattgttgtttggaagggggatgctgggggaaatgtt

SEQ ID NO: 6084 - DNA, 359 bp, Homo sapiens
  misc_feature (1)...(359): n = g, a, c or t
aaataactttcttaaccccgcccattaagatcacagtaaacatacaataatttttattatggaaattaatctttacatacaaaatcagctacgtaattttacttacaaaacaataaaaactgttctttactgtggcaacaaaagaagcattttgacaaatgaaaaaaattaatgcaaacaaattaaaacaatgcttttctttttacttgcttcactgtctcttctatttattttccatgatcatttgacacaaacatggattactttgatatctactgaaacataaatgataaggttcttaaaggttgaattaaaagtctgggtgcncaatattttacaagctgaataaacaaaacgaa

SEQ ID NO: 6085 - DNA, 275 bp, Homo sapiens
aaatagaaaacagtatattgaaagtggtgggtttgatctttttatttagaaacccacaaaatcagaaacacagtacaaataaaacagaaatcaaactataagttgacctttagttcctaaaaagaaacatatttcaaaagcaatggaatctagaattcttataacatgaataacaaaatgtacagcaagcctatgtagttcaattaatatataaggaaaagggaagggtctttctttatgaaaccaagcattataaagtttttactgtaggtagt

SEQ ID NO: 6086 - DNA, 310 bp, Homo sapiens
  misc_feature (1)...(310): n = g, a, c or t
ctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaangaaaaggatgaaagaanaagaacatgcangaanaaataggattagtgtgggaaactctatttgaaacagatcatantcttgacacatctgatatccngttcttggaggatgctggaaacaacgngg

SEQ ID NO: 6087 - DNA, 332 bp, Homo sapiens
  misc_feature (1)...(332): n = g, a, c or t
aaaaaaagaaaaataaaataaagtgttttgattatttagggctgacttacatttcagtatgtgacaaaaattcaaacccaaatgcatctagctcactcagtttcagacaggtcctatgttcagcccctaaacgaatggcacaatgccaccaattttgggattcctgagtttggttcccttaagttctcagagttttcccaactctcaaaaccaaagcatcatgggagtgacagggccactggcaagactttttgccagtcagcctagttcttcttttaagatgcagtagtctcaaagcttaaagtcagaaaatcttgcaataccagantaac

SEQ ID NO: 6088 - DNA, 459 bp, Homo sapiens
aaatgcattcttcacaagtaattcagcatatatttttatatcatgtttacttatgcttaagaattaaagcaagtatatttattactctgatggaaatatgggaaatctctcattcatgcaatatacagggataatattcaagcgaagggaaaattcccgctttttatttttgtaaatgtatccatatataatcatcgacatgacagatgaggaaacccatgaagtttcccactagtcagatatacattttcacttcatcagaagcacctgatatctacagctaatttataattagatactgtttcaatgaaaccaaaatgagccctacaagttcctataaacaaaagcttccaatgtactaggacagtcagtaattaatgcatcattcagaggattatggctgttccttaagaagtgcaagttcaaactgtcaacaccagaggtaatcattttatatta

SEQ ID NO: 6089 - DNA, 242 bp, Homo sapiens
  misc_feature (1)...(242): n = g, a, c or t
cccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgngatggtaaaaatactgggctccnatactacagaatg

SEQ ID NO: 6090 - DNA, 204 bp, Homo sapiens
  misc_feature (1)...(204): n = g, a, c or t
aaataaataaatagctagactggcgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaatngtaatnatncct

SEQ ID NO: 6091 - DNA, 342 bp, Homo sapiens
gtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtcaaaagttactattgctcataatgacttacaggctaaaattagtttt

SEQ ID NO: 6092 - DNA, 294 bp, Homo sapiens
  misc_feature (1)...(294): n = g, a, c or t
gtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagnggtttggacttgggaacaggactttatacctcttttactgtaacaagtactcattaaaggaaat

SEQ ID NO: 6093 - DNA, 232 bp, Homo sapiens
  misc_feature (1)...(232): n = g, a, c or t
caggtaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccnaaatatacggaaaataaacactaactgctgcttatggataaatgctgcaactacttgtnatg

SEQ ID NO: 6094 - DNA, 295 bp, Homo sapiens
  misc_feature (1)...(295): n = g, a, c or t
ctgtaaggaggcggcagacggctaccagtgctgtatgatggcgcagtacaaccggcacgacagccccgaagatgtgaagcgacgagccatggccgaccctgaggtgcagcagatcatgagtgacccagtcatgcgccttatcctggaacagatgcagaaggacccccaggcactcagcgaacacttaaagaatcctgtaatagcacagaagatccanaagctgatggatgtggnnctgattgcaattcggtgatgacttgttcatccccccttcccttcgccctcatgtggaaag

SEQ ID NO: 6095 - DNA, 234 bp, Homo sapiens
  misc_feature (1)...(234): n = g, a, c or t
aaaaaattaactaataaaagcttttatatttaagaactgcaagtgtttcaaaactatgctgttttgtgttgttatagttgtaacatatttctcaattttcctgtttttcttttagtttattgacaagactacctggtcggcctaaattcacattttcattcagtttttgggcatttgagatcaaagagtaagtatggtttctacaagntacttcatttttctacttatcttttt

SEQ ID NO: 6096 - DNA, 396 bp, Homo sapiens
ctgcgctgcacagcctgggcagcaggctgagtatgggctcctcactcccacctcctggccttcaaggccctacttgttgccccagacagccatctttgagaacacaggtcttgggaggaagcggctggacttcatgtaggcagagatcttctccaagccctcaaagcgggagatgaagtccttcagatttgggaaggcgtccaagcagttgggctcaaatatacggtggaggtcaaggacatcatagacgagaaaatctacaaaagtgatcttgtttcctgcaaaccatggccgcttccccagaaactctgagtagagctttagcttttcagggagttcctccaagtactttggcttcagtttctcaaattctggattgtagcagatcatgcccag

SEQ ID NO: 6097 - DNA, 147 bp, Homo sapiens
  misc_feature (1)...(147): n = g, a, c or t
aaaaaaattaaatagtattaatttactaaatatttaggagataacagtgcattaagggttttttttttttatataatncatncatatcncccctttgcagggatagcataaaaaagtaagtntggccttaggtccancncgtttttt

SEQ ID NO: 6098 - DNA, 198 bp, Homo sapiens
  misc_feature (1)...(198): n = g, a, c or t
ccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttntctcc

SEQ ID NO: 6099 - DNA, 162 bp, Homo sapiens
  misc_feature (1)...(162): n = g, a, c or t
aaagaaaccaccaccaacaacaaaacaaccaaaaaccatgttttatgtcaaagctctgtagcacagagaatgtggtgtcacagatacatcgccgagagaggtttctttctttcttttttttttttganacanagtntggttttgtttcccaggntgnagtgc

SEQ ID NO: 6100 - DNA, 271 bp, Homo sapiens
  misc_feature (1)...(271): n = g, a, c or t
aaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgcataataaacatcctttttctttcctgaaatttnttttagaaataancttatttttgcttgntatgttctgaa

SEQ ID NO: 6101 - DNA, 169 bp, Homo sapiens
gaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataa

SEQ ID NO: 6102 - DNA, 265 bp, Homo sapiens
aaaggttattcactatatgaaaacagaaagggaacaattacaacaatgaaattgttttaacttttttaaatctgattctaatgtgtattgacatatatttaattatataaaagactgtgggaaaggggcattaacagtactctagaagagtaaaggataaaaatccctctttttcccctagcttccagtttgacaagagggaatacttaatcgaatcctgtccacaaaaacagctaacagtactgtgctttgaaaaaaaaaaaaa

SEQ ID NO: 6103 - DNA, 317 bp, Homo sapiens
ccaaggaatagaagctctagacctcccttatttctatcgtgaaaacagaggtatatccaagtgagggactacaacagtaataaagggaaaaaagtatttaattccaaaataaaattgaaaataacctcctgtctcagcctctttttgggaatatctagaaggagtggaaaaccatctctggctatgagacttgtatcactacccctttctccctggggcgacaggtagaggctgttgtaaccattttgaaccttgtcctggagtagcttgttgcttttcagttaaagagcttgagtgagcctgtctgggcctctggc

SEQ ID NO: 6104 - DNA, 381 bp, Homo sapiens
  misc_feature (1)...(381): n = g, a, c or t
ccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccangaactttggtaaaagctagctttggggaaggggntgggtgtaaatatgagagggnggagggagaccatacctgcccgggcgggncaagggcgaattccacacactg

SEQ ID NO: 6105 - DNA, 212 bp, Homo sapiens; identical to SEQ ID NO: 4977

SEQ ID NO: 6106 - DNA, 183 bp, Homo sapiens
  misc_feature (1)...(183): n = g, a, c or t
ccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgnnagn

SEQ ID NO: 6107 - DNA, 262 bp, Homo sapiens
ccactgtctgcagcatgggcagaaagtgctcaaagtccagcaccttcacattcatctcatcactcttggggttccccaggaccttgagcacctcggcgttggtagggttctggcccagggccctcatcacatccccacactggctgtacaggatcttgccatcacctgttcggtcaaacagctggaagcctccttgaactctgcggtctggtcttcggtgaagtcacacatcttgactgctcagctctccgggaccttttcc

SEQ ID NO: 6108 - DNA, 243 bp, Homo sapiens
ccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtgggcaaatacattccccagcagg

SEQ ID NO: 6109 - DNA, 362 bp, Homo sapiens
  misc_feature (1)...(362): n = g, a, c or t
aaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgn

SEQ ID NO: 6110 - DNA, 134 bp, Homo sapiens
  misc_feature (1)...(134): n = g, a, c or t
aaaaattactaaaaggtttactttgntcattaataaaacatttaacaattcaaattatatgcaccttttacctagttgaaaaaaatacacattcctggtttcacattataccaactgantaanctgantcctgt

SEQ ID NO: 6111 - DNA, 362 bp, Homo sapiens
ctgttctcatacagaaagtaaatcaagacgaaatatggaaaacatttatttcctttccttcaaaatttaacttacattccactttaatagctgttgaaggttaattaaaatgcagcaaagtataactacgttacgcaagtgacttcagttattttaatgtgagaaaaatcagactatggtatcttacgagtcattatagaaatgttcatcattaaaaagcatttattaggcactgaactgcatgatgttaccttaagtcatttacaaaagaattcctggtccatgtgatgtgaatgggcttggcactttctccataaattttgtagatgactatttgtaagattatacacttaataggtttt

SEQ ID NO: 6112 - DNA, 443 bp, Homo sapiens
  misc_feature (1)...(443): n = g, a, c or t
cctccgtggcagcagaagatcttttcgtccactatggccgcgatgggcaggcagttgaagcagtcagtgaaggttttccacagtttgatgttgtagcgtctcttgcactcatcgtagaaaccatagatgcggttgatgctggcacactcgtggttcccacggagcaggaagaagttctcggggtacttgatcttataggccagcagcaggcagatggtctccaaggactgcttgcccctgtccacatagtcccccagaaagaggtagttgctctcgggagggaaaccgccatactcaaatagtcgcanaaggtcgtagtactggccgtgtatgtcaccgcanatcttgaggggtgcctccanctccagaagaatgggctgnctcacaaaaatctcccgggatttcaggcacagaccgcggatctcgttntctgtagacctcng

SEQ ID NO: 6113 - DNA, 466 bp, Homo sapiens
  misc_feature (1)...(466): n = g, a, c or t
ctgctgacagttctttggtggaaaagtaagttgcgtacttacccaagctgcccaaatgattatcaagccaagtttgtttttcaaaaataggttttaagatacaccaaagaaactatacaatacaaaaatttaacaatgaagttaaagtatatagcaaaagccaaatatgacaacacacatgtataatgtagaaaagaatcctttcagtcctagaaaactaaaatggggagaacttactgaagggtaacatacataaaatgagtactaatagcaaggaataatcctaaacattttcccaataaactgactaagcctcaaaaggacagcttaggaaaatgattaacatgcagtttttctttttttnctagccaattcagttctacttagataaatctgggttgccaatcaatacatatataaattaatttttttctgctcaattctaccattttttctttttnacctt

SEQ ID NO: 6114 - DNA, 231 bp, Homo sapiens
ctgcttgcctgcaaagatgagcctctgctggtcgggggggatgccttctttatcttggatcttggccttcacattttcgatggtgtcactgggctccacctccagagtgatggtcttgccggtcagggtcttcacgaagatctgcataccacctctcagacgcaggaccaggtgcaggggtcgactccttcttggatgttgtaagtcagaaagagtgcggccatcttccag

SEQ ID NO: 6115 - DNA, 296 bp, Homo sapiens
  misc_feature (1)...(296): n = g, a, c or t
aaattttctcacttaggacttttcaaagccatctcaaaggagcttcctcaaaacatttaatgttggcatcaccccacaagtactcagaaataagtgttaaaatagaaatccaatccagtaatgggaaactgacttagattatcttatttgtttgtatatttatttggcatctatctctcttattcactgccctattttcaacatctacaatagtgcttagtaatgaatacacatgcagtacacaaaggtgctaacacaatacatgactaatgatgagggctatgcacatttntaca

SEQ ID NO: 6116 - DNA, 357 bp, Homo sapiens; identical to SEQ ID NO: 5688

SEQ ID NO: 6117 - DNA, 413 bp, Homo sapiens
  misc_feature (1)...(413): n = g, a, c or t
gatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaggacccatcatgccccangctcagcagggagctgctggctgagaaagagcctgaagtcttgcaggacccactggatagatgttattcgactccttcaggttatcttgaactgcccgacttaggccagccctacagcagtgcttgtttactcattggaggaacagtaccttggcttggctcttg

SEQ ID NO: 6118 - DNA, 403 bp, Homo sapiens
  misc_feature (1)...(403): n = g, a, c or t
gatatctgngntaccagccttgtctcggncacctcaaggataatcactaaattctgccnaaaggactgaggaacggtgcctggaaaagggcaagaatatcacngcatgggcatgagnagcttgaaactgctgaagnatgtnctgtntttcttcaacttgctcttttggatctgnggctgctgcattttgggctttgggatctacctgctgatccacaacaacttcngagtgctcttccataacctcccctccctcacnctgggcaatgtgntngtcatcgtgggctctattatcatggtagatgccttcccgggctgcatgggctctatcaaggaaaacaagagtctgcttatgtcgctcttcatcctgctgctgattatcctccctgctgaggtgaccttgg

SEQ ID NO: 6119 - DNA, 294 bp, Homo sapiens
aagctgctccacatctaccaacaatcccggaaggacaactccaattccctgcaggtgaaaacgtaccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccac

SEQ ID NO: 6120 - DNA, 297 bp, Homo sapiens
ctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccag

SEQ ID NO: 6121 - DNA, 173 bp, Homo sapiens
ctggcttgcctgctggcctgcttcctggagataggatgctcagacccaccgctgctcttcaggggtcgtgggaggaattaatgcacttccttctgtcccccaatctctgtccctttacgtgtctctggagctgagcaggtattctttttctttcttcatctcagtagagctgg

SEQ ID NO: 6122 - DNA, 309 bp, Homo sapiens
tttttttgttctaattttaatagggaaggaagaagttacagctcagtgcaccatgaagttgagacagagatggagacacctcagccccacctctctgcaacaggaaagatgattggggagggagcacaggtcagcgtgggaagagggtcatggtggacatgggggtggggtggtctccccacctcctcacattatgcctacatgaacacagacacatgcaggtgcctttgcagaaacaaagtcagggttcttcaagtcacaaagggaagggcaggaacaactcttgcctctcagtcccacacaaggcag

SEQ ID NO: 6123 - DNA, 235 bp, Homo sapiens
cctcagggggcaggtacacaccatcaccaactcggtacaggatgccgttcttagtggctgagtagtagaggacccggctatccaggtcctcgagctgctccaggaccctggggatttctttttgcctcatctcagccagacgggcacagctcacacagaatttgaacttgttgtcctctgttggctgggtttttggaggggactcgaatctcgcgtagtcttgatcataccacag

SEQ ID NO: 6124 - DNA, 348 bp, Homo sapiens
gaggtctggagaggatgcctgatgacttcctgccaggagaagccaaagccaggacatagtcaaccaaaataactccaggttggtgagggaagggacaaggaaaagaaacactgggaaattcaaagaaaggcaatctcagacactaaaagagcagagagagaaagcgacatgggggacttaaagaggctccttccagggcgctgggcttctcttccagcacagaaggctgcaaaagtggaactggcccccagttcccagaggatcacaaggccaaggatccaatgggcacaccatgaggacccaaggaaaggacagagaaaggaacggctctgggaaagccaaacctgg

SEQ ID NO: 6125 - DNA, 440 bp, Homo sapiens
aaaataaaattccagttagccctaattaactacaaccattcctgaactctccctaatgcttctttacctgttagaaaaaagcagtaggacaaaaacatgtaataaacatgcaacctaatcaaatagcctgtgctttctaaactaaatgctcaaatttgaagattaataggaacaacagtttccctttctaatattctatttactagtgtcctctaaggtttactgattctataaattactgtaacaatactaactactttaccatgcaatctctaaatagttaaatgtcttctgcctagtgatacaaaatatatgaaatattaaaaaattgaaaaagaggaaaaaataggaattaaaaaggcatacatggcctgttaacagatttctttatttttcttgggcaattctctaccatcattttggagtttgggcagacctcg

SEQ ID NO: 6126 - DNA, 280 bp, Homo sapiens
ccagatttcataaaactatgttaagggatcaggactttatctcacaggtatagagaattaaggagatattgaaataaagggagatacatgatacaaggagtactttagaattattagattcattttgacatagtgaaaacattcatattacttattttactacaaaatgtcacttgagttgagggggagttaagggaaagaaggcgaggcaaaaaggaagggctatttgaacaaaaatactcactgttaagctgtattggtgacagccttctcttactgg

SEQ ID NO: 6127 - DNA, 212 bp, Homo sapiens
ccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccag

SEQ ID NO: 6128 - DNA, 285 bp, Homo sapiens
aaaaccatttgacctctataatggctttctgtgggctttatatatcgctgtactagtaattaataggcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagttttt

SEQ ID NO: 6129 - DNA, 415 bp, Homo sapiens
cctaccctgtcaagagcaaacaataacatgtaacttgcttattcatttgtacaattaaatactagcttttgctcagagacaatgctataaagtattttaatgtcagtaacaatatacactacgaagtgcacttccattacaaattaacatggtgatatacagatgaacaccaccacccaaaacaaaccataaatgagcaacagttaaaacattaaatttataaatagcaaaaccacaaaataaagtatatacattttatagatttacccttgaacaaatatatagtgtatctgggaaagccaaaaaaaatgtgttttatcacataacatctgaataccagaaatgaagatctgataatattctaaaagccttgtaggctttctcccacttaatattcctttaactgtcgtccttt

SEQ ID NO: 6130 - DNA, 300 bp, Homo sapiens
ctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggtaggtgggttactttgtttagggcgcatagtcaagtcttggtgtgaaatctagatatcacttttattctacatagttctttcctgctgcagttaaaacttatgtaagaaaaacattgaaggcacaaaatggaaattatgagttatttcttgg

SEQ ID NO: 6131 - DNA, 282 bp, Homo sapiens
aaatttcttctttatttcttgttctttcttttctttctctttctgttcctttttctccagctctaacctcttcttttcttccttttcccttttcttctctctttctttggatgcttctctgtgagtaaaaattgttaggttgttttcacatctgcaggtgttgatgcgtcggaactccctacctagaagtttctactcacaacagaaaaggtggtatctgaagtacagttgaaggtaaaaagcgaaaggttgtcaaaatccggaatgtgtgagattattttt

SEQ ID NO: 6132 - DNA, 286 bp, Homo sapiens
ccacttcaagtcacacaggtagataaaaacaggtccttttaggggccaaaggagaggttatcacagcagcagtttggttctcagcagaaatgcccagggcccctgttccacatcaaagctacaagcactgttgtcagggcatggagagcgacgggaccagagccctcctcgtctcagggcagcctgcctggcttcaaggtggagatcacagcgtcctctggggtcataggttcccccactgttccacaggagggaactggtccacctcgcccacctctgtgctcag

SEQ ID NO: 6133 - DNA, 196 bp, Homo sapiens
ccttagccctgctcctctctattccatcctgtagaggtcaggagtcaggagtcgctggcaggagacagcatgtcacccaggactctgccggtgcagaatatgaacaatgccatgttcttgcagaaaacgcttggcctgagtttcataggaggtaatcaccagacaactgcagaatgtggaacactgagcaggacag

SEQ ID NO: 6134 - DNA, 150 bp, Homo sapiens
ccatgctggatgttctgctgcttagacctgatctgctgccaattaccaggggcgggtcaaggatgaccttcttggatccaggaacgctaacatagatctagaaaggaagatggcagtttattacaccagaggtctggagaaacaagacag

SEQ ID NO: 6135 - DNA, 286 bp, Homo sapiens
ccagcagggattcagccggatcaacatctaccacaacactgccagcaacaccttcagagtcgttggagtcaagttgcaggatcagcgggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacaccatgaattcccaagaaggaggcccctccagccagcgtcag

SEQ ID NO: 6136 - DNA, 305 bp, Homo sapiens
ccacctacagcaaaatatcaaaatgggtaagtccttccttcctcttcctcctgattatatacaacatatctcctttcaagactattatttccatcatgcttattccttcacaaatctaaaccttgaggtgatatgaaggaaaccaacatcaagaaaagaaaactcaattcagaaatgaagaaaactggcaggtatacaatacacccccagagcatctcaatatccctggcacagtacaattcagtgtactgctacagcccatagataaatattggcagcttgaataagctcattttttccctcag

SEQ ID NO: 6137 - DNA, 255 bp, Homo sapiens
ccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcag

SEQ ID NO: 6138 - DNA, 309 bp, Homo sapiens
ccagtaggtgtgggtgcttttgatgtttgcttctgttggttgaaagaagcgcagggaagagactgggtgtagagtgatgtaccccaaggctgcagctaagatcaaattcttctggagagctgtgtgagctggatgctgatgcagaggagggtgggggagctggtgagaccaaggctgggctctgtgcccatcccactgggtgtgaaggaaggaaatgaccacagacagccatgttctgggtcggccgtctgcaagccaggctgactcctcctctcccccagagttcaggatggtcaacggcagcagcag

SEQ ID NO: 6139 - DNA, 306 bp, Homo sapiens; identical to SEQ ID NO: 2659

SEQ ID NO: 6140 - DNA, 331 bp, Homo sapiens
ctgccgtagcccatccagggttagttctggctgacgtaaatcaagctgctcagaaggtcgatcctggaacactggtggagcgcctgggccagcttccccaccgtggctccctttatgccttccctcatcacccacttttggagcatctggtaaaccttttctttcagtccatctcgctcatagtcatggtcaatttcatcaatctgagactgtgtgaagcccagtttacgggcacagtttttccagtgctttcccagattttccctgattgggtccaggtgtttatccgtcagactagtggtattatcaaagatagcttggtacttagcag

SEQ ID NO: 6141 - DNA, 255 bp, Homo sapiens
ctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtgg

SEQ ID NO: 6142 - DNA, 263 bp, Homo sapiens
ctgaatcagcctgggtgccctagacccagtcatgtttgttggaccaaattagctgtcttttcatttcatgctatatagaactggcagtttacacttctgattaatacattgtctccgatcaggaggtttatttttttttcctaataaaatctgaaaggagattgggcagaaccaattagtaatcttacattacacattgtccctaggtatataatcaagaattaacagcagttatgattatatgattataatacatgcatttt

SEQ ID NO: 6143 - DNA, 206 bp, Homo sapiens
caggattcctttctccacattcctaaaactgggtaccacggtccgcaataatagtcaccagacccatcatcacaggctatgtcactaaaactgaccgaagcgttttccagttcacattttcctaaagattttataatgtgacaacccttctctccttagaaagttatacttctggcacttgaaatgctggatttgttgtccagttt

SEQ ID NO: 6144 - DNA, 284 bp, Homo sapiens
ctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaagttgagcttaaagagagagtgtgatcagtttcagaaagaacaatctcctgctaacaggaaggtcagtcagatgaattcccttgaacaagaattagaaacaattcatttggaaaatgaagg

SEQ ID NO: 6145 - DNA, 366 bp, Homo sapiens
cgcagtgtgcactaaggggcccggccagccatgtctgcatttcggtggctggtcaagctcctcctccctgcatctgaccagcagcgcctttcccaactctagctgggggtgggccaggctgatgggacagaattggatacatacgccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggctcctatgtagtccgtgctgacag

SEQ ID NO: 6146 - DNA, 311 bp, Homo sapiens
ctccaaccagcctcacaagaacatcaacatcacatttgaggaagacaaagtcaactcaactctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaagcctcaaagagaaatgttttgtaactcaactggccggcttcctgg

SEQ ID NO: 6147 - DNA, 348 bp, Homo sapiens
  misc_feature (1)...(348): n = g, a, c or t
aaaggtaaaaggatgggagaaaagtacacagaaagatattctggagaaaaggcacagagtgagccaaggcacaaggtaaaatgtttgactggttagagacgctagattattttgtgtggctaagacaaaacaaagctggtggggagtggcaggaggtaagtctanaatggcacaatggggccagactgcgaatggcaaactgaagtatgtgatcttttattctaaagaaaatgtagtatgattagcacaaaaaaagaaaaattattggccgggcgcagtggcccatgcctgtaatcccagcactttgggaggccgaggagggtggatcatgaggtcaggagatcaaga

SEQ ID NO: 6148 - DNA, 419 bp, Homo sapiens
ccagtggaagaatgaaacttataacagtcacccacttttagtaaaagttaaagctcaaacaatagacagagccaaatatatcatgaagcgcctaaccaaggaaaatgtgaagccttctggaagacaaattgggaagttgagccacagcaatccaaccattttgtttgattatatcttgtcacaactacagaagtatgataacttaataacacctgtagtagattcattgaaatacctcacttcactgaattatgatgtcttggcctattgtatcattgaagctttagctaatccagaaaaggaaagaatgaaacatgatgacacgaccatctcaagctggcttcagacagccagttccttttctttcaacttattgtatctgatagccggaatcttgcagtggctccccattgtccttt

SEQ ID NO: 6149 - DNA, 270 bp, Homo sapiens; identical to SEQ ID NO: 2914

SEQ ID NO: 6150 - DNA, 224 bp, Homo sapiens
cctctggacctttgatggaaggggctgccatgaagacctgtgacatgccctggagacattttccccattgtcttggggattcacatttgactcctcgttacttaaacaaacttctgcagccagatcgaatttttcttgagaaaatgggattttcttttctattgcattgtcaggctgcagattttccaaactttcatgctctgcttccctcataaaactgaagg

SEQ ID NO: 6151 - DNA, 389 bp, Homo sapiens
ctgtcaggggcggcgtgcctggtgatgcggcatcttaccttcatccccatctcagaatgggcagccagtctcagattcaaggaggaggaatcctgaggtgtggcgttcagtcctgaggtagacctgaggtcccctggaaattgtgttgatgctgagatggatgaggggtgctcattctctcaggtagacagtgaggagtcctggttcagccgagcctccatgtctgcatggatggttatgaccctgattgtttttggaaacagccaagctctctaggtgtactcagcaaatgcaaggtatagtgggtcctgcatacccagggtattatttgagccatggaagcaaaacagagactgcttagcctccctaagagtagttggtgggagtgg

SEQ ID NO: 6152 - DNA, 212 bp, Homo sapiens
ctgacactagaaaaccttcagatgctgccagagagtgaggatggggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaaa

SEQ ID NO: 6153 - DNA, 351 bp, Homo sapiens
  misc_feature (1)...(351): n = g, a, c or t
cctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcangagaagaaagacaagactactcngaagaatgtgggagaaaagaagagtgg

SEQ ID NO: 6154 - DNA, 410 bp, Homo sapiens
  misc_feature (1)...(410): n = g, a, c or t
gtgaatcanaaaactgatttattctggggcgtgatcctaatcttgacttgcacaagtgtaacttgacctagctcaccaatttcagtaacattgttctgttctcagttcctggcatgggatattccaaattcctgtgtctggagggaaatgatagcttttgtcttgccatcctgagtgaccagtcacaaagcagttgaagggggctggaagccaccctatgaggacacgccattagtatgtaagcagaatgtgtgtctacctgtcaaagtaatttccagtaacctgagttcacaattctggtcctaggtgagtttttctaggagtgaaaatgcagaaaaggatgttgaaagctattggctaatgtatcatttgaactgctgataacctgagaaggggctcaggcatggttt

SEQ ID NO: 6155 - DNA, 571 bp, Homo sapiens
  misc_feature (1)...(571): n = g, a, c or t
cctacagcccagagaagacattttttcttcatttacattagcttatgaaaaataaagggaaaacaaccctcttcaatacaaaaacaaaaaaacaaaacaaagcaattccattacaataaaaatgaaagcaataacaatttggagatcaaagctgcctagctcttggcaataatgagctatctggatttcacatcttccgctagcatggttctgcccggctttggtaacaccacatgtgggtaaaacggtataaagaattgaagaactgtgggcacagaatcacccttactgcagattctcattcttaatatttccctttaacagcattttgctgttctcaagtctcagaaactttatgtggtgggatgggagggaaccaccataaccgcctgcctgcctttttttttcttaactgttattgntcataatagagatggggctcactatgttacccaggttggtctcaaactnctgagctcaacaatcctcccccttggctccaaagtgctaggatacaggngtgagccaccgcgcccggcatctgcttttgccacctaagagagtgctcaac

SEQ ID NO: 6156 - DNA, 577 bp, Homo sapiens
  misc_feature (1)...(577): n = g, a, c or t
ccatggagagcaggcgggtttgtgtatggctgatgttgaagccctggatgtgcagctccaaggggacgggacgcacattgggatggaagttgaaggtggaggtggcactgcagcccagccagtgggccacatccttggcattggagagcgaagagctgagtgccacaatgcgaatgggccgctcaatctgggaggagatgtagcgcattcgggagcagatcacttctaagacaggcccattctcgcccccgataaggtggacctcatccaccacgaagaggttgatgttctgcacgttcttgcgctgcttccatcgccgggaaagtatgtcccacttctcaggggtgctgatgataatgttccctttgcccagcagcttcaggtctgtgctggtctcgcctgtcaggagtaccaccttcttgttgagcctgtcctggaacttctcgtaccagtccatgtatacctgctctgccagggccttcatgggggtgatgtacacacagcgcccttccanctctgcagcagcattccangaagggaaactctgcacaatagtcttccccttgcccgnggggcc

SEQ ID NO: 6157 - DNA, 233 bp, Homo sapiens
aaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctgg

SEQ ID NO: 6158 - DNA, 376 bp, Homo sapiens
aaacatgacttggtgctgaaagacacactgctgggacccaagttccctcccacatggacgggatggaggctggagcccaaggtttcagggaaacgtatgtggcctgtgcccctgggtgtgatcatgggcacacacatttatctggcagggccagccttggctgctgaggggtcatgggcacagaggaggaccatctggtgacactgaggaccagtgttgcccacagccagggagaataaggatgaagaatgagtgttgccacacccctccagatgagctcaagaaagaggccaagcctagccctaaacaggtctgtaagtaattctgggtcctgataggcaaacgcatccagccagagggccctgggtccttcagg

SEQ ID NO: 6159 - DNA, 499 bp, Homo sapiens
ccaaggggatgatgccctgtagcactttgctttgcaggaagggaacaactgtgctgtgaataccaggatccaggagggagggagggtatatctgtgtcccccagctagggacaaggcttccttaaccttaggtcctcatgcttatattagttcttctccaacaaagtttgactttgagaagaagctggcacatggctgaaatgcgctcacgcggttgggggaagagtgttcttccagtcctcctccccacagggcctcctgcttctcctaagtacctgtcatcaaaggagatgaagatgaatcccccttcagcccccacacctcaatgagttgtcaagtactctccctcccacttgaataggaagcaggagcagcaggccaggttgcaggttgaggaagtcagaagttaacttgagctgagtttgcagctctggagagattgaggagcagacttttctcttgtcactttggaaggaaaggattgtgaggctgccccttt

SEQ ID NO: 6160 - DNA, 359 bp, Homo sapiens
ctgtcgccgccgctctcagggtgaagagggaacagaaatctttgccccctgactttggaaatctcgtttaaccttcaaactggccatgtcaagggttccaagtcctccacctccggcagaaatgtcgagtggcccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcag

SEQ ID NO: 6161 - DNA, 201 bp, Homo sapiens
acgcacacgagaacatgcctgtgagtgctttggcccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagat

SEQ ID NO: 6162 - DNA, 231 bp, Homo sapiens
ccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaagtaagttttattaactctgttatatttgcttcctaacaactttgctgtaaaattgagggatcattgtttggtgagttgttttaggttatttcag

SEQ ID NO: 6163 - DNA, 343 bp, Homo sapiens
aaatcaactaacagggaattcatatccaacaattcactgatattttcttggtatgttcttaagaacaaaacaaaacaaaaatctcaatttgaactaacagtgggtggcatacagagagcttgcatacaatactcttacaagaattacgtactatactgaacttctatgaaattatttacctggtccgtaatgttattcagggcaacccatcccaaaaagagcaaattctgcaaccctcaatggcaaaaacgctgcccagcattgcttcccaaaaatgtccttgcaaagtttcccattgtaagtatacaatgtggcaaaagttcaaagatcagaaaaagtcttt

SEQ ID NO: 6164 - DNA, 334 bp, Homo sapiens; identical to SEQ ID NO: 5578

SEQ ID NO: 6165 - DNA, 308 bp, Homo sapiens
cctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctcttt

SEQ ID NO: 6166 - DNA, 383 bp, Homo sapiens
  misc_feature (1)...(383): n = g, a, c or t
aaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatatcttcaaataaaagtttgcctgcagaacctggcaaaatgacccattaggagagtttagatgttttaattttatgtgctcccagctactctggagtctgaggtgggaggatcacttgaggcagaggttgcagtaagctgagattacactactgcactccagcccatgcgacagaggaatgagagccagtctcaaaaaaaaaaaannaaaaan

SEQ ID NO: 6167 - DNA, 217 bp, Homo sapiens
gggtgtttctggttttgccttagcaatgcatcggtctctgaggtgacactctggagcggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttcttttt

SEQ ID NO: 6168 - DNA, 263 bp, Homo sapiens
ccactcacccactgtgaggtcctctaggaaaatacacaaagagaggaccagaccaggcagaggaacattttgtttcatatgaactgtggctttgacccccaaactgcaaggaggaacttgctgggccaagctgcagcggcgctgtcttgctggagtggggacctagagtcagagaaaacccacaggctcctctgcccattctcctccatctgcacacgtctcagcctcggaccctcaccactccatggtgaggaaggccatgg

SEQ ID NO: 6169 - DNA, 330 bp, Homo sapiens
ccttgcccacgttctccttgtaggagacgaagttgtggaaggtgaggtccaccatgtccgggccggacaccaccgtgagtgtcttcagcaggaaactgttatcaggaaagtccatgttgaagacgtcccggagcttctggctcttgggcatcttggcaaacttcccaaagcgagtatcccggatgctggtgatatccagaaactccatctccttactttgatacgtccagtataagtagtagcccttaggatccacacggaggataactggagaggcaactgtagtttcatcatcccatttgatgaagcgctccccttggctcagatagg

SEQ ID NO: 6170 - DNA, 488 bp, Homo sapiens
  misc_feature (1)...(488): n = g, a, c or t
ccanaggcagagattactatcctggcactccagtgacccactgggtgactcactgatgccacagcacccgctaggaagctctgctgaaccttagtatttggtcctaaattttatgactccatggagttcccgtagtccatggctagttaggaagaaaggaggtgggataagggtcaggcccaggtgacccctaagaaccagganatggntaaaagtttttttttatattctgcttttatgatntntgagtacctgtttgtctccaggccaaacctttgggcttaaatatctttttcctagacaggtttttgctagtgttgaattttcttcttcctctggcctccttctgtgcccctttccccaagcccaagactgcttaacttccaaagcaaattctagatagacactgtatttattggtatgggagtgggctctatggggtggtctgcacccatctgggactctttttcctaaatcctgcaccaaat

SEQ ID NO: 6171 - DNA, 278 bp, Homo sapiens
  misc_feature (1)...(278): n = g, a, c or t
gaggnccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggagg

SEQ ID NO: 6172 - DNA, 177 bp, Homo sapiens
ccaggctggtcttgaactcctgacctcaagtgatccgcctgggtcagcctcccaaagtgctgagattacaggcatgagccaccgtgtcggtcctgttttgtgtaactttagtttggctacatcttttcttgcacctctccttagacaaactgtacactaattggaaatgtaaacttt

SEQ ID NO: 6173 - DNA, 459 bp, Homo sapiens
aaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgttt

SEQ ID NO: 6174 - DNA, 286 bp, Homo sapiens
aaactgtcttgcaaagagaagatatcttctgatatcatcgagggaatagacacgatcaattgattcctcaattcttgaatgcaaatctactatgcgcctggcaatggcataatctgtaacctaattcaaaacaaaaaaatcactttgatagtcacagcaatatcttctccagactatcccaggcaataagaaatgatttatcgccaaaaacaagctctaatataccacttaaagaagtattaatgggtaccaagtttctgatgaaagtttgggaacaggtggattt

SEQ ID NO: 6175 - DNA, 336 bp, Homo sapiens
cctctggtgcggaaactgagtcacagccagacctcagggcacggcctagacgcttacgagccaaagttaggggtagagagcagagacctccggggggtctcagggagtagggggcttcagggcctcccagtctagagcccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacag

SEQ ID NO: 6176 - DNA, 199 bp, Homo sapiens
aaaccagctttaagacaaaaaatcgtcaccaagttccatatgacaaaaaagggtctttcagtttgaattactttccatttctatttgatcaaataaaccaaaatattactaaggaagagcatccaatgatttgtaaagctgataaaactgccctgtttcaaggaaagctctttaatagatacaagtcaagctctcgttt

SEQ ID NO: 6177 - DNA, 384 bp, Homo sapiens
aaatttactggaggacttttttgttctcttcttttttctttttttaatagcatcccgctcttatttcagaataaaaaaatttttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgttaggagaaggcattggttaggattgggaagcggcaagcagaagcatttagggattggctggcaatgttttacttctcag

SEQ ID NO: 6178 - DNA, 606 bp, Homo sapiens
  misc_feature (1)...(606): n = g, a, c or t
ctggcctctcctgacgtgttcctctttaggagcaacaggtgaaaaaatgatacggttctggggcaggcccatgttttgtgcatactgttgaatattaggttctcctactgctggaaaacgcaacagtcagagtacactattggggaacacgcttcagaatgtttgcccacatctgcaaagtagaagggtcaattttatacaactgattaaagttacagtatacgatggcatcttctggtaacccgtactgagaacgggtggttacaataatggtacggggaacctcctctccagttgcagccttattgttgatctgagtagttgccagtccattgctaatactgaatccattaattgttatttgaatctgtcctcggttaatcatttcaataactgcttctgcaatagtattcataggaataacaggcatattaagagctgtgttactgctatctgcattgtctcctccatcaggacacttcatcttgacaattttcacatctggtangactatcaagaaatgctttgaggtcgatgcccttcagaactatccgattgtcataaatgtgcccattggactcaaaatcgatgactgcttttttnttt

SEQ ID NO: 6179 - DNA, 253 bp, Homo sapiens
cctggacatacctgcggatatggacgggaaatccatcctcaagctgctggacacggagcggccggtgaatcggtttcacttgaaaaagaagatgagggtctggcgggactccttcttggtggagaagaggcaaagctgctacacaagagagacaatgacaagggtggacgcccaggaggagaactttctgcccaagtaccagcgtgtgaaggacctgtgtcagcgtgctgagtaccagacggcgtgtgagcag

SEQ ID NO: 6180 - DNA, 600 bp, Homo sapiens
  misc_feature (1)...(600): n = g, a, c or t
aaacttacttttcttgcccttgccaccaacactaatttcaggagtctcaaggttcagctctgcctcaggaacagtgacatccagtgaaggtgacttgatgtcagctttggggctttttgccccaaatccaaacttgggtttcttaaattgggggattttaacatctggcccttcgatgttaatatctgggctgtccatgtgtacatctaagcttggagcttcaactttgggtcccttgaggtccacttcaccaccttctaacttcggacctgaaaatccaatttttggtgccttgagatgcaaatcaacatcaggagcagctactttaggagcagatatctccagcgatggcatcttcaaagatgggccactgagtttggcatcagggccttcgaaatccagacgtggacctttaagatctacttctgggcctttcaaagtcccttcaaccttanggacagacacatcaaaatctcctttactttgggtcctttcaaatccacgggaacatcaggtattggagatcttggggagctntgattttatttcaggcatcttggaacntgggggcccttcaattttgcggcctggaccttcnna

SEQ ID NO: 6181 - DNA, 326 bp, Homo sapiens
ctgaatacacgtcttttgtggaaaatttcttcctgctgagaaaattttgggattaagaactgtattaaagactgttacggcaaagacaagaacatcaattttatttatacgatactgttaaagaagaacagttaaagagtttggtttttgtttttttcaaatcccagtctgccctcaaaagctgggaaaattctttgtggctctatatataaactatcctgaggtcctctcagaacgcaaagactcctgtttttccaatccactgggtactgtcaagataatatcagaaagagtgagtataaaaaaatgaatgggagtaaattttt

SEQ ID NO: 6182 - DNA, 507 bp, Homo sapiens
  misc_feature (1)...(507): n = g, a, c or t
ctgtcatatgaataattgaatgagtatcagtaaagtgcttcagtgcgtgcttgtagctttatggttgtgattggttgctgtggagggggaggccctcagctctgagctgggcagggagaagcagagaaaagttacttcagcctgaggctccccactttcgttagctaagcccggggttactggtgtctctagggaatgatcagcactcggtcagaattggaggaactctcttcttcttttcacgctggacaaatagtcagggccgtgggctccaaggtcaaaattctgaaaacaggatatagagcctcagagaaggagacgtccaggaaagtatgaatatgcgatccatccacagcattgtagaatgagatatctccagtctcatagtccaggaagacccccactttcttagggggcttaggaagtttcaggttggttctgggctcagttagagtcccgatacttattcccatcagtcanncccatagtccagaatccattcttcag

SEQ ID NO: 6183 - DNA, 271 bp, Homo sapiens
  misc_feature (1)...(271): n = g, a, c or t
ccagcctacaatggggatgttgtgtttctgttcaccttcgtttactatgcctgtgtcttctccaccacgctggggtctgggaggaatggacagacagaggatgagctctacccagggcctgcaggacctgcctgtancccactctgctcgccttagcactaccactcctgccaaggaggattccatttggcagagcttcttccaggtgcccagctatactagtgccgngagggacagaagggacagaaagaggctgaagaccatcatccag

SEQ ID NO: 6184 - DNA, 389 bp, Homo sapiens
ctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccag

SEQ ID NO: 6185 - DNA, 262 bp, Homo sapiens
ctgaaggagtatcacatcaagcacaacattctctacttcctcacctacgccgacgaggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcag

SEQ ID NO: 6186 - DNA, 261 bp, Homo sapiens
ctggacataccaattggtatcaaatagaataaaatcaaatataaatgtttgagtcttaggttaaaaaggaaggttatttgtatagtttatagataatgaaggaaaaatttctttttcattgcaggaaatcttgtttactggaagatagagtcactcttttcatataagacaaatagtgctttaatgccaacttctttttatctcaacatttcaggatcatgctaggcacactgcccccttgaatagacattatatgcacag

SEQ ID NO: 6187 - DNA, 247 bp, Homo sapiens; identical to SEQ ID NO: 2583

SEQ ID NO: 6188 - DNA, 337 bp, Homo sapiens
ttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgagg

SEQ ID NO: 6189 - DNA, 181 bp, Homo sapiens
gaggtctgggtttttctgagaaataacaccagacatctttctcaccccctgcagaatgagtccctggaacgccagatgcgtgaaatggaagagaactttgccgttgaagctgctaactaccaagacactattggccgcctgcaggatgagattcagaatatgaaggaggaaatggctcgtc

SEQ ID NO: 6190 - DNA, 327 bp, Homo sapiens
cctgcggctgctgctgccgccttctggaatatctaaagtgctttcacttggctcatcagggtctggaggattactgagtagattgtgaacatctcctcgacgacgttgtctgtgcctcctccgatactgaaattcagcatattcctctggtgatgcaaatcctaaatattcccaatcccatgttccaccagcaaagctgcgccttggagcttctggtgagtctgcaggagctactccccgagccacagatgccaggaattcttgcctcttctgctgtacaaggcatgctgctttgatgatcttgtggcggggtgtgcgaaggtaagg

SEQ ID NO: 6191 - DNA, 337 bp, Homo sapiens
ctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcag

SEQ ID NO: 6192 - DNA, 349 bp, Homo sapiens
ctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgattt

SEQ ID NO: 6193 - DNA, 441 bp, Homo sapiens
aaatgtaaataaattggcaccacctttaatcagactgatgtcctgacttgcacaggaaacacgcacctaacctcaccaacctcaagccctccctcctcaagtctccatgcaaagactgtgccagtcagagtggagctgtccccccgacgagcccccagaagcgcccggccggccacggctgtcattttgagggcggaaaataactggatttctggttaattggtgacatcctcaagagctgtggcaagccatgtctcggccgcgtgatggggcagacatggtgggtcctggcggccttgtcttcaccaagtgctcctaactctcagcaaacttggggttcatgaccgtcgtggtggcgctcttgaaaaggggattatcattgttccactgggacttgagcttctccttctcaaagcgcctgtactcccggaggtcgctcag

SEQ ID NO: 6194 - DNA, 207 bp, Homo sapiens; identical to SEQ ID NO: 5458

SEQ ID NO: 6195 - DNA, 311 bp, Homo sapiens
cctccacgaagaatatttttggccgatactcttcacagcggatgaaggattggcaggagattatagctctgtatgagaaggacaacacctacttaggtaaagtggcccggcctgggagccctggtatccatggggaagcccactctcagagttctgagataccaggcttataggaggcacagtctgtgagtgggaagagactggagtgtagatgttgcccatttgtaggtggtaaaatcaattgtttttgatggaattgattttccctgagtggagtgctgggggaaggaggaggtccaggccggtagtgg

SEQ ID NO: 6196 - DNA, 373 bp, Homo sapiens
  misc_feature (1)...(373): n = g, a, c or t
cctactgtatttattttagtaatgtgctacattagagtagaaaaaataagaacgtgaagaagaaatagcaaaaggagaaaattaccacagatttacagaacaatatgttttaagagagacgttgagaaagattcacgtggccgtcctcagcgtctcaaactcctttgaagggagatttgagcttaggctgttgatgacataagatgcaaagcaaaataatatactctctttattacccagaaaatcaagttgccagtcaaaactgagaaatgagaaagaaaatcagatttctttattcatctctgttgaagcctanaaaaccaaaacaagctggttgtggttcagcatcatggtttaggaatcaagctgtcag

SEQ ID NO: 6197 - DNA, 290 bp, Homo sapiens
  misc_feature (1)...(290): n = g, a, c or t
gaggtcctttccttgagctgcacgtgaacctgtgtgggcaggcancgtttgcaggcgtgtttacgggcaggcagcgtttgcaggcgtgtttaccggcaggcagcgtttgcaggcgtgtttacatgcaggcgtagcaccatgtgagaccactggtccagggtttcagaggtcctgctcaggtgaatcggctgtgttctcacaagttcacggagctgagtgggtgtgcaacatgaaatactagtgctgtgagggacagaagggacagaaagaggctgaagaccatcatccag

SEQ ID NO: 6198 - DNA, 303 bp, Homo sapiens
  misc_feature (1)...(303): n = g, a, c or t
nangtaaaancatggaagaganggaaaaaaaaccagcttangaanaatnaactgataaactgcaagaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtatatgtaaagatacttgataggacttttgcttanttgaatctttagcaaatctcttttatttcttgggattttgaagaagtaattttt

SEQ ID NO: 6199 - DNA, 446 bp, Homo sapiens
cctgtccatcatgtattgtctgaggctgcttcctgctgtcatgggagaaacttttgggcggatgctgctgggagccggtcagactgggcagactggatgagaacaggaggatgagaatgagcaaaggcacccacgaggagaacaggaggaaaacccacgcgtttgggggcgactagaaatgcgcagtgagccttggggtcccctgtgctgccctcaggctgcgtttgccttgagtgaaatattttctccaaaaggcagaggagaggacaaagcccctgtgcatctccattctccacagcatccccaggatggcaggaggaggtccccgagaactgcacaagctgtgtttgacccaaggggactttttcctcttgaggaggtttgctgggtcatgtcagtgatgaggtttaaggacagagcccaggaccctcacagcctggatatgg

SEQ ID NO: 6200 - DNA, 376 bp, Homo sapiens
cctcaacctaatatgccccaaagttgatacaaattttattagaaaaacaaactttttgtaagtctaacaggtaaaggaacaaagaatcagatctatttttcttatagcttccttactcttcccttccctcttttattctttatcacctaaaagcttggtcaccagtaagttgaaaaggttaaaatatggctatgaaagtagaaaatatagaaaaatatttaagatgttcaacagtaatttttagagtaaagttagttaagcactagagtttatgcaacactgtaaaatacaagtattttactaactacactggaaaaaacacctacttgcaattttaattaatcattataattcaaaaacaggtttatataactgg

SEQ ID NO: 6201 - DNA, 435 bp, Homo sapiens
ccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgac

SEQ ID NO: 6202 - DNA, 158 bp, Homo sapiens
  misc_feature (1)...(158): n = g, a, c or t
gtccctgaacgctcncttgtctnctggacaacccatactaggactncacnttgacactaaggtgagctcgcagntgtgtacgctgggacctgtaggtgaaccantnccatgcttgcacttgccctttcttncgactgcctgctttaacagactctgcg

SEQ ID NO: 6203 - DNA, 135 bp, Homo sapiens
  misc_feature (1)...(135): n = g, a, c or t
tctnaaatagtctcacctctggctctgatactcacgcttacacggttgatatctcacaggacaacaactcggacgagctcggacttacgtaagtggggactcacccangcctctggatagcgcagaacctngggg

SEQ ID NO: 6204 - DNA, 221 bp, Homo sapiens
agagtggggagccacagcagcacaagcggccacctgccaccacggccacacaggtctcccagcagctctgcctcatccaggtggtgggtggagaggatcagccgtgcgaccttctcggtatttgagcagcagctcccaaataccgcggcgggaagcaggatccacgccagccgtaggctcgtccaggataacaacttgggagccgcccacaaaggcaatgg

SEQ ID NO: 6205 - DNA, 190 bp, Homo sapiens
  misc_feature (1)...(190): n = g, a, c or t
agctgggnactgcagggcagatgccatgcattcgcttgttgaangccaccangatttgtgtgacgggcaaaancaacttccanntctanacacctccgccaccaccacnctnagggngaattccaccacactggcggccnntactagnggatacctagctcggnaccaatcttggcgtaatcatngtcat

SEQ ID NO: 6206 - DNA, 35 bp, Homo sapiens
  misc_feature (1)...(35): n = g, a, c or t
cctggacacctgtnaagacnactnttatgacncat

SEQ ID NO: 6207 - DNA, 393 bp, Homo sapiens
  misc_feature (1)...(393): n = g, a, c or t
aaaccctgccttgctcaactccggagttggtgggtttttttctctttagaaatagcgtctctgtctgtaaggctgtgagggtgtagtgcagtggcacaatcacagttcactgcagcctagaattccttcgcttaggcgatgctcccaccccagcctcctgagtagctgggagtacaggtgcatgccacacctggctaattaaaaaaaagnttnttagagatacggtctctgtatgttgcccaangctgatctcaaactcctgtcctcaagnaatcctcctgcctttgcctcccaaagtgcttgggatcacaagtatgagccaccacatccaacccagagttcgtgctcttaaccaggggatgacatgttgcaacttcactcntcacanntgtg

SEQ ID NO: 6208 - DNA, 395 bp, Homo sapiens
  misc_feature (1)...(395): n = g, a, c or t
aaacctggtcaagtggtaatgttctgatgaatttgtttctctgcaagaacaaggaagaaaacattactttgaccaggtattcaacatgatttgatccaaagctacttttagatgctacatttacctgataaaaagagggataacattatgcccaaatggatgcattgtaaagaaaatccagaacagttaacaactacagaaacaaaagagatatcttccgcttactttatttacttgttttacaaaggcagtgaacaccaaaggatatcaccaacaactaaaaggagttcaaaatgcaggggaaggaaaactagctgaaacttgagtaaaggctcctgtgcggngtgagcccttgggcccttttcctccacccatcattgagtatataaaggcgc

SEQ ID NO: 6209 - DNA, 461 bp, Homo sapiens
  misc_feature (1)...(461): n = g, a, c or t
ccaggaggctgaaggctgagtctgcttcttctgggttcacgccacagtcacgtgtggtggctgctgtagcctgcagccaggtgccattcttcctcatgccctctgtgagtggcttcattccactctggggtctggcatggccctccccatcgttatcctctctgcattcatgacagggtgttggcaactcgcttgcacccttcaggtctgccgtcttggttcctaggttgctaggaaaggaccacgagggggcccgctgcagagaacggaagagcagccaggaccagtcggctccatacaccagcgagtcgggcaatgtgtgagatgtcaggaccgtcgcctcctgcctctcctccattgccttttggcagttgaggatcttaaagccacttgtgcatgcaggcggccangagcangtggtggtggaaanggtgccacttgattctccataccccacccct

SEQ ID NO: 6210 - DNA, 205 bp, Homo sapiens
  misc_feature (1)...(205): n = g, a, c or t
ctgttaccgacccacgtcctgctgtctctgtgtggtcctacaaaaactgtccattcccacccctttgctttgccatttgcaagagtctggaattgtcaggtctcagcttcnaaaagtcctggttccactgacaggacacattctttagtggggaattaagacctacaaagtctagtttgtatgtagggtatgaagggaatttttt

SEQ ID NO: 6211 - DNA, 178 bp, Homo sapiens
  misc_feature (1)...(178): n = g, a, c or t
ctgagagtagacacttgtggtatgtggagtacagataagccaggggcatagccacggctcgctccatgaaagctaggagggagtgaaatatcagtgatcatcgcaaggaaggaggcagacaagagtaaggcacacctgactcttaggactagcagtcagaaccaggaggaacccccnc

SEQ ID NO: 6212 - DNA, 328 bp, Homo sapiens
cctatgcctttgctgtcatgtgattctgcagtaccacaggaataaccaccttcctcttcttctgtcgcctggtctcctgaattgttgccactgtctctgatgtaatagccttttaatcccaaattgtacaattttcgatcctccacaaatgccctggagcaaaggcacagtatcttacaatcctcccgctcctcagtgaagagaaacatttccgccacgcggctccacttctcgcagcacattttaccacttcggaggcagctctgacgtacgcagcccgggtcgcgcctgccgggcctccgctcggttactggagacttaaaacagg

SEQ ID NO: 6213 - DNA, 361 bp, Homo sapiens
  misc_feature (1)...(361): n = g, a, c or t
ccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacangtgtgaaaaaatggcaggattnattttggcatgcatgggtncctgaccaatgtnatccttgcngacctcaacctctnagtgtctcctttcctcttgggccngggcactttgggctgccagtngagttcactngttgctattgtcccctgaactgatccangcagttccttacaggcnanagttagtggtctttcactc

SEQ ID NO: 6214 - DNA, 323 bp, Homo sapiens
  misc_feature (1)...(323): n = g, a, c or t
ccatgtgttacgggatcacgcagcaccgtggttccagggctcatccacactggagtctttccttcatatggctgagtgacatcccacggtacagacagtgcattgcatctgcccgtttgtccactgatggacgtttggggtgtttccgcctttggccgtcttgagtcacgctgctgtgtaaggatgagtttgcaggggatggatgctttcattcctctggggcagatgcctaggagtgtcatggctgggttttgggctcaccatgtctagtcggttgaagaactactttccagacttttctacggtggctgcacgcgttnnnn

SEQ ID NO: 6215 - DNA, 155 bp, Homo sapiens
ccattaaatgctggagttgctgaaagcttggccctgtccttgtctcgcctagcacgttccttctctgggtgatcttacccacatctggagctttatgactcagacatttatgtttccaacctagattgcttctgagtcatggtgcagagggtcag

SEQ ID NO: 6216 - DNA, 252 bp, Homo sapiens
attttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgagg

SEQ ID NO: 6217 - DNA, 390 bp, Homo sapiens
  misc_feature (1)...(390): n = g, a, c or t
aaaattctgataaaaatttactcaattacattttatacattaatatttagtgaatttgtccaaaaaggctatgtttaatttatgtgtaaaaataacaaaagatgtatcagtcagtctctgggcaataagaaaggaagaaagccttgctanaaataataaataatctcacgcaaaaggccaggtgacataagaatactacaataatcaatatgttttctttgnatttacaataaaatccatctgttaacactgngatagaaaaaanaatcagtccacatcatgtaataaaaacaggctttgaggatgattatacctcttataatanaaacatacaanggatttctccagctaaaggctnttcaacttgngacaacttgatgaccagncntg

SEQ ID NO: 6218 - DNA, 316 bp, Homo sapiens
aaaacaacagaatgttgctatcagtttgtcttacgttaaaacagttcttaaaccacctactatattaaatacattctaatttggtcactgatgataaagatttttacctagacgttttgcacttaaaaaatgctattaaaagtctttggcaaagccacggtcggggagaaacacgtcgggtgccgcttcccactcgtgtgccctcaccacccacgtggcccgcggagagccaggtcgctgtaaaccacagatgcctgttcctgctcaactcctagggacagtcccagccctgagcagaagggtcaggtcatcgcgg

SEQ ID NO: 6219 - DNA, 97 bp, Homo sapiens
  misc_feature (1)...(97): n = g, a, c or t
tggaccttactcatgcaggngaagatggaatttttgatnctgganattttggtacctttcctagtgaatatctanggttctcttccctagtnntgna

SEQ ID NO: 6220 - DNA, 318 bp, Homo sapiens
  misc_feature (1)...(318): n = g, a, c or t
tngaggtaaagtcatttatataaccaattgnaaagctttgnttaaaaagaaagataacagggtttactggcaagaacaatgaatctttncatgaacttctacccctcccttttctttactgttgtttctagaagcagggagatcacttgtttagtaaggacacctnttactgaaaatnatncnaaaagagagccagttaagaagatgactgtgaataactagagataattagctcttcccgaacgtggggatgctggttntgaaaacagtnttangatgttnagtgggaggnctcccccccccccccccccccgactt

SEQ ID NO: 6221 - DNA, 95 bp, Homo sapiens
aaaaaaatatgtcaaatgacacagataagacaagcagaaaggaaaaaactacatttgttctttcagcattacatatatgagtacttgctccttgg

SEQ ID NO: 6222 - DNA, 397 bp, Homo sapiens
  misc_feature (1)...(397): n = g, a, c or t
ctngtgctgntnagcctggncgcactgagcangancgccnaacccnganagncgancgtncaatgngnctttgaaactgggccatctccacannggatgctacnacntgatctaatncctggnagacttgagggacctccnacncaacctgttacaactagtgtngaaacaggggactattnnatnatgatgaatgtaagctgggnactgcagggcagatgccatgcattcgcttgttgaangccaccangatttgtgtgacgggcaaaancaacttccanntctanacacctccgccaccaccacnctnagggngaattccaccacactggcggccnntactagnggatacctagctcggnaccaatcttggcgtaatcatngtcatagcttgctc

SEQ ID NO: 6223 - DNA, 418 bp, Homo sapiens
  misc_feature (1)...(418): n = g, a, c or t
ncgaggtctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagctttagaactttaagcaacaagaccaccacttcgaaacctggggattcaggaatgtgtggccttgcacagtgaagtgcttggcaaccactaagaattcaaactgggggcttccagactcactggggcctacagctttgatcctgcatctgaatctggagccaggagctttggttttgactgccgg

SEQ ID NO: 6224 - DNA, 162 bp, Homo sapiens
  misc_feature (1)...(162): n = g, a, c or t
ncgaggtccacaccctcacccctgagcagcccggggggccacagcaagaggtacacatgctgtggacaccagcacccccagacctgacccttggggaaggtgaggaggctaggacgtgggacttcctgacagccgtgggcggcngccacgctgaggctcagg

SEQ ID NO: 6225 - DNA, 326 bp, Homo sapiens
  misc_feature (1)...(326): n = g, a, c or t
naggtctgcagttgctccctcatcatgtcactctgtgggctagtagttacagatgttttcatcacaggttcaatagtgtgagaaagagacactagantctgaggaagatanaggggaagggaagttaaatccctaaatgctcctgagtcttcagacaaccattgntgaagctgatcttcaaacctcttggtctcttctttctccagcagcagactgctcgacaaacactgcgccaagagctcctcngcagaanctcctcgcatcagatctctctgtgctgngaatactcccctcttgagcacactctgtgctcctcttcccgttnc

SEQ ID NO: 6226 - DNA, 351 bp, Homo sapiens
  misc_feature (1)...(351): n = g, a, c or t
aaaacttgcctattactgccctcttttccagaaagaaaaggcaagttcaggcttgcagcttaatatatttcatgttctactatttgtcttaagtggnggaagattcactggctcgggatggactggaatggcttaaattgttaagttgcatggcttatggattgtcattctgttccaatggtgcactgccacgttaaatccataagttgaacgaacaaaacttatttgaaggaataagtgcagtataaggatttttagnttggaggtcttcaagtttactatattcaagaagcatctttttcaacttcatggctggacctggggcatgcctgcctcangttttggcttttt

SEQ ID NO: 6227 - DNA, 493 bp, Homo sapiens
  misc_feature (1)...(493): n = g, a, c or t
aaatttgtgttaagaaagggaaaaaaatcacaggtttgtctaactcagtagaaaaatcgacaaagcatttgcagacaacttggcaagggtacagagaaacggatgtactgtttttcantatttggggagggtggtttgagcagcatttattgacaatttcattagtggggatgtttctattgaaaacagagttaggaagtcataaaatgttcctgcaatataaggtaataataccaccagcgtttatcttactgttttcatgttctaagngcatgcatctgagtaaaaggatctgggctgcagtccantctgagagatgccagcaaaggcttcctaggccagttcangtccagtaaatccctcttcgatcttctcttccacacagacagcaagtgatgagcatgcccatgaactcacatgattattttggggaaaaatgaaagagntgtattctttttgaggnaggaatttccctttcnggggccaatacatt

SEQ ID NO: 6228 - DNA, 187 bp, Homo sapiens
gcgaggtcctttgagaagctaagcttggttaaaaggagttttaggatggaattgaaaactgagtctagttctgtttgaagggggcagctttttactcagctttgtgcactttggggtgctcgctcggggtgtccgcatttctcagaccttggtttggttccctgcacagtaagtactaatggttagg

SEQ ID NO: 6229 - DNA, 474 bp, Homo sapiens
  misc_feature (1)...(474): n = g, a, c or t
gngaggtaaaaaacaagttttcctaaaaagtcattgtatttggggcatgtttctcttaaaataacacatgtagtttcaaactaaattttaagaaaggaatatatctgactgaaataaatgctctcgaaataatgcctacgcattttactaaatgcagttttcatctaatactttgaggcatttctgtactagtatattgttttggttcacatgaaaataacttgggaaaaactacaagtaattccctatattaacaataaaagaagaactattaagaataaaagaagaaacactaaagagatacatttactgcttaataaacatttattgagaaactattttgtggtactcancaagaagtgagagttggatgggctcaaatatcngcctataacttacttttctatcctccnattactataaaagcccaagaaactcttctatggctttctttcttttcttttcttttttttt

SEQ ID NO: 6230 - DNA, 277 bp, Homo sapiens
gcgaggtccagagggaaggcccaagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcagcttcgggggtgacatttgtatccggccagccgagcggggaaaggagaccttgtgtcctggcaacagggagggccgggactgggatgg

SEQ ID NO: 6231 - DNA, 290 bp, Homo sapiens
  misc_feature (1)...(290): n = g, a, c or t
gaggtaaacttggctgtattgngtacaactattataccatcttttataaacacagttttttaagaaatttctttttgtaagttacaacattccactggatccttatattgcctgtagtggaagagggtcttgtgtgtctgccccttctagttttcactcatgcagaagcaacataaccttctgatatgcacaataaattacatatatttagcaggatttttatttgccgtgatatataggataatttagtctttggcatgtggcattatatttattttggtttttttttt

SEQ ID NO: 6232 - DNA, 271 bp, Homo sapiens
gcgaggtcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatgg

SEQ ID NO: 6233 - DNA, 302 bp, Homo sapiens
ccatgggggtcttagtgggcccccccttcgggagtgtgctctatgagtttgtggggaagacggccccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcag

SEQ ID NO: 6234 - DNA, 187 bp, Homo sapiens
gcgaggtccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagagg

SEQ ID NO: 6235 - DNA, 378 bp, Homo sapiens
  misc_feature (1)...(378): n = g, a, c or t
gcgaggtaaaagatactttggattcaattaagaagagtttttaagaaaaaagaggaaggttctggcatggggagctctgcaacccactgctgggtgccagaagcgagctgtggaacggaagatgaagatggcaccatgtgtctctaaaccacaaatggaaccactgatttctatgtgtatttgcatttgctgtaatgtgtgggaaatctgaaggttacacagcacaactgtccacagcagatggccctcgaaggggatgaggtttagagccaggcagggcctggaaggactggattttacatggacatggaggacattgcaagagaaaggcatncaaggtgttctcacgaaatccactacaattgtacaagaaaatga

SEQ ID NO: 6236 - DNA, 366 bp, Homo sapiens
ctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagac

SEQ ID NO: 6237 - DNA, 219 bp, Homo sapiens
ctgggaatcgtggcttcatcgacatcatggacatgcctaacaccaacaagtactcctttgatggagccaaccctgtgtggctggatcccttctgtcggaacctggagccggccgcccaggcggagcatgaggatgacctaccggagaacctgagtgagatcgccgacctgtggaacagccccacgcgcacccatggaacttttgggcgtgagccagcag

SEQ ID NO: 6238 - DNA, 201 bp, Homo sapiens; identical to SEQ ID NO: 5066

SEQ ID NO: 6239 - DNA, 333 bp, Homo sapiens
aaaaaagaacagtgaccaccttacaaaccagaaattccaggcaacaccttattcctttaagtaatccaaactattttctatctcctaaatgcagtcttttcccctgactagatactgtgtgcgtttagcacgaggcagaagggtgggggtttcacagtgacgcacacaaagaggcaggagctttgctaggtaccagggaaggggcagcatcttcaagtgcacatgtctgcgtctctgtgaagtcacttcaaagactttatgaagctcagatctgattctgttgaaatcaattggctcctttcccaccaaaattgtattcgagatgttcttcag

SEQ ID NO: 6240 - DNA, 166 bp, Homo sapiens
ctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaagg

SEQ ID NO: 6241 - DNA, 170 bp, Homo sapiens
aaaaagatttaacaagttaacataaaattaaagtgtgtctcaaaaccagacagccatcttgtctgccatcactgagcaaattacagatggactcaatacaaatttgcccacggggcttgcttgcaatactatttcacaaagctgactgtattcttcatcttcataaatgg

SEQ ID NO: 6242 - DNA, 236 bp, Homo sapiens
gcgaggtcctctgccttccttcactgtgcaccctgggctcatgcaccaaggcagagaacaggaagaagtgaggggacaagaagaaggcagaatgtccagatggaggataagaccaaagagccagcacctacaggacttgggctgcttcaggctgaacgctgggagaccacttcctgtgctgacacacagagctcccatctccatgaagaccgcacagcgcgtgtaagccagcccag

SEQ ID NO: 6243 - DNA, 158 bp, Homo sapiens
  misc_feature (1)...(158): n = g, a, c or t
ncgaggtgattttgaaggcagtgttcccttctctccattgactatgagagagttgggggacacacatgcagaagaagcccgtggggagaaggtggattcctggtgtgctggctggtttttcagggctgttagaggttttttttttctttttttttttt

SEQ ID NO: 6244 - DNA, 212 bp, Homo sapiens
cctccacggcacccacggcggtggcttctgtggggtcgctggtaatgggcgccaggcggcggagttcctcaaataattgcaagtggtagatggcagcctctgcctcacgggcaatctaggggagcaacatccgtccagagggacgagagggggacagagctttgtcagagctttgtcacaaaaggagagggaggggaagagtcaccggacag

SEQ ID NO: 6245 - DNA, 262 bp, Homo sapiens
  misc_feature (1)...(262): n = g, a, c or t
gcgaggtaaaatcaaccagtaaataaagcatgaaaaagtcaattacggttatagaaaaggatgctaatgtactagattatgcaaagaaaaagttggtaatggaaattaggaagtagaagcagcagagggaacagtggtagaatgaagggttaaattgcttatgtccttatttctagcagatcaagaaatagtatttggaatggcacaaagaaagacttgttattttttaattataaaaggcgagtgaaataatttttttncn

SEQ ID NO: 6246 - DNA, 370 bp, Homo sapiens
  misc_feature (1)...(370): n = g, a, c or t
ctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggngccaagctagtcccctctggtgtcctcgactgccctgctccctgtgtatctggcaaacctctgttctcccttctccattcatcaggaagggatctgctgt

SEQ ID NO: 6247 - DNA, 377 bp, Homo sapiens
ggcgaggtaaaggcttctggagtgaatggagtccaagttattacttcagaactccagagatcaataatagctcaggtaaggaatggtggtagagtttttgttccctcagagtgctttgcatgtcaaagtgtgggagcaagtgagaggaagattgttgaaactaacctgcaaaacaggacacccttggagggcactcttacactttctttggagaatgacttgcctgctgtctttgcgccttttgtgaagaacaaggaagcagagggagtggggtccttattagctgagaattagtacaagccatctgtattcctggaagctgccatacattttgaacaaaatccccacccactacgtccagttaaccaatttagccc

SEQ ID NO: 6248 - DNA, 264 bp, Homo sapiens
gcgaggtcaatatcaaaaagccttgttagtctatctggatcatatcaaggaaactaagataaatatatttgcttatatttgctatagttttgtgtgtgtgtgtttgcttacttgtggaaaccataatgaccaatattataccatggctgagagtgtagatttggaggttttaatttctgatccctcagttcattgactttgtgacactgattatctaatagttctctgtctcaatttcattagataagttgggaaggctttcag

SEQ ID NO: 6249 - DNA, 371 bp, Homo sapiens
aaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaa

SEQ ID NO: 6250 - DNA, 259 bp, Homo sapiens
ccaaacccagcccttacgcccctgctgacaagggagacaagctgccccgctgaactccaacaacctctgggtgggctcagcagcccctaggaagttaagcgagagctacagggcaggggggctccctgagggagtttgcacagaccaggaggggccaaggggtagccccaagggagcagaggaaggagaagggcaggaaaaggtccagggcacagggcaagcaacagtgccagagggtgcctggtcacaggaagcccag

SEQ ID NO: 6251 - DNA, 375 bp, Homo sapiens
cctgaaggccctgggcttttacgtagtaaaatcattcttaacagactattccagtgctttggttttgaataggatgtagcagaagactcagggctagagatcttcatacatatcaaactgtatgattgccagaagcgtaaagtcacagacgaaatacacacccacgttgggattagcagtgacctgtggggaagctggaggccaggagaggacctcccctcatcactcagccagacagaaaaggatgcagctctttcccagccgctctgttcctctctgtccacaatgctggagcatgggcagatcaaacaaaactcctccctgtgcctaagcatcgaggcgtacgtggaagacgggagtgagtgggtgtgtgcc

SEQ ID NO: 6252 - DNA, 275 bp, Homo sapiens
  misc_feature (1)...(275): n = g, a, c or t
ncgaggtaaacattgacccaacatattaccaaactaattcctgtgaaatacaaaaagaataatatatcatgataaaggtaagtttgtttaacccatggttaatttaacatatgaaaatcaatcatctatcatcttaatagatacaaaaaagaatttgataaaagtcaacacttatgataaaaagcaaaacccttaacaaattaggtatagactgggctttccttgatctgataaatagcatctacaaaactgaacatcaaatattatatttcata

SEQ ID NO: 6253 - DNA, 364 bp, Homo sapiens
gcgaggtctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccagagggccaggaactcgtggtgactgtcactgctcggtgcctggcgctgtctcagccagtagatgcgcatgttactgagggagattttagcctcgcaggacagcatcaccatcttgttggtttgcacctttatgtatgcaggggtctgctggaggactgagttgccatggagaactgtcag

SEQ ID NO: 6254 - DNA, 345 bp, Homo sapiens
gcgaggtctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaa

SEQ ID NO: 6255 - DNA, 345 bp, Homo sapiens
aaaaaagaaagacatattttacatgtatgtgtagaaaataatcaggaagaatgtacaccatattaacaggagattattcctaaggtgaagaattatgagtggttcttatttccttatctacttaagttttttctctccaatgggcaggcattgcttgtaccataccttaagcaaggaagtgcatgtttgggacagcagtttgggctctcagcctccttaagagagtcaggtctgcctcatccctgtatctgctagttgagcagaggccagggctgtgtgaggggctctccaacaattgtctttacaaagtataaaaagtcatcagtgatcccaggaacatgtttg

SEQ ID NO: 6256 - DNA, 252 bp, Homo sapiens
  misc_feature (1)...(252): n = g, a, c or t
ctgttaaacaggttcgttcttggcgccacataaaaacaagccaatcacatcgaataaatcatggctttttttttctttatcacaattcactaagtgatgttaattatggnccttgtcaaacacgtttggtaaaggctatttacagtgtacatggntgagcatgcactatttatagttacaaanatacctgccagtttattacaatagaattacacagngcctgaaaatggngaaacatctcacacatcattt

SEQ ID NO: 6257 - DNA, 356 bp, Homo sapiens
gcgaggtctggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacag

SEQ ID NO: 6258 - DNA, 197 bp, Homo sapiens
gcgaggtctgagagccagcgaagaactgaattccgccaacaacctgaatgaacttagaagcagattcttccccagagcctccatgaaggaatgttgtcctgccaacccttatttcagcctttaagaccctgagcagagaatccagccacactgtgccagactcatgagctacagaactgctatgggtattgtttttt

SEQ ID NO: 6259 - DNA, 164 bp, Homo sapiens
aaagaattttaatacaaacttaatataaactatttcagtccctcttaacatgtaagacactgactcaaaatacttttataccgtttttttcaagtattgcacaatataggtacaaaattaatatttacgattacatttttcttccataatatatagcaaaaatc

SEQ ID NO: 6260 - DNA, 364 bp, Homo sapiens
aaaaggagtttttagaagaaaatagaaacaatgggggaagatggttaaaaattaataataactttccagacttgaagaaaaaaaactgaatcttcacattacagaagcacactatgtctagggcaggataaataacaaatctacactaggacacatcctgatctgcaacacactgaagataaagagagaacagtaaaaatatagattactacctgtaagattactacctacaaactaagagggctcagactaacagcagattttttcattagttaacactgaggcaaggagacaatagaacagtatcttcaaggcacagcagacagtactaaacaactcaactcggtcaaacctaactttctgg

SEQ ID NO: 6261 - DNA, 334 bp, Homo sapiens
cgaggtccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtatcaccatcagctctgtggagaaggtgcccatctcagccctgatgccccttgtgtgaggggagggttgacccacgaatggcagctaatgggtgggtgctggtgggagccgtgccctgg

SEQ ID NO: 6262 - DNA, 297 bp, Homo sapiens
  misc_feature (1)...(297): n = g, a, c or t
cctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggntctctttggagctgtgatcactggagctgtggtcgctgctgtgatgnggaggaggaagagctcagatagaaaaggagggagctactctnaggctgcaaagcaggtgacagtgcccacggctctg

SEQ ID NO: 6263 - DNA, 206 bp, Homo sapiens
  misc_feature (1)...(206): n = g, a, c or t
ncgaggtaaataattaggccacttaatttttattacaccaagagtcagaaaatgattgcagactacatccttttacacaaaacacatttgtagggtttctaaaaagctacatacataaaggaaaaattttagaataatatcctactttcagtgtgtcagggaaatttgctaatatgttttaaggttatgttagtttttattttttt

SEQ ID NO: 6264 - DNA, 177 bp, Homo sapiens
gctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggc

SEQ ID NO: 6265 - DNA, 442 bp, Homo sapiens
gggtaaactgtttactggagaaaatcctcgctcatgtccatttattgttttttctgtactgtgatttgtttcaagcttaggaaaactagtatattagagtatgttctaggaaattaaaggatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaattt

SEQ ID NO: 6266 - DNA, 306 bp, Homo sapiens
  misc_feature (1)...(306): n = g, a, c or t
gccactggaccgtcttcccagtcccatcaagagaaaaccacagactctgggctcactgaagtcttcccaagggattgttgaanaaacttctgaagagggaaactctgtacctgcttcacaaagtgttgctgctttgacagtaagagaagcttagtccttatgccagagaagttctgcagaagaaatcactgtttgtcctgagacccagctaagttcctctgaaacttttgaccttgaaagagaagtctctccangtagcaggagatatcttggatggggtcagaataataatggcagataaggagg

SEQ ID NO: 6267 - DNA, 229 bp, Homo sapiens
ccaatgcccttctagtatgtttggtgaaggtcttgaaggcaccatttcccccatccaccctggggagaaattgagtccctaaagtcaacgacaaggcttattgaggctgagtttgcaacagatccgatctgggaggtagaaacaaaaatgactgaacatctttttatcccccaatcgttacaaagcctaaataactctaaacgggatgggagggcaaattttaggtcag

SEQ ID NO: 6268 - DNA, 292 bp, Homo sapiens
  misc_feature (1)...(292): n = g, a, c or t
nggtaaatcaacttgtctgatgccagggttcagagagacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgattt

SEQ ID NO: 6269 - DNA, 418 bp, Homo sapiens
  misc_feature (1)...(418): n = g, a, c or t
nctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaactcttgtggtacacacagattactgnccaatatgcagttctgcag

SEQ ID NO: 6270 - DNA, 320 bp, Homo sapiens
  misc_feature (1)...(320): n = g, a, c or t
nctgctccctgagaaagggctgggccttgattccctggcactntgaccttttgagcacagcagagtggggacagtttcgagcagagctgcaggtgggagctgggccagtaggcaccagtcaaggagtgggcagggtaccagcagcccccgcattagcttcctagggctactgtaacatgtgaccacagactgaatggcttaaaccacagaaacctactgtcttacagtgctgcaggccagaggccctcaaccaaggggtcggcaggcttggctccttctggaggctctcaggggacccctgtcttctccctttcccccag

SEQ ID NO: 6271 - DNA, 282 bp, Homo sapiens
ctgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccaaagctaaaggatgatgaggttgctcagctcaagaaaagtgcagataccctgtgggacatccagaaggacctaaaagacctgtgactagtgagctctaggctgtagaaattt

SEQ ID NO: 6272 - DNA, 297 bp, Homo sapiens
ctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaagggcgaattccagcacactggcggcccgttactagtggatccgagctcggtaccaagcttggcgtaatcatggtcatagctgtttt

SEQ ID NO: 6273 - DNA, 178 bp, Homo sapiens
  misc_feature (1)...(178): n = g, a, c or t
nctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcag

SEQ ID NO: 6274 - DNA, 418 bp, Homo sapiens
ccattgcccacccaggtaccagcagcagaagactatctgacttggaaagaatgggggtttacaggagtccaggaggtcctttccgctctcctaagagccagtatgttcgcatctttccttttcccttcatttccacatccccccgaagctctagctggaagcatcctagctcatctagggcatccttggtggtagaggagacatggatcttcagcgcttgaccattagactccattcgagaagcagtgttcactgtgtctccaaaaagacaataacggggcatcttcaggccaacaaccccagcacagactggcctttgagaagaaacaggttgggagagtctgggaaaggtggagactagggctggagtgagagtcagccttaccagtatggaccctatgcgtagcctcagacctcg

SEQ ID NO: 6275 - DNA, 216 bp, Homo sapiens
  misc_feature (1)...(216): n = g, a, c or t
gggnccacagatttgggaatcaggattcttcagcctaaagaggttgacagctttcacactttttctgtttgctggaatgacttgtataagacaagaagtaactgtttctttttttctttttgagacagggtctcactctgacacccaggctgaagtgcaagtggtgcagtcacagctcactgtagtctcaatttctcaggcttaggccatcctccc

SEQ ID NO: 6276 - DNA, 155 bp, Homo sapiens
  misc_feature (1)...(155): n = g, a, c or t
aaccataccataccaggcttccggcaggcttcataatcctcggttccccagactcaccggacaccatctcctatgccttggagacctnctgtcacttggctcccttcttaccaccaccaaaactgtcccactgggcctgacccacctatgaggga

SEQ ID NO: 6277 - DNA, 451 bp, Homo sapiens
  misc_feature (1)...(451): n = g, a, c or t
ngtggtgtcgggcactgtcatagtccacgagtttccgaccccgcttggcaattctctccttaatttcactgaactgggcaacatagatttccatggtccttacagcctggtcagccagtttctcctcgtagtcttcccaaaggagatcattattctgtaggatagagtcagaggctggtgaaggctccacttcccaacaacaactgcctaccagggaaatacccaaattctccctgcaaaaaccttttttgtagcaccgtatttagaataccatgttggattctggggactagtcagaggaagaaaagagacagcccctaccccaaggaactgctctatgggagtctgaacatacattcagagattaagaacagggcacaaggtcaaagccttggattccagagcttagatgggaaagtttaagagtgtataactgcatgaagtttgtttt

SEQ ID NO: 6278 - DNA, 257 bp, Homo sapiens
aaattaatttttagttgttcaaagttgaaaactttaactgaaaatacttctgatcatagtgtgacatgaagttaatatttttacctatgaaagtggttacgtatatatatatacacatatatgtatagactgttacagataattgtataaatttgctcgtggagctagtctatatttgaagttatttgtctctgatttctgattttcaaagcttaatgagagttcttctagaaataacccagcccccattttttttt

SEQ ID NO: 6279 - DNA, 377 bp, Homo sapiens
  misc_feature (1)...(377): n = g, a, c or t
nggtctgtacatggtgcaccatctttggggtatctgtttttcccttttcgagttactgggatttaagagttcattactaagttgtactgggaagtagagcacatcttgagtcagtaaccttaaccactacagcaaatccgacgtcacagagggacagtctgtacggggctgtctggactagcgaggtcaacagtgaaagnccatagattgatggcattagtgagctgaaagtgagtanggatgatggggaaaggaataagggggtaaagcaagcagccatggaagaaggaggccagggaagtcaagagtgccttccacagaagtgggtcccagcctttctttgtagactgactgcttactttcctcgacagangcag

SEQ ID NO: 6280 - DNA, 159 bp, Homo sapiens
  misc_feature (1)...(159): n = g, a, c or t
nccttctagcatggcatcaattccgatataggttcctgtgcgcccaacaccagcactgcagtgcaccacaatgggaccactgaagaaattgctgaaggcattcactctccttctcagtttgaggagcaagtgaggatcctcaggcaccccgtggtctgg

SEQ ID NO: 6281 - DNA, 139 bp, Homo sapiens
  misc_feature (1)...(139): n = g, a, c or t
agggttctgtggaacaccatttctcaaaggggcatcctgcanacgttccagccccaggggaggccccgagatgctggctggcctgcctggagggtgcttccanaaacaacggagatggnggtgaanaaggctcngggct

SEQ ID NO: 6282 - DNA, 152 bp, Homo sapiens
  misc_feature (1)...(152): n = g, a, c or t
caattaagaagagtttttaagaaaaaagaggaaggttctggcatggggagctctgcaacccactgctgggtgccacnaagcgagctgtggagcggaagatgaagatggcaccatgtgtctctaaaccacaaatggaaccactgantcctatg

SEQ ID NO: 6283 - DNA, 269 bp, Homo sapiens
gcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcacttt

SEQ ID NO: 6284 - DNA, 317 bp, Homo sapiens
  misc_feature (1)...(317): n = g, a, c or t
nnggtctgagccgacttaggaatctcccatccccgccccaggaaaaagaaccaagagaaaagaaccgtttgtgctaacagtcatcgccaactgccgtgagtacaaactccggttaagtactgctgctgcgccagcgccctggcaggcatgatcacctcccattggtagggccacagctccattctgggaatggaaggggactagacccactgggcctccactcatcccactcctggacctcggcgcaccacctaaggggaattcacacactgcggcgtctatgatcgantcggaccaacttgcgatatggcatantg

SEQ ID NO: 6285 - DNA, 307 bp, Homo sapiens
  misc_feature (1)...(307): n = g, a, c or t
nggtcctgggtgagggcgtccatggtgccagccgtgccattcgtcaagcctgtggcgccaagtcctccattcagagccgccatacctgagagcatttgagcaactgctagtgcattaatattattcagtccaacagtggctccagccagtccttgcagagtcccaagagaggtcaaggagttcatggctgcaccagcagtggagttgggggttgaagcagccacgggactcgtgagggctcccagggcgctgctcgtggtagagagagggtttgcattggtgctggtggctgaggtctgggccgcag

SEQ ID NO: 6286 - DNA, 297 bp, Homo sapiens
  misc_feature (1)...(297): n = g, a, c or t
nggtctggctcgcaggcgtcgggggtaacctggtactgactctacccgcaggccctggggtgggtcagggcgcactaagggcatcaagacacaaagtcagggtaggctatgggtctccatcacttccccaccacttcccaaagtgtgtgtttaaaggagccttagccagacactcctgagaggggaggggaaatcttaaacttgatcatccattagactcagaccggtcatctgtattatgaaatgggctgaggccgcgtgtggtggctcatgcctgtaatctcagcactctggaag

SEQ ID NO: 6287 - DNA, 399 bp, Homo sapiens
gccaggatggtctcggctgcctgacctcgcgatccatccgcctcagcctcccaaagtgctgggattacaggcgtgagccaccatgcccggcctgtgtatcttctttatgtttaccctaccaagagcagacctgagcattttgctggccgtagaggtatataaaagaactctaagcttaggcatgcagaataggcactggatgaatgtagtgaggctattaggagtcttgttggctccctgatgtccttatcatgtcttcttcgcagactgtggatgcacacaagacagctaaaaccttgggcatcatttgaaaatgtttggctgcctgctacaatctcaggagagagaatccttcatacttatattggactggatatattgtcaatcaaattctttttt

SEQ ID NO: 6288 - DNA, 287 bp, Homo sapiens
gaaatgactaggacattaaagggattgtttcagaagaactatcagcaccttttttatgtgtcatgttcatccagactatccatccagataattgctttatttctgatatgtcttccaaggttgttaccccgtgtgggataggcaatgaatttaactgtcttttgtccctaaaagttttataagtttttatctaacatattcatgtagtggaaaaaaactcacaaaagtgctttcaagcattcacagtggtgtctaagccactattaattgaaaaagctgctgtattt

SEQ ID NO: 6289 - DNA, 212 bp, Homo sapiens
  misc_feature (1)...(212): n = g, a, c or t
gggnaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaattt

SEQ ID NO: 6290 - DNA, 519 bp, Homo sapiens
  misc_feature (1)...(519): n = g, a, c or t
naaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaacttttttccctacaaaattttaaggtgaaaaatacaatagtaaattaagattacactggggaaaaaaatgcaggtatcactttactccattggtatctgacctagagcttaattaaggttttagaaatatgtaataccttccatcattccatcatccttaaattctggtaccaaataatggctaatggtacaaaaaggtatcctccaganacccaagcttgaca

SEQ ID NO: 6291 - DNA, 429 bp, Homo sapiens
gactttgtaagtttcttgatctctttagtatgatgttaaaaacagaagggactgaagatttctggcattgaagaaagctattttatgaacattctgcactgagcaggtaaaaacccaataatgcacaccaaaagtaccccagaaaatggggtagtcccatgtagtggagccccaaaggtaggtgctttctgcctaagtggagctcaaggtagcaaaaaataatggggatgagccatggcaccttgtcaggctgtgctataaagccatatgtactgttatttacaccccatagacttaatagtctgtccaagatcgctgaacactagaacatagcatggctctgtgggtttgtctcttgctacattgtaccgtgctcctggggttaagtggaagcaagcattggggagaaatgtgtgagatttagcccca

SEQ ID NO: 6292 - DNA, 457 bp, Homo sapiens
  misc_feature (1)...(457): n = g, a, c or t
nggtctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatanactcttatgaaagttctttgtccttgaagtcacatttacatcagtatttatttggggaaaatcttctggggttaatt

SEQ ID NO: 6293 - DNA, 302 bp, Homo sapiens
gcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattgactaaaaaataagggtatgtaactttgcattttgaagaacaaaccaataatttttcatgagccctactcgatcttcttt

SEQ ID NO: 6294 - DNA, 336 bp, Homo sapiens
gggtctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcaggctgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagagg

SEQ ID NO: 6295 - DNA, 278 bp, Homo sapiens
  misc_feature (1)...(278): n = g, a, c or t
naggtccttccaattcaggccacatgtacctccagatactatgtggctggctgcctctgcctttttgggcaatctcagttccaaatattctatcatgttgtcatgccagcttttggcttgggaaatatggtcagtatgtctgtggggaaactgattctgtgtgccggccgcagaggaaggactctgggctggaggaaaggggtagggctcagcgccagtgctaggactggttgaactgtagggtgcagccctggctagtgaccacaccccatgtccag

SEQ ID NO: 6296 - DNA, 378 bp, Homo sapiens
  misc_feature (1)...(378): n = g, a, c or t
nctgctctttcagctttgaacgtcctttcccattctccatcatccacattcacctatcctgcctgccccagttaaaatcctgtttcttctaggaagtccctcatcccacccgcttaccccagggagactgagcttgttccttctcctagtaagaccctcagcccatggagtcctgtgtgatgtngtgaagcgtgggaggacagactgaactgctcggaccgtggagtcctgtgtgatgttgcgagcggggaggacagactgaactgcgtggtgcttcgcacatagacctcaacagggattgggattttgaagctgntggcgggggctgaggactgcttttcttcctttctagctcaaccggcagntaaagccactgnn

SEQ ID NO: 6297 - DNA, 413 bp, Homo sapiens
  misc_feature (1)...(413): n = g, a, c or t
gaggtccaatgatttaatgaattatgcctacataatgaagcctccggaaatctacaaaagaactgggttcaaagagcttctggatagctgaacacatgggggctcctagaaagtggcatgcccacagagagcagggaagctccatgccccttcccatgtaccttgccctctgcacctcttccatctggntcgcatctgtcccctttgtaatatcctttataataaactggtaaaagtattttcctgggntctgtgagctgctctagcaaattaatcaaaccccaantgagggggtcatgggaacacttatttataactggttggcgagaagcacangnaaaacatctgggacttgtgattgtcactggaagttggggagaggnttangactcaactctcaaccttgtggaatc

SEQ ID NO: 6298 - DNA, 245 bp, Homo sapiens
aaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggcatgcgaggagagtttgactcactgttgcagtgg

SEQ ID NO: 6299 - DNA, 247 bp, Homo sapiens
  misc_feature (1)...(247): n = g, a, c or t
cctggaaggtgtgcaggagtttggtagaggagtgatctaggtgaggggaatggaaggtgcagagaccagagctgagagggcctgaggcactttccagagcgtggggaggggcctccaccaaggcgagaagggctgcangtccagatcaccagcgtttgtagacagtagtgtggcgcttggagtttacctgagggccagtggagctccagggacctatcangacggggacctgtggggactgggaagg

SEQ ID NO: 6300 - DNA, 341 bp, Homo sapiens
attttttctttatttttctttataaagtgaagagtaggtagcatgaattcctcttgccctttgctatttcagtctggcatcagtagcaattgttgctatgtccagttttcattcatggatttttctgggattgaagatgagttcaatgttgattatttaattgggcagtataagtaaattcattggctctccttccagtttagtgaatactaaatatcatccatgatattttatacttcttacacttctggaatctaacctgaaaatagaagttgtaagtcagggacggtggtatgtgcctctagtctcagctagttgggaggctgaggcttgagcccagg

SEQ ID NO: 6301 - DNA, 438 bp, Homo sapiens
  misc_feature (1)...(438): n = g, a, c or t
gcgaggtgagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggctgatacccaagagcttgtacaagaacatcggggactgctacctgctctctgccccggggccccacgtcctgcttctggtgatccan

SEQ ID NO: 6302 - DNA, 248 bp, Homo sapiens
  misc_feature (1)...(248): n = g, a, c or t
gngaggtcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccag

SEQ ID NO: 6303 - DNA, 345 bp, Homo sapiens
  misc_feature (1)...(345): n = g, a, c or t
gaggtccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcctgtggtggcttatgtcttaaacatnaactctattgacaatctctactctaaaatgttggcaaaaagtgaa

SEQ ID NO: 6304 - DNA, 205 bp, Homo sapiens
aaatggtagagggttagtggaagtgcacacgttgtttttagcccaggggtagtaacaaactcttactagccaactagaaaattattttgttgacgagatgtcccttttaggagggcttgtttcctgaaagaatgccaactttttttgttgttctttcagtattggcttgagtgacctgttctcctgagtgctctagtgtctccag

SEQ ID NO: 6305 - DNA, 347 bp, Homo sapiens
  misc_feature (1)...(347): n = g, a, c or t
gcgaggtctgtgttggcatgcacctgcagtctcagctacttgggaggctgagacaggaggatcactcaagctcagaaggtcgaggttacagtgagctatgatcatgacactgcactccaacctgggcagcagagcaagaccccgactcaaaaaaaacatatgaaaagaaaaaagtatggagcatagttggggaaaagcaaatagccctatctgagcacagtcgactcatgatgctctcttctactataactgcctttacttttctcataaaagttgaaaaataccattctgccatttgtgcattaatttgctagagttgtagcaataaagtagcaganactggaagg

SEQ ID NO: 6306 - DNA, 348 bp, Homo sapiens
aggtaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcaaccttgtgg

SEQ ID NO: 6307 - DNA, 177 bp, Homo sapiens
catggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgt

SEQ ID NO: 6308 - DNA, 201 bp, Homo sapiens
cctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctgg

SEQ ID NO: 6309 - DNA, 340 bp, Homo sapiens
  misc_feature (1)...(340): n = g, a, c or t
cataggaacgcactcaggcaggtggtttgttctggatgcagaaaccagagatctagtttctatccacacagacgggaatgaacagcttntctgtgatncgctnctcaatagatgganccttcctgnctgtaggatctcatgacacctttatttacctctatgtagcctctgaaaagggaagaaaatatagcagatntggaaggtgnactggacattccagcttacatcacacaccttgactgggcccccagacaacaagtatataatgnctacctcggganactatgaanattgacctgggacattccaaatggctgcaaactaatcaggaatcgatccg

SEQ ID NO: 6310 - DNA, 195 bp, Homo sapiens
  misc_feature (1)...(195): n = g, a, c or t
natcatttaatggaaatctgcacttcaaaacagcacttgaaggaccagccattggccctccaatgtaaatacttctcatttcacattatcagagaacagtgcagtttactaaccactccttccttataagaaattcagtactgtaaaattttttttcagtttcaaaacatttcaatcttattaattccaaagatc

SEQ ID NO: 6311 - DNA, 309 bp, Homo sapiens
  misc_feature (1)...(309): n = g, a, c or t
aggtccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggcatgtctaaaggcatcgtattgaggaagttcctgaacttcctttggtagtttgaagataaagttgaaggctacaagaagaccaaggaagctgttttgctccttaagaaacttaaagcctgggaatgatatcaaaaaggtctatgcctctcancgaaatg

SEQ ID NO: 6312 - DNA, 186 bp, Homo sapiens
aggtctggagatgttgggctgggaggccctgtggtcactcatactgcaggagagagaagaagggtacaggtgccagcttctccctgcccttaagcgaggtcagctccaccaggctcacgcactccaggacctcagcctgcaggcggcccagcagctcacaggcagcgttcatggttccaccagtgg

SEQ ID NO: 6313 - DNA, 172 bp, Homo sapiens
gaggtaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttt

SEQ ID NO: 6314 - DNA, 194 bp, Homo sapiens
  misc_feature (1)...(194): n = g, a, c or t
aaaagctatttacacgctacattctatgaaaaatatgcttcaggaaatacatctaaaattaaaatacangattgcctgagaaacaaatccancccctccgtgtcgatggtggncacaccatccaggtacgacccatgcaggcgacaccacacgctgacacgggagaacagagaanngccgaccgnaagtcctcg

SEQ ID NO: 6315 - DNA, 289 bp, Homo sapiens
  misc_feature (1)...(289): n = g, a, c or t
atggtacctatggaattgcttntattttagngaanatggaataaattncacccatccccattgtcaagnaatnaaaatatgcctctttttctactgntgaatgattcaaaatcaggtatttctggaaatactcagaaagggtaggaagggaaggagaaggtcaataggtgcatcagaaaaaggtataaaaatcatctaccnttaatcataagggtggatggattgcacttttccacttatttcaacacataatttttctaactagtatgaatgattgcaaccattttgg

SEQ ID NO: 6316 - DNA, 297 bp, Homo sapiens
  misc_feature (1)...(297): n = g, a, c or t
ctgacatggcgggagtttcagataccatacaagtcactggtctctctggaacaacttcatgttcttctgctactactgcagactctacaggtgttaacgtaattgaagattctggctcttgggggggggtctngaacagncacagcagcctctgatactaaaactganggatctgatgctnacactgaataatcagnaggcactgctgaaggctccgaaatctcactttgactcacaggaggctcaggctgcgatacagactcttcagatggtaatgatggcacctctgtaggccaa

SEQ ID NO: 6317 - DNA, 129 bp, Homo sapiens
  misc_feature (1)...(129): n = g, a, c or t
ctgaaggaccaacaagggaaacggngatgagagagactgcccattataactttcaaaaccccgtctttggggaagaatcatctagggngacattcctttgaagtaaaatccccaggagaancttnggcc

SEQ ID NO: 6318 - DNA, 370 bp, Homo sapiens
  misc_feature (1)...(370): n = g, a, c or t
ctggaggagtggcaggccaagtggagcgtggagaagcaccaaaagtggtctgaagtcagagaagttggtggaacagctcactgaatacagcacagacaaggacgagcctccaaaggacgtcttttgatgaattatttaagctggctccggagaaagtgaacgcagtgaaagaggccatcgtgaactttgtcaaccagaagctggaccgcctgggcctgtctgtgcagaatctggacacccagtttgcagatggggtcatnttactcttgctgattggacaacttgaaggcttcttcctgcacttaaaggaattttacctnactccgaactctcctgnagaaattgctgcacaacntcaccctggcgcttg

SEQ ID NO: 6319 - DNA, 120 bp, Homo sapiens
  misc_feature (1)...(120): n = g, a, c or t
ccaaaggtgtgggtacttgtattcatcaatgaatccagaggaaaatgggctgctctgaaataaaggatctggaaatgaaggaaaatgtgcatgagtatgcnagtgtgtgtgtgtgtgngt

SEQ ID NO: 6320 - DNA, 113 bp, Homo sapiens
aaatgttctcacaacaacaaaaaatgataagtatgtaagattcttaaccacagttgatgtacctcacaggaagagcttctctttcaagatgtgtagctgcccgatgggttctt

SEQ ID NO: 6321 - DNA, 280 bp, Homo sapiens
ctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacag

SEQ ID NO: 6322 - DNA, 277 bp, Homo sapiens
  misc_feature (1)...(277): n = g, a, c or t
ccagagggaaggcccaagagacgtctctgaagccaccgttcctgattattcagaggcagggtccacagtgagtgactcggtggggctggaggaacccagggtgacccagagggggctccggagccgggtccctaacatctgaaaaagtcctcccagggaactcngagcttggaacttccaggcagcttcgggggtgacatttntatccggccagccgagcggggaaaggagaccttgtgttctggcaacagggagagccgggactgggatggacctn

SEQ ID NO: 6323 - DNA, 120 bp, Homo sapiens
ttgcgcatgacaggcaaatgcagccaagttaccgtccttgccgaaaggttacaggtttggatgcaagatgctctgggaagtgcacgcagatatggggggagaaaagctgctcagaccttt

SEQ ID NO: 6324 - DNA, 101 bp, Homo sapiens
  misc_feature (1)...(101): n = g, a, c or t
acantattctgtggtcctgtgaactcagacttaaagcctgggggaggaggtcctgctgagttggtgaatctctggtaacggtgggaaaatggaggatactc

SEQ ID NO: 6325 - DNA, 227 bp, Homo sapiens
  misc_feature (1)...(227): n = g, a, c or t
aaaaagacaacaaaaacagaaacagacttgcattagaagacacacactcacctgcctgggtggtcagacacttgcccatagttcagcccctacacatgcagtgtgggcaagagccnggggaaatgataaagcctggncagttttttaccnggaggcacaacnatggggaatgatgggagatgaactcaaaccatgctntgaagtnagtgccagggacaaattttagg

SEQ ID NO: 6326 - DNA, 115 bp, Homo sapiens
  misc_feature (1)...(115): n = g, a, c or t
ngtttcagaanactcttggtggcaagcagcctgtgtatgataccacaattagaactggcagagcactgaaagaaaagactttgcttcccgaagatagtcanaaacttgacaattt

SEQ ID NO: 6327 - DNA, 183 bp, Homo sapiens
aaatgtaggacctatttcatgggtacctactacagacaaagaagaacaagacttttttgtgtgtattctaaggcacaacaagtgcaggaaggaaatgacctctttcccgtaaaagtccctggcagtagttggttgctgcataagagtgtcatgggcccggagggagctgggcccagatgcagg

SEQ ID NO: 6328 - DNA, 118 bp, Homo sapiens
  misc_feature (1)...(118): n = g, a, c or t
ctgctttccggcaaanatcaacctctgctggtcaggaggaatgccttccttgtcttggatctttgctttgacgntctcgatagtgacactgggctcgacctcaagggtgatggtcttg

SEQ ID NO: 6329 - DNA, 213 bp, Homo sapiens
aaatgtgtctttgatgcatactttagaagcacactggctcgcggtttccatccctcttgccttgggacactcctgaggctggcagccctcctgcaatgagttgctctcagttccttctgtttggatcttgctcaacatctccagtttctctgctctgaaaaatgggaaaaactgctaaacatcccagagatttgcaatcttctagctctccag

SEQ ID NO: 6330 - DNA, 224 bp, Homo sapiens
aaaaatgtattatgctatgtttatttcctataggaattaaggataacctagacgacataaagaggataattaaagccagagagcacagaaataggcttctagcagacatcagagactataggccctatgcagacttggtttccagaaattcgtattcttttggtgggtccagttgggtctggaaagtccagttttttcaattcagtcaagtctatttttcatgg

SEQ ID NO: 6331 - DNA, 353 bp, Homo sapiens
  misc_feature (1)...(353): n = g, a, c or t
ntgcagccactgtgctaaagcgggcagtagaactagattcggagtcgcggtatccgcaggctctggtgtgttaccaagaggggattgatctgctcctgcaggttctgaaaggnnccaaagataatacctaagagatgnaatctcagagaaaaaatttccaaatacatggacagagcggaaaacataaagaagtacttggaccaagaaaaagaagaagctaaagaaactcctgggatttctctcagattttgttgggaatcaaaacacctcaggagttaagcattcctaatgattagagggcagatggaaaatatcacacgccnattaaaatagaaagagaatgcnacccgggt

SEQ ID NO: 6332 - DNA, 250 bp, Homo sapiens
ctgctgctccaggcggagggagggagagagaaatggagagtgtgcgctgctgatcagcgcgaggcccaggggggtgaggtccgctccagggctctgctctgctctgatcagggagctcactttccagaaacgaagtcccagagcaccagaaaaggaaccaaacccagaacctcactttctaagtagtgctggtgagagaataaaactgtccatcagtcaacgatgaattcacatagagcaaggctgacaa

SEQ ID NO: 6333 - DNA, 171 bp, Homo sapiens
  misc_feature (1)...(171): n = g, a, c or t
ctggtgcttgtctggctgggtgaagtgctaggtgtcattggggactgtccagagctagttcagcgctccttcctggtggctagtgttctgcctggccccnatggcaacattaactcacctacaagaaatgctgacatgcaggaggagctaattgcctccctagaggagcaa

SEQ ID NO: 6334 - DNA, 341 bp, Homo sapiens
  misc_feature (1)...(341): n = g, a, c or t
nggccnangtctgttacagccctcaacagtgaaagtaactttgcccgagcatatgcacagggtatcagccgaaccaagtactgggagttgatttatgaagactctatggatctaatcgcaaagctaccttgtgttgcagcaaagatctacccgaaatctctacagagaaggcancggtattggggccattgactctaacctggactggnctcacaatttcaccaacatgttagggctatactcgatcatcagttnactgagctcacgcgcctgtacctcaccatccacagtgaccatgagggtggcaatgtaagtgcccataccagccntttggtgggcag

SEQ ID NO: 6335 - DNA, 129 bp, Homo sapiens
  misc_feature (1)...(129): n = g, a, c or t
ctgagagactctaaatccantgacaagtctgtctgcctattcaccgattttgattctnaaacaaatgtgtcacaaagnanggattctgatgtgtatatcacanacaaaactgtgcnatacatgaagnct

SEQ ID NO: 6336 - DNA, 187 bp, Homo sapiens
  misc_feature (1)...(187): n = g, a, c or t
ccaccggncagcagccctctgtgatgtgtgtgcagagtgaacagaggactcaggtttcatagcanctagtgcggggcatcctcatcctgtacctatagagttcntgcactcccccatccatgctacctacctccccgtttnctgnttcagttttaaacaatgaaancagcatttcnctgctttcatt

SEQ ID NO: 6337 - DNA, 154 bp, Homo sapiens
  misc_feature (1)...(154): n = g, a, c or t
ctgagctctgaatcanagagcagtgagacctaagggtccctgatctcanagggtccctcctgtctcagggtgaggacctgaanggtgtgggtcccngggagggtgaggaggccattgttggaaatttactgagntgggatcgggatnccccana

SEQ ID NO: 6338 - DNA, 314 bp, Homo sapiens
  misc_feature (1)...(314): n = g, a, c or t
ccttttgccatacagtcctgggtttgaatgcagccccctcctcacaaactggctatgtgatcatgaacaaattaaccggccagctccaatttgcttcttaatgttgtgaagtgtaaatgangccatgactggcangcggtacctggaaaaaggggctttgtttttactaaaaagctgtctgaactttcaaattaaggcanagttcaaaataagtgatagntacttagttggaaaatgaaacctatccaacatacaggnngaggggtccttctagagatgtggcattgagacaatgttggaacattntatacann

SEQ ID NO: 6339 - DNA, 294 bp, Homo sapiens
cctgacaggatgatgattttagaaactagaaagagttcaacgggtctggcacaaaagtggcatctgtgggtgtgctggagaatttcgctggagagatgacagggtccaagtcagaaaggaccttgactatctcaaccaagaatctggcatttttctgcaggcaatgaaaacaacattgagagattattagcagtggaagagaaagttcttaatgtgatttagaaagatggcaccaagagccgcgtgaagaatgagaagcagtggctgagagagaaagcagagactggttagagg

SEQ ID NO: 6340 - DNA, 337 bp, Homo sapiens
  misc_feature (1)...(337): n = g, a, c or t
ctgtcaccaccaagcatgaactttcactgattacccataacctactggaaatcttcagccttgctgtcagcatagaccactgtgagaaacagtacattccattccagtttgccctgctttttgaagatctaaatgccattccatgttttctgttacatattgaagtttcttggctgccaaagaaaaacggactntgctgaacttgtggacagaacaaccccaaggttggaagaacaatgaaaaataatctatacttgaacatttcaaaanttaaanattttcaacagtagtttnaacacactggaagcttaaaatacatcgacactgaaatggtnaa

SEQ ID NO: 6341 - DNA, 100 bp, Homo sapiens
  misc_feature (1)...(100): n = g, a, c or t
gggggccgangtaaacatgactnggtgctgaaagacacactgctgggacccaagttccctcccacatggacgggatggatgctggaacccaangtttcaa

SEQ ID NO: 6342 - DNA, 113 bp, Homo sapiens
  misc_feature (1)...(113): n = g, a, c or t
ctggcctgtgggtgatcccagctcttactaggagagggagctgaggtcctggcgccangggcccangcccttcaaccataaacagntcangatggaaccttggttcacccttt

SEQ ID NO: 6343 - DNA, 201 bp, Homo sapiens
  misc_feature (1)...(201): n = g, a, c or t
ctgaatcagcctgggtgccctagacccagtcatgtttgttggaccaaattagctgtcttttcatttcatgctatatagaactggcagtttacacttctgattaatacattgtctccgatcaggaggtttattttttttttcctaataaaanctgaaaggagattggnaagaaccaattantaattttacattacacnttgt

SEQ ID NO: 6344 - DNA, 145 bp, Homo sapiens
  misc_feature (1)...(145): n = g, a, c or t
ctgaatcaccagctccttttatgatatttgtgtttgtttcacaatttctcaaggactaaagcagctcagtttgcattgctttctgctggtaanggcgggaaaagtggtggtggtnacccccacaggagtgatggtaganaaggna

SEQ ID NO: 6345 - DNA, 267 bp, Homo sapiens
  misc_feature (1)...(267): n = g, a, c or t
ttggctgacttccacacctagcatctcatgagtgccaagcaaaaggagagaaganagaaatagcctgcgctgttttttagtttgggggttttgctgtttccttttatgagacccattcctattttnttatagtcaatgnttcttttatcaccatnttattaagtaanaaaacatcactgaaatgctagctgcaagtgacatctctttgatgtcatatggaanagttaaaacaggtggagaaattccttgattcacaatgaaatgctc

SEQ ID NO: 6346 - DNA, 222 bp, Homo sapiens
  misc_feature (1)...(222): n = g, a, c or t
cctcatcagcagggatgagatcacagcctacttcatgagagccagctcaatctattccaagctgggcctgggctttcctcacaacttccaagagaccacctacctgaagcccactttttgtgacaactgtgcttggatttctctggggagtgatcaaacaaggatatcgatgtaaagactgcgggatgaacttgtcacaaaacaatgcaaaagatctggtgn

SEQ ID NO: 6347 - DNA, 175 bp, Homo sapiens
ccttagcagtagcctgagctgcccccagggctgtgagctgctgaatcttctgactcatcatttccatgacggcctgttttcatggcgtgcttctcctgaagagctggttggattttctccatctgcttggttagaaaatctatcttcctcttgaagaagtccttggcatcctcag

SEQ ID NO: 6348 - DNA, 252 bp, Homo sapiens
  misc_feature (1)...(252): n = g, a, c or t
ccaccagcatcaaaagaagaaatccttgagggtactgggtgagttggtgggcaagcgctgccaccttcagtgccagcacaatctggggtcagcaaagaggggtagcaagtgtgccttanagatgaagaaatggctaaggaggaaagcactgtaaaggtgacttggggaatcctcctgagacctaagatttgaaactaattgtccaagtcccagcctctgctctgggaggctccaggggccaaggtaagcagg

SEQ ID NO: 6349 - DNA, 196 bp, Homo sapiens
  misc_feature (1)...(196): n = g, a, c or t
ccttagccctgctcctctctattccatcctgtagaggtcgggagtcaggagtcgctggcaggagacagcatgtcacccaggactctgccggtgcagaatatgaacaatgccatgttcttgcagaaaacgcttggcctgagtttcataggaggtaatcaccanacaactgcagaatgtggaacactgagcaggacag

SEQ ID NO: 6350 - DNA, 301 bp, Homo sapiens
  misc_feature (1)...(301): n = g, a, c or t
ctgaaagggacgttgttggaagcgttctcggaaaggttcatgtggttctgcaccacgatgtaggccatctcacctttatgtctttcattattcatcacaagaggaatgttcagaagcatcgtgtcactgaaaataaacatccaaagatctcttgcccagggcggagtatctggcctggtcagnaactctaggntgccgtctctgtcgatgaatgatatcatgctcgccagcagaggggtgacagcaccttggacccgctttcagagggtgtgcctgaatgtgcccncctnctggagagcnt

SEQ ID NO: 6351 - DNA, 350 bp, Homo sapiens
  misc_feature (1)...(350): n = g, a, c or t
cctacaagtagggagggagggtaataaaaaaacgaatcccaggaagagcaccacgaaagcgggaagcctgaagtcacccacaaagggcactgcagacaccgcaccaggaatgtttcttaagagctggcagtcctctccagggagagagcanaggaggggaacagccgcagggactatagagtttctaggactccacgatgtgccggcacagcatgctgccatcacacacgctgacctccttgtcctgtgcaattacatgactaggacctgccttcgacaagcgtctgatggtctatgagcacattccgcttaccttcccaataaaataacaaagaaatacaaaacaaaac

SEQ ID NO: 6352 - DNA, 238 bp, Homo sapiens
  misc_feature (1)...(238): n = g, a, c or t
gncgngcaggtctgatttctgaggagctggattcaatgtgggaggtgcagcagagctggaagcaccctgcactctgatctctagctgggggctctgtttccaaacttggttgtcctcagtggctgcctcacaccagtatgacccggagtgatcttctgaagctgtggggatctggaattctgaggagagccccctgctttgcactatccttccatccttgtagaaggagaagaggagg

SEQ ID NO: 6353 - DNA, 101 bp, Homo sapiens
  misc_feature (1)...(101): n = g, a, c or t
tgggggaggggacctaaaataaatagactttaacatttcccttgggtgctaatcatagttggaagttgaatttaaggngattatttgggtgacaattaaaa

SEQ ID NO: 6354 - DNA, 123 bp, Homo sapiens
  misc_feature (1)...(123): n = g, a, c or t
ctggagagagatcaatatgctgaacaaataaaaggagagagggcccagtggcagcanaggatgaggaaaatgtcgcaggaggtttgcacattgaaggaggagaanaaacatgatcncatcggg

SEQ ID NO: 6355 - DNA, 423 bp, Homo sapiens
aaaagtttagagaaggaaagtatagtgttaaaggggttcggggagatttcatcaatggaacggcacagggaaacggctttcaaggagaagaaatatttcacaaaatgaagagacaaaaagggccaacaaattcagcataagacaatatattaatggaggaaaagtcaccatgtttgggaaatgtggagttcaggttagtgaagggctggatctttgtaggcagagataaaatgggcaaggaacatttgcatgaagtaattttatttaattaggagcattatgaggaatcacagcaattttttgaaagagtaatgatatgatcaaagttaattaaagttatgatcttcagaaaaattaatctggccactgtgtacaagaatagattggaatcaaaaggaacctggaggtgggaacaccactttg

SEQ ID NO: 6356 - DNA, 129 bp, Homo sapiens
  misc_feature (1)...(129): n = g, a, c or t
gtgacccangtagaggaagatatggtgatggtgttgatggatggctctgtgaagctggtgaccccggaggggnccccagtccggggacttctcacacctgaaatccccatgaccgaaacggtggagccn

SEQ ID NO: 6357 - DNA, 248 bp, Homo sapiens
  misc_feature (1)...(248): n = g, a, c or t
ctgatcagactcctggtgccactcccaaaaaactatcaagttgggatcaggcagagacccctgggcatactccttccttaagatgggatgagacaccacgtcntgcaaagggaagcgagactcctggagcaaccccaggctcaaaaatatgggatcctacacctagccacacaccagctggagcttgcttactcctggacgaggtgatacaccaggccatgcgacaccaggccatggaggtgcaactt

SEQ ID NO: 6358 - DNA, 351 bp, Homo sapiens
  misc_feature (1)...(351): n = g, a, c or t
aaattctgcacagaaaaaggagaaagggtattaagatggcaccagagagacacaccatcaaatgttcagttcaggagtaggtctatagagttttctgacagggaatgtcacagaattgccagcatgttcctcaatggactctttgcttcttggagcttctgagacacttcaagacttgaagtgaccactggctgtgncctccagccccagggagcccagaagttctgagatgtgtatcttatttcagttccctactgcagctagggtcttaggagggaccctagttacaggatgaatcaaataccaaaaggtgaggttcaactgttccttgtcctggaatatcattcttgg

SEQ ID NO: 6359 - DNA, 122 bp, Homo sapiens
  misc_feature (1)...(122): n = g, a, c or t
cacacgcctgttcccagcaagtgctgaaactcactagacccgctgcctgtttcgaaatggggaaagccntgcgtgcgcgttatttatttaaatgcncctgtgtgcgcgggtgtgggaacaca

SEQ ID NO: 6360 - DNA, 131 bp, Homo sapiens
ctgtgagaggcagtgcgcccgcctcccagggagaacgaggaaccgccaggagacaggtctacctgcaccaccggcaaaccagagggcccaaggccagggccgtaagccctgggagtacactcccttaaaga

SEQ ID NO: 6361 - DNA, 401 bp, Homo sapiens
  misc_feature (1)...(401): n = g, a, c or t
cctaagcatagggccattttgaaacacatgtggctcatcacaaaccacacaatattcatttaatacagggatccgctgttcagcaaactcaattgtctgcaccaggaagccacggtctcgtactggaatgcattttgcaccatttggagcaagctgagaagatgaagatgaagatggtgttaggataccaataagccctgaggtaagagagagcctcctgccctctgcgttaggttccttgaaaagctcagttttggatgacttgggggcactggagtaggacttgctgagcaatttgtgatttttcagtccatataattcttccattctgagattactagagtaagacctgcttaacagtttatggggnttcaagtttgtgttgtgctcacatcgtggat

SEQ ID NO: 6362 - DNA, 107 bp, Homo sapiens
  misc_feature (1)...(107): n = g, a, c or t
aaanctggctcaanactggcccangcataatactgtcaatctaaaggtaaccggcnacatcaaaaantacatctcaanagaatcangnttaaanatcaacaggagaa

SEQ ID NO: 6363 - DNA, 322 bp, Homo sapiens
aaatcaatagtgattattgcgagcggcagccccagctacacacgtcgctgggagctgattactgctacatctcaccgcagcgtagagtttagtcacagcttctccccacaatattgcaagtttaagtggtggagagtcgcaaagaaaaaacacaagaaaccccaaataataataacaacaaaaacaacaataacaactgtaataataataataataataataaaaaccctaagggatgtatgaactggttttaactaagtaggccaagggatcattggttctgatttgcattcatctctacagtaaataaaacctcgttttt

SEQ ID NO: 6364 - DNA, 254 bp, Homo sapiens
cctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgcctttttt

SEQ ID NO: 6365 - DNA, 388 bp, Homo sapiens
  misc_feature (1)...(388): n = g, a, c or t
aaagttgctttgaagctcgtctataaatggcttcaagcaacatgactggttggttgtgagaattaaagggtcattaactgaataactccaaagtcattaacatgaccaaggtaaggatacnagaaataggaaaaggaaaatcctattccaagttggagggccatgccatcaaccacagtggtctgtgccagagcaacactattcgctagtggttctatactgacttctttactggctttccatctttgtatttattccctctgcaatccgtttcattttcagtagaagccagtgtcgaataggaataaagaatctgtgtattgcggtcagacagatttgggctagaataccanctctagactttctagtttccatcactttggggcag

SEQ ID NO: 6366 - DNA, 217 bp, Homo sapiens
aaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttgtttt

SEQ ID NO: 6367 - DNA, 343 bp, Homo sapiens
ccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtgg

SEQ ID NO: 6368 - DNA, 100 bp, Homo sapiens
  misc_feature (1)...(100): n = g, a, c or t
ccttggtgctcagtggggagactcaggaacgggagcgaatcctctaccagttctccanacgcttccaccattgnaatccggggatcttcccctcantacn

SEQ ID NO: 6369 - DNA, 362 bp, Homo sapiens
ccagcagggattcagccggatcagcatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggtgcgtgcatcctctaatgacaaagcaaccttgtatttccttccacaaatgaatggaggcagcctaacgtcatgtggcccctccagccagcgtcag

SEQ ID NO: 6370 - DNA, 324 bp, Homo sapiens
aaaaaagggaggaagaatctctgttttaatgtagtttgcttctacaccatctgtcccacaacactgttttaccaccttcagcacaatttttttcatttcctcatcaggagactggaattctcgaataagggattaacatcacttctctagtatagtagttggcatattctgcatccataagaggaataagatacccaatagccttcaagaaagcagccaaaccctttcctctgtgttggcggatacccttccataaaggctttaacacagaatcaaaagattcgataccataaggagttgctgcttcagccaaggcagcaatgg

SEQ ID NO: 6371 - DNA, 121 bp, Homo sapiens
  misc_feature (1)...(121): n = g, a, c or t
nctgcancttctgatgatgccccctaccctgtctgtaccgngcggtacttccctagcacagncnatcacaccctgcagtgggcccggcatgagtttgaanaactctaccgactgncngcag

SEQ ID NO: 6372 - DNA, 338 bp, Homo sapiens
aaaattacactttttcttaacctgtctagctgtcggaaaaggtaacagaagatggaactcgaaatcccaatgaaaaacctacccagcaaagaagcatagcttttagctctaataattctgtagcaaaaccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcattt

SEQ ID NO: 6373 - DNA, 348 bp, Homo sapiens; identical to SEQ ID NO: 415
  misc_feature (1)...(348): n = g, a, c or t

SEQ ID NO: 6374 - DNA, 274 bp, Homo sapiens
ccttccaattcaggccacatgtacctccagatactatgtggctggctgcctctgcctttttgggcaatctcagttccaaatattctatcatgttgtcatgccagcttttggcttgggaaatatgggtcagtatgtctgtggggaaactgattctgtgtgccggccgcagaggaaggactctgggctggaggaaaggggtagggctcagcgccagtgctaggactggttgaactgtagggtgcagccctggctagtgaccacaccccatgtccag

SEQ ID NO: 6375 - DNA, 299 bp, Homo sapiens
ctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccag

SEQ ID NO: 6376 - DNA, 395 bp, Homo sapiens
  misc_feature (1)...(395): n = g, a, c or t
ctgagagactctaaatccagtgacaagtctgtctgcctattcaccgattttgattttcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagagattgggttccgaatcctcctcctgaaagtggccgggtttaatctgctcatgacgctgcggctgtggnccagacctct

SEQ ID NO: 6377 - DNA, 204 bp, Homo sapiens
  misc_feature (1)...(204): n = g, a, c or t
aaaaatgttagcagttttcaaaatcacctgaacatccaagtaggatccacccaggagagatctttaatggagngaccctcacactctataaaactgacaggggcaacgaattgaaccttgacttaacaaaaacacatcctggtattcataagtctctgttaggaagtccgtggaggtaggtgggagccggaagttagggctcag

SEQ ID NO: 6378 - DNA, 289 bp, Homo sapiens
ctgatcgaaatggcattgctgtctctaggttattcacatagctctgctgcccaggccaaagggctagtccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattgg

SEQ ID NO: 6379 - DNA, 223 bp, Homo sapiens
  misc_feature (1)...(223): n = g, a, c or t
cctggaaggtgtgcaggagtttggtagaggagtgatctaggtgaggggaatggaaggtgcagagaccanagctgagagggcctgaggcactttccagagcgtggggaggggcctccaccaaggcnagaagggctgcaggtccanatcaccagcgtttgtanacagtagtgnggctcttggantttacctgagggccantggagctccagggacctattacgac

SEQ ID NO: 6380 - DNA, 306 bp, Homo sapiens
  misc_feature (1)...(306): n = g, a, c or t
ctgttcagaaagctcattggacctggttttgaaaataaaacaaagttaaaaccctgggaggagttattgtgcagtgtggagtactcaggctttcttataaagaaaaaaaaaagttatctggtaccaaagtgtgcaacctacagaccctcaggnactgccctgngacttctntgtatgacatcacaaggctgccaagtgcctgtttttntaaaactaggagttggngaggtttggctantgctgaaaccatgcataggattggtttactaaattaaaaccttattacgnacgtcctccaaaanacan

SEQ ID NO: 6381 - DNA, 191 bp, Homo sapiens
  misc_feature (1)...(191): n = g, a, c or t
nccatttaactggtcangcaattaagtcaagggaaaatccatttgggatttctgagaaagctttgctttccctcataaaaggngatatatatagctggnacaggcccatttccatttttttctttcctggccttcacnatggaccncggcccgcngaccaccctaagggggaatttcancacnctggcggg

SEQ ID NO: 6382 - DNA, 116 bp, Homo sapiens
  misc_feature (1)...(116): n = g, a, c or t
aggtcgatgggcctatttgtttggtgctggcaccaactcgggaactggcccaacaggtgcagcaagtagctgctgaatattgtagaacatgtcgcttgaaatctactttnattcta

SEQ ID NO: 6383 - DNA, 249 bp, Homo sapiens
  misc_feature (1)...(249): n = g, a, c or t
ggaggaggctgattgcactccacaaacaggactgnctggaccaacggaaactggcangagggaggtgggaaaggaaaaaggcaaacntttggcttttataaagcaaaggacgtttatttnctgaggncatgacacacgaagtggaatcctagccacggctgcggagctctcgtgatgaangccggagtgctgactgacatgccgggtggaccangagctggagtctgttatcttacacnaatgctcatg

SEQ ID NO: 6384 - DNA, 112 bp, Homo sapiens
  misc_feature (1)...(112): n = g, a, c or t
ccatcccagtcccggctctccctnttgccanganacaagggctcctttccccnctcggntggccggatacnaatgtcacccccnaagctgcctggaagttccacctccnant

SEQ ID NO: 6385 - DNA, 204 bp, Homo sapiens
ccaaaagatttccccagacacggttctgcacttgatccttcctgagagccctggcagccacgaggagtcacgagagtactctttagaggaggtgaaggagcttttgaacaagttgatgctgatgtctggcaagaaaggatcgtaacaacacggaagtggagaggttttcagaggtcttctgcagtgtgcagaggctcagccagg

SEQ ID NO: 6386 - DNA, 230 bp, Homo sapiens
  misc_feature (1)...(230): n = g, a, c or t
ncctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcaaccaggtgctgtgacaccccccttctgaatgaagccttntgacctgggctggcactgctgggggtgaggacacattgccccatgagacagtcccagaacacggcag

SEQ ID NO: 6387 - DNA, 242 bp, Homo sapiens
  misc_feature (1)...(242): n = g, a, c or t
ngnctgcagccccttgaacaggtgaaagctggaatagaagctcattcggaagccaaaaccagtggactcctgtgggctggattggcactgctgtccattcagggnggggcactggcctggctcacgtggggggngtactcctgggatatcatggagccaggttacattcttcatcacatttgcaaattctatggtcttttttgcatactttatagtcactcgacaggattatacttactcag

SEQ ID NO: 6388 - DNA, 156 bp, Homo sapiens
  misc_feature (1)...(156): n = g, a, c or t
atttcatttcngtttcttttctcgccatgtttttctgtcggaattacngttcgttttggttctatgtactctctaaaatgttatcgtttttcatttgtctactaattttcntgcatttngttactacctgagtatnttaanatctgactggctcca

SEQ ID NO: 6389 - DNA, 261 bp, Homo sapiens
  misc_feature (1)...(261): n = g, a, c or t
ctgcgtcaccacctcctgggtggcagggagacgatacatatttcctaatgaccgggatggttttattaggattggcaagcgggacttcttagcctctctgttggtaataccagggagggaaaggaagggcagnctgccacccaggcaccccgtgcaggttctctggccgatgctctgcgctgagtgcagtgttgatcggtttctcttcccaagcctctcttgttgcttcatgcttgaatctcagcaggtcgccctccgtgg

SEQ ID NO: 6390 - DNA, 153 bp, Homo sapiens
cctcaggtttttgtgttctctgaagctcaggggacaggaactaagtccccattctcgctttggcttcctgctctgggactcagtttcccccgtgcagcagggggcttgggcaagtccaaggagaggtgggggtacccacctgtgacatgaagg

SEQ ID NO: 6391 - DNA, 284 bp, Homo sapiens; identical to SEQ ID NO: 416
  misc_feature (1)...(284): n = g, a, c or t

SEQ ID NO: 6392 - DNA, 248 bp, Homo sapiens
ctggcgttggcagggaggaatggagagcttgtggaaggtgcgggaagggagggctgtgcttggcctgagagcaggaggacaccgggaacagcacgatgggctatgcccgctctcaaagagcttgatcaggccggagggacctggatggggccagttatacataagacaggccaaaacacacgccctgagagagatggaaaatgaccacaccagagaaaggacagcaccacgtgcctcgaggggcttgg

SEQ ID NO: 6393 - DNA, 175 bp, Homo sapiens
  misc_feature (1)...(175): n = g, a, c or t
gatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccanccacagattcaggagttcaaagagg

SEQ ID NO: 6394 - DNA, 252 bp, Homo sapiens
  misc_feature (1)...(252): n = g, a, c or t
aaacatgacttggtgctgaaagacacactgctgggacccaagttccctcccacatggacgggatggaggctggagcccaaggtttcagggaaacgtatgtggcctgtgccccctgggngtnatcatggggcacacacattttatntgncagggccagccttggctgttgaggggtcatgggcacacaggaggaccatctgntgacactgaagaccagntgttgnccacagccatggacaataaggaanaata

SEQ ID NO: 6395 - DNA, 338 bp, Homo sapiens
  misc_feature (1)...(338): n = g, a, c or t
aaacttactagctgccaagtagcacacttatgctgctgtgtcccaatccattctgtggtgagtataagtcacaagagtctgcataaaacactatcagcaatcaggatggctatggggcaaggaccgtttanaatgttaccaagtcacaggaccagcaggaaaatggaataatggaagaatgtgaaataaatctgatttgtttgagtagaaggcagctttgattcaggcataaatgcatctcccagattatcatgtaaataaagacctcagaagttgacacttccctcccagtccaccacttaaaacaggacacatgctcagttttcccaatctgtttt

SEQ ID NO: 6396 - DNA, 273 bp, Homo sapiens
caccacacatgatcataactaagccttgacggcatcactgtcccacctactggaacttgtccgtgaaaatccacacagatgctgcacatccccttatcccctacaaggaggctggagatcttccacaatgcaggctgcagcctgcttcttcatttgttaggagcagggaaggaaatgcagaagctgagaaatgagggccaagaaagccaggcagtaggatggagacccaagggacatcagggcagaaacaaaatagtacaaaggagaagagtg

SEQ ID NO: 6397 - DNA, 119 bp, Homo sapiens
  misc_feature (1)...(119): n = g, a, c or t
aaaatcagtggcaccgaggcgcctgcagccgcactcgccagcgactcatctctccagcgggttttttttttgtttgncgtgtgcaatcctcacnctcatgaacatacncaggtttnccc

SEQ ID NO: 6398 - DNA, 262 bp, Homo sapiens
  misc_feature (1)...(262): n = g, a, c or t
cagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccanattaaaaaaacagaatttcctgctggggttggagtcggctgctccctcccaaacatctgtgtacttntgngcca

SEQ ID NO: 6399 - DNA, 312 bp, Homo sapiens
  misc_feature (1)...(312): n = g, a, c or t
aaatagagccaaccagtcattttctgagactaaactctggcaaactgcttcttcatgtagggaattgataatttagaaactagtttgcattttcaggtatgtctccaaaggattttttttttttaagtaaactatccgcctaaattgttaancccttttggggcagcaaaaacagcccttattacccatcaacaaccagtttgaacgggaattcagtgttntttgggaaaatgngtttttacaaaggagcagtaattaggcccccactgnttaacagatgacccnaancaaaaaaggaacnaaaatgtaacc

SEQ ID NO: 6400 - DNA, 287 bp, Homo sapiens
  misc_feature (1)...(287): n = g, a, c or t
ccaagggtcgctcactgggcaggaacattgtcaaggccattcatgcttggaatagggtctctcttcagctctgaggcaaatctgttctctaatttacagatgacttcaaggggaacgtgtacccgcacccctctggtgcgtcacattgcttaggaagcctgctgtgtttatcactgggtggctgtcagggctgagatggagagggccagggcctggcgaggtggagcagtcggcccaggtgtcccancaattgttgctggaacagggtctggaacccacaggagagg

SEQ ID NO: 6401 - DNA, 315 bp, Homo sapiens
  misc_feature (1)...(315): n = g, a, c or t
cccgtctgcgtcctgcatccatctccctgttacagtggcccgcatcatgattaaagaatgtggatccctctgtctggggtgggatgccttactttgcacttaatttaataagggcattctcngaggagtagacntttaatacgaagtggnggcatagccctgccganatgtcggtgatggcctggatgctgtaaccacaacctgtggctaaaaattttattttctatcctttacccgtcattatcattagttgctatgattctttctgcattttcggttaactatcatttccaaagacttgtcattcactaatat

SEQ ID NO: 6402 - DNA, 152 bp, Homo sapiens
  misc_feature (1)...(152): n = g, a, c or t
aaactgcataatttagtaaaattggtacaatttcttttcacatattaatcaacattagaggactgtaaatgcctccctagtaatacagaaatatccattggaaataaaaatagcaccagtggggaaagtatnaaaaaaataagacaantcag

SEQ ID NO: 6403 - DNA, 177 bp, Homo sapiens
aaataaaggtcactattgctgtgaaatgggatgtcagttttgcaattcttctgcactttcccaccaagctgggatctgggtgagtctagagatatttgtgaaataagctaatttgaaaggacaccacaatccgtcaaaagcgactttcttcctcttccacagcacgatgaaggccag

SEQ ID NO: 6404 - DNA, 213 bp, Homo sapiens
  misc_feature (1)...(213): n = g, a, c or t
aaacattgacccaacatattaccaaactaattcctgtgaaatacaaaaagaataatatatcatgataaaggtaagtttgtttaacccatggttaatttaacatatgaaaatcaatcatctatcatcttaatagatacaaaaaagaatttgataaaagtcaacacttatgataaaaagcaaaacccttaacaaattangtttagactgggcttt

SEQ ID NO: 6405 - DNA, 204 bp, Homo sapiens
ctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagccgtataggagaattaga

SEQ ID NO: 6406 - DNA, 206 bp, Homo sapiens
ccagagggaaggcccaagagacgtctctgaagccaccgttcctgattattcagaggcagggtccacagtgagtgactcggtggggctggaggaacccagggtgacccagagggggctctggagcgggtccctaacatctgaaaaagtcctcccagggaactcggagctggaacttccaggcagcttcgggggtgacatttgtattc

SEQ ID NO: 6407 - DNA, 221 bp, Homo sapiens
  misc_feature (1)...(221): n = g, a, c or t
cctgtgtccaggtctccctggcggccctgcagagatcttcctagcccgagagcttctctgcttgggtcctacggttccaagcctggttccattttcttctcatttggtgagagtccacctcaacattcggggctggagtggctcactggcctcccagtgtcgcatggtccgtgcagaggggagcatctctgcctgtctncttctggaccctttgcctttgg

SEQ ID NO: 6408 - DNA, 172 bp, Homo sapiens
ccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcatga

SEQ ID NO: 6409 - DNA, 172 bp, Homo sapiens
ctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccag

SEQ ID NO: 6410 - DNA, 217 bp, Homo sapiens
  misc_feature (1)...(217): n = g, a, c or t
ccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctcttaaantaga

SEQ ID NO: 6411 - DNA, 148 bp, Homo sapiens
ctggttcacgtgtggagctagttaatacgtcctgccaagatgggtaccagttgactggacatgcttatcagatgtgtcaagatgctgaaaatggaatttggttcaaaaagattccactttgtaaagttatccactgcaccctccacca

SEQ ID NO: 6412 - DNA, 197 bp, Homo sapiens
  misc_feature (1)...(197): n = g, a, c or t
ctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgacagtgacagtcaccacgagttcctggccctctgggattccgcaaaangg

SEQ ID NO: 6413 - DNA, 187 bp, Homo sapiens
ctgcacagcttctaaaccataatttttaattttgtagctaatttgttagtcctgcaaaggcagtgtagtcccagtcaggaagagggtttttgttacagtctttctttcaaagtgaaactatcaactaagttcctcccaaagttagtttggtatccacccaggaatgaacaaggacagcttggaggtt

SEQ ID NO: 6414 - DNA, 205 bp, Homo sapiens
cctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcatt

SEQ ID NO: 6415 - DNA, 189 bp, Homo sapiens
  misc_feature (1)...(189): n = g, a, c or t
ccaggncactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaagnccacctcattttcagttaacatgtgccattaaatan

SEQ ID NO: 6416 - DNA, 191 bp, Homo sapiens
aaaagggaaaatctcacacataattaagcagtggaaaatgtgctcaatgctatggtgcgtcaggccctctgtctaccaggtttctcccctttctgcagagctgtggaccctgtacgtaccaaacaggtgaacttggtccatctttccttcttcctttttttgcacatttgcatttatatcttcccgtacta

SEQ ID NO: 6417 - DNA, 180 bp, Homo sapiens
  misc_feature (1)...(180): n = g, a, c or t
cctgcnagaccccccaaagccagcagtcagcctacttcctgttaacactgtttagagaggtggctattttgtacagatcccacaatgcaagcctccaccccacgccagagcaatgngaagcttgtgagcaaattcattggcgaatgcaagatctttcacctctgatatcngccgttttgg

SEQ ID NO: 6418 - DNA, 210 bp, Homo sapiens
ctgggtcattataaaacctcacaccaggagttgtgatggcttcactcttatgcagaccttcatattccaatctcattaaggcttttcttctgacatcctcatagagttcttttattggatcaagcaggtcttttagtactatgtgattaattttgttcttgcaaatgggacaagatataaatccaaatgttatccttgggccaagccatc

SEQ ID NO: 6419 - DNA, 217 bp, Homo sapiens
aaaaacagatccttcaagctaagttaacacttctaatataaaatgtattttttcttcataaaaacaaaggaaaagcaaaagcttttagattcacttgaaagaattctctctctttctctgtctctcacacaaacacacacccatacacacatacatatacacacataacgattacaaagaagttgttttttactgaataagagataaaattttacct

SEQ ID NO: 6420 - DNA, 111 bp, Homo sapiens
  misc_feature (1)...(111): n = g, a, c or t
tgtgttggcatgcacctgcagtctcagctacttgggaggctgagacaggaggatcactcatgctcagaangnngaggtnacaganagctatgatcatgacactgcactcca

SEQ ID NO: 6421 - DNA, 181 bp, Homo sapiens
  misc_feature (1)...(181): n = g, a, c or t
cctctttgtctgtgagaggaaatggttccctcactttaagttctgtaggctaatcagaaagggatctctctatagtttcaaaaagtgaaattttacttgcactacagaaataagaaacttacagatttgtccttgaagacctactaacctgcaactttagggtcctgaaagangattaagt

SEQ ID NO: 6422 - DNA, 155 bp, Homo sapiens
ccacaccctcacccctgagcagcccggggggccacagcaagaggtacacatgctgtggacaccagcacccccagacctgacccttggggaaggtgaggaggctaggacgtgggacttcctgacagcggtgggcggcagccaggctgaggctcagg

SEQ ID NO: 6423 - DNA, 184 bp, Homo sapiens
  misc_feature (1)...(184): n = g, a, c or t
ctggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttattncaccntagtga

SEQ ID NO: 6424 - DNA, 129 bp, Homo sapiens
ctggctgaggaccagcccgtgcacggggaccttgacctcgtcatgaacctcatggatgcacacaaggttttccagaaggaactgggaaagcgaacaggaaccgttcaggtcctgaagcggtcaggccga

SEQ ID NO: 6425 - DNA, 211 bp, Homo sapiens; identical to SEQ ID NO: 515
  misc_feature (1)...(211): n = g, a, c or t

SEQ ID NO: 6426 - DNA, 197 bp, Homo sapiens
ctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaa

SEQ ID NO: 6427 - DNA, 208 bp, Homo sapiens
ccaggtggccctccgtgtgaggtcatggtcacagcatagtttggagctagggagggactgtcagcctggaggtttggagactcattctggaatctagtgtgggtctagccaacttcagggagaggctgagccagggtaggagtcacaggagcagacgaggatgtggggtgccgtgcacagagctccatgaccagcttgggaagttaaa

SEQ ID NO: 6428 - DNA, 193 bp, Homo sapiens
  misc_feature (1)...(193): n = g, a, c or t
ccttgctcatagtatacacaagccaggttgccgtgcaccactgcgtgatttggactcaaacttagggcacgaagataagctgccacagctctgtcaaaaatgcgtgcctctttcaagacatttcctaaattgatataagcatccagaaagtttgggtcaagggtgacaagncttttcaaagtgatgaattgca

SEQ ID NO: 6429 - DNA, 198 bp, Homo sapiens
  misc_feature (1)...(198): n = g, a, c or t
aaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattganccacccccttggtanacct

SEQ ID NO: 6430 - DNA, 198 bp, Homo sapiens
cagacatttattgaactcctgatgtgtgccaggccaggcaccaaggaggagcacacagaggtattagataaagtcctggcccttgaggaacttctggatgatctgaggaaagaaaagtaggtgggcagaagcttctgtcaatcccaggcttctcccctctctctgtggtctcaggaaatgggagagccagaaaggggt

SEQ ID NO: 6431 - DNA, 204 bp, Homo sapiens
ccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacga

SEQ ID NO: 6432 - DNA, 199 bp, Homo sapiens
aaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagat

SEQ ID NO: 6433 - DNA, 109 bp, Homo sapiens
ccacattttaagtgctcagtagtcacgtatggctaagggctactatactggacagtacagattcatagagtataaaatatgactttaactttggagatggtgaggtagg

SEQ ID NO: 6434 - DNA, 196 bp, Homo sapiens
aaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatt

SEQ ID NO: 6435 - DNA, 195 bp, Homo sapiens
cctacagacctggctcatgcccttggatgtggctgactctacttctagactgtcctgaagagattatctgaatcttggacagagattatgatgtcatttataacagtgaaaaaacggaaaacctcaatagccactagaagaaatgactgatgagtaaattatattaaaataacacaatttattttttcgtggaat

SEQ ID NO: 6436 - DNA, 198 bp, Homo sapiens
aaatccattgtttctttgttgatttttggttttgatgacctgtctagtgttgtcagtggagtattgaagtcccccactattattttgttgctgtctatctcatttcttaggtctattagtaattgttttataaatttgggagctccaatattaggtggatgtatgtttagaattgtgatattttcctgttagacaagg

SEQ ID NO: 6437 - DNA, 212 bp, Homo sapiens
ccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggcttggaa

SEQ ID NO: 6438 - DNA, 211 bp, Homo sapiens
  misc_feature (1)...(211): n = g, a, c or t
ctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccagagggccaggaactcgtggngactgtcactgctc

SEQ ID NO: 6439 - DNA, 216 bp, Homo sapiens
aaaatgcatgtattataatcatataatcataactgttgttaattcttgattatatacctagggacaatgtgtaatgtaagattactaattggttcttcccaatctcctttcagattttattaggaaaaaaaataaacctcctgatcggagacaatgtattaatcagaagtgtaaactgccagttctatatagcatgaaatgaaaagacagctaatt

SEQ ID NO: 6440 - DNA, 212 bp, Homo sapiens; identical to SEQ ID NO: 417

SEQ ID NO: 6441 - DNA, 189 bp, Homo sapiens
  misc_feature (1)...(189): n = g, a, c or t
nctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaactttgg

SEQ ID NO: 6442 - DNA, 206 bp, Homo sapiens
  misc_feature (1)...(206): n = g, a, c or t
ttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagntgttaataaaaat

SEQ ID NO: 6443 - DNA, 212 bp, Homo sapiens
  misc_feature (1)...(212): n = g, a, c or t
ctggtgtatctcatcctcaggttgctttacaacgtcatctcctccagaggaaacgcagcctcgtcatatccctgagaaacaggtctgctgtgtcctccctccgcacgtatagactgtccctccaggaggttagacacctcccctgaaactgcggcttctgtgtccaccttcaccacacttccgtcctcctcatcttggagcacaacctngnc

SEQ ID NO: 6444 - DNA, 212 bp, Homo sapiens
  misc_feature (1)...(212): n = g, a, c or t
ttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccaganccttcaggcaattggataaga

SEQ ID NO: 6445 - DNA, 217 bp, Homo sapiens
  misc_feature (1)...(217): n = g, a, c or t
ctgagcaaatggatatgtatctagttgtaagaaatcaagaagaggatataaaatataatcaggatgtggactctgaaacggaataacctctttgtcctgtaacttttttcacttgtaataatacagcattctcaccctattaaatggaaatttagagcacccttaaattccngaataattaaaattgctanttggattgaaaaancccctaagggat

SEQ ID NO: 6446 - DNA, 203 bp, Homo sapiens
  misc_feature (1)...(203): n = g, a, c or t
ccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggnccgccaaggaagaa

SEQ ID NO: 6447 - DNA, 207 bp, Homo sapiens
  misc_feature (1)...(207): n = g, a, c or t
ccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctnct

SEQ ID NO: 6448 - DNA, 208 bp, Homo sapiens
ccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcca

SEQ ID NO: 6449 - DNA, 193 bp, Homo sapiens
  misc_feature (1)...(193): n = g, a, c or t
aaagcttatttttcaattcataaaaaagacatttattttcagtcaaatggatgatgtctccctcttttcccctattctcaatgtttgcttgaatcttttattattttttttaattctcccccatacccacttcctgatactttggttctctttcctgctcaggncccttcatttgtactttggagtttttctc

SEQ ID NO: 6450 - DNA, 222 bp, Homo sapiens
ctgtactatcttcagttttcaaagagggatgctaagaagggattacatgctactctggggttaggactatgtctcttggattgccctatcttacttggcaccctatgtgaggactaaaactagaatacatttgttactataaataaatgtggcatggtatacctagggaaaaaaataaggaaacagttgcaattacatgggttatcttaaaaaccaaaaacc

SEQ ID NO: 6451 - DNA, 212 bp, Homo sapiens
ctgctctgcgtccacctcctccccaacattgtctcgcacgttcagtgctgccttctggaagaacttcatgtacttgttgaagacagtctggatctcctcgttgatgctgggctgcaggacagctcggaggagatccatggagatggcaggatctgtgaaacttgttgtcatctgtgagcggcggcccctccgctgcacctgccggggcttta

SEQ ID NO: 6452 - DNA, 180 bp, Homo sapiens
  misc_feature (1)...(180): n = g, a, c or t
aaattgcagttattctcccaggggttgaagatacacatggaagttcatttgccagtgcactggctgatgttcaatatttggaaataccccagaacagtactattcagcagttaagagtgagagagtgctttttacataagaacagtgagtggcaggttacagaaactgacaggtgaatna

SEQ ID NO: 6453 - DNA, 189 bp, Homo sapiens
  misc_feature (1)...(189): n = g, a, c or t
aaattagccctataaataaaccaggcattctcttttcttcttgttttgttgttaccttacaggaaaaaaagtttcatatcataattaaggcttagggacacagacttcagagccaataaaattttggttcaaattccagngctacctcctactagctgtgagatattgggctagtttcttaaccattgc

SEQ ID NO: 6454 - DNA, 183 bp, Homo sapiens
  misc_feature (1)...(183): n = g, a, c or t
aaaaaaagacaatttgagcaggacgaccctctccaatctgggtagcatggttagcctgtgcagtaacaacgtaggcttggaggatgggtncaatgaaaatgattctgattcggaaacgttttgactttggactgtanaagcttttctttgatcacctgtgntggaggaaaggaaagaagcctt

SEQ ID NO: 6455 - DNA, 191 bp, Homo sapiens
  misc_feature (1)...(191): n = g, a, c or t
aaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtanaagaaatgggctgga

SEQ ID NO: 6456 - DNA, 193 bp, Homo sapiens
  misc_feature (1)...(193): n = g, a, c or t
tgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgngggggtggaccatgctttt

SEQ ID NO: 6457 - DNA, 195 bp, Homo sapiens
ctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgactt

SEQ ID NO: 6458 - DNA, 210 bp, Homo sapiens
  misc_feature (1)...(210): n = g, a, c or t
ctgctgagctattggtattgctgtgccagaggggaggggatgaggggctctgcgaggaaggagaggagggtcccatcctcagatacagcagtgtgcagtgagaagaccccagtaccgcgtattgtagagattgaggtggggagagaggaagtcagggagaggcgcctgtggccccaggggcaactgaccacgaatncccttnccacccca

SEQ ID NO: 6459 - DNA, 186 bp, Homo sapiens
ccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcaca

SEQ ID NO: 6460 - DNA, 201 bp, Homo sapiens
  misc_feature (1)...(201): n = g, a, c or t
ctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttggtgtcgagggagctggcttctaattgngcca

SEQ ID NO: 6461 - DNA, 187 bp, Homo sapiens
ccaccactaaaggtcccagttcagggaaagcacaggagccggaagcggtggcatgggcagcatttcttactcagtcctccagcacactctgtgaagtgccctgggggcaatgaaaccttctccctagtattcccgatgacccacgaacaagttgctcccatgcacatcacacacagaaaggacctcg

SEQ ID NO: 6462 - DNA, 174 bp, Homo sapiens
  misc_feature (1)...(174): n = g, a, c or t
ctgcaacgcatcattcggacaggccgtacaggtcactggttgaaccatgggaaggaacactgcttggtgagcagcagtggggcccaatccaataggtggagcacaaagaagaatcatttgatttcttactgagaaaaagttcaaaggtgtggtttcataaggtaatctgctatn

SEQ ID NO: 6463 - DNA, 201 bp, Homo sapiens
ctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaaccagaaacca

SEQ ID NO: 6464 - DNA, 202 bp, Homo sapiens
ccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaaaa

SEQ ID NO: 6465 - DNA, 204 bp, Homo sapiens
  misc_feature (1)...(204): n = g, a, c or t
ctggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttcancantaggagaacctaatattta

SEQ ID NO: 6466 - DNA, 206 bp, Homo sapiens
  misc_feature (1)...(206): n = g, a, c or t
ctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatnancc

SEQ ID NO: 6467 - DNA, 143 bp, Homo sapiens
ctagaacctgggtcctagtttgtacctagaatatgaggcaagtggcgagagtgatcgtgttcctgaccctgagtactttgagccttgctaagaccacccagcccatctccatggactcatatgaaggacaagaagtgaacata

SEQ ID NO: 6468 - DNA, 136 bp, Homo sapiens
  misc_feature (1)...(136): n = g, a, c or t
tgaattcagtgagagattcacatcattgcaagagccacgcatgtgttggatctgtgtcagtactgccctcacccacttcggtcccatcactgacttggcattaggtctactctctcttcctgggactgncanaagc

SEQ ID NO: 6469 - DNA, 154 bp, Homo sapiens
  misc_feature (1)...(154): n = g, a, c or t
aagctgctccacatctaccaacaatcccggaaggacaactccaattccctgcaggtgaaaacgtgccacctggtcaggtactggatctccgccttcccagcggagtttgacttgaacccggagttggcttgancanatcaaggatctgaaggct

SEQ ID NO: 6470 - DNA, 202 bp, Homo sapiens
ctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatgggattcct

SEQ ID NO: 6471 - DNA, 198 bp, Homo sapiens
ctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaa

SEQ ID NO: 6472 - DNA, 192 bp, Homo sapiens
  misc_feature (1)...(192): n = g, a, c or t
ccaagacagagnccctacccccaaggcaggattcagtctcattttattgtctttcccatccccagcactgtctggtcctgtgtgtcactgaaggaataaagggatgggccctggaaagggtgggtcanagctgaccttggtgaagcctgagtcaggccacagagctgggagtcaggcatgtaganggataca

SEQ ID NO: 6473 - DNA, 204 bp, Homo sapiens
  misc_feature (1)...(204): n = g, a, c or t
ctgtgactgagggcctggtcaccacaattagagcttgatgcctcccggctttgcagggagaccaggcttcccaaaccaagtgccttgagctgcctgctctgcagcccacagaggacagtgctgaccccaggaagtgggagaagtggcccctcgtgacctacagggaactgggaagatgctggccccaaaagccttacggncatt

SEQ ID NO: 6474 - DNA, 210 bp, Homo sapiens
  misc_feature (1)...(210): n = g, a, c or t
cctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagntattggggatgtcaacn

SEQ ID NO: 6475 - DNA, 345 bp, Homo sapiens
aaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccag

SEQ ID NO: 6476 - DNA, 264 bp, Homo sapiens
cctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatgg

SEQ ID NO: 6477 - DNA, 286 bp, Homo sapiens
  misc_feature (1)...(286): n = g, a, c or t
ctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagccccagtttttgcatttcattttcattaaaatgaaaggnggtttggttttggttctaa

SEQ ID NO: 6478 - DNA, 382 bp, Homo sapiens
ctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaattt

SEQ ID NO: 6479 - DNA, 386 bp, Homo sapiens
aaatttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagt

SEQ ID NO: 6480 - DNA, 329 bp, Homo sapiens
ccaaagctgcctcttgatcaaccacgcaaacaaaaaccatttacctcaggtaccaaccaaccaagcgcagagcccccaccagccccgcctcgggttccaggctcagcagtggcaggcatgagcgactgctgtttccatctttgcaagttagggttctgaaagcatccccaagggtggaatccaaacaataccacactagaaatttggggcttcttcccccttttggtgctacagaagaactgcactgaggtgagatggtacctagaaccacatgactctggaagcacatttatgtctgccaagtggcagcagtgacacagaatcagagg

SEQ ID NO: 6481 - DNA, 376 bp, Homo sapiens; identical to SEQ ID NO: 6158

SEQ ID NO: 6482 - DNA, 428 bp, Homo sapiens
ggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatacttttt

SEQ ID NO: 6483 - DNA, 362 bp, Homo sapiens
ccaacatggtgaaaccccacctctactaaacacacatacacacccacaaattagccaggtgcagtggtacattcgtgtaatcccagctacttgggaggctgaggtgcacaagtgagaatcgcttgagcctgggaggcagatgttgcagtgagccaagatggtgccactatactccagcctgggcaacagagtgaaactctgtcaaaaaaagaaaaagaaaaagaaaaagaaaaagaaaagaaaagaaagaaagaaaacattctagaattccagaagccattctcattccctatttaagtcactaacccaagagtaattaatatcctgagttccaacaccttggatttgtatgggttattttt

SEQ ID NO: 6484 - DNA, 247 bp, Homo sapiens; identical to SEQ ID NO: 2583

SEQ ID NO: 6485 - DNA, 309 bp, Homo sapiens
cctggagatttatgaagtcatgaggaagagccttccaggctctgatccgaatgaaattcaattacaaatggatttgagatgaatcttaatacaaaaaaacagtgtgacagtgtcctgaggaatgggtctacagagcctttggatagctgaattgtagagaacctgggaggctcaatagtatcttcagagtgctccttcatgagaatcacaaacttacacaaaagaagagctatatgtttgctaaactatcattaaataattgagaaaatcaaactcagcatgaacatacctgatagcctgaatgttgaa

SEQ ID NO: 6486 - DNA, 435 bp, Homo sapiens
ccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcctatgtggccttgcttactaaagtggatgattgcagtgaggttcttcaagacaacttttg

SEQ ID NO: 6487 - DNA, 280 bp, Homo sapiens
aaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataagg

SEQ ID NO: 6488 - DNA, 333 bp, Homo sapiens
  misc_feature (1)...(333): n = g, a, c or t
cctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggagactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatctaaaaaaaaaaaaaaaaaaaaacntg

SEQ ID NO: 6489 - DNA, 324 bp, Homo sapiens
tttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgttt

SEQ ID NO: 6490 - DNA, 237 bp, Homo sapiens
aaacagagcacagaattaaaccattagtatgtgaatctgcaaaaagagaacttgttttagactcttctacagtttagacttcaatgtgcatactaaatgcataacattcgtatcaaataattaacatttatatacaattaacaaataaggacaaattttatacaaaacttctactactgctataatttttgaaaacatttaacccactagcaagaggtaagacagcactgccttttt

SEQ ID NO: 6491 - DNA, 187 bp, Homo sapiens
tgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggcttttt

SEQ ID NO: 6492 - DNA, 343 bp, Homo sapiens
ctggagaggatgcctgatgacttcctgccaggagaagccaaagccaggacatagtcaaccaaaataactccaggttggtgagggaagggacaaggaaaagaaacactgggaaattcaaagaaaggcaatctcagacactaaaagagcagagagagaaagcgacatgggggacttaaagaggctccttccagggcgctgggcttctcttccagcacagaaggctgcaaaagtggaactggcccccagttcccagaggatcacaaggccaaggatccaatgggcacaccatgaggacccaaggaaaggacagagaaaggaacggctctgggaaagccaaacctgg

SEQ ID NO: 6493 - DNA, 392 bp, Homo sapiens
ccttaacccttgccctgggagcccccaaggataataacatccctttctggggcaacaaaactgggaccgagtgggtaactgatatttgacaggggaacctaaacagtctacggaagtgtcctgagatgggcgtaaagtcaaacagaccaagcacacaggtaacactgaaataggaaagagtaagagcttctgttcaggctggaggtgctcgtatggtgggacaggaaaggggaaaagagaaaggggcaacatggcagacataccacggttcctacagagattaggggcagccctggcccgggaagtacacagggcagagagctgactctcaggccaggaaggagtttagctctgacccatcctcagggaccacggctctcccccagcctcag

SEQ ID NO: 6494 - DNA, 220 bp, Homo sapiens
ccaagtcacccaccctgtatgggcctcagtttccccatgtttacaatgagatactgagctgaatggtaaccaaaagaatcagagtttgcatgtattgagagcattctatgttccacgtacattctgtaatatcaccaatccttacagtcatctgacaggataagtttccatttgacagagaaactaaaacgtggcctataccccacagactgggatttga

SEQ ID NO: 6495 - DNA, 178 bp, Homo sapiens
  misc_feature (1)...(178): n = g, a, c or t
ctggggatgagaactgtcaggagggaaggtcanaagtcccaggatgcacttgaaaagcctctagctccaccagtgaccagctcctggctggactcctggtctggactcagcatcagggaggctctggcctctcgccctcagggctgggggcttcttcacatggtcatcaaagacttgg

SEQ ID NO: 6496 - DNA, 531 bp, Homo sapiens
  misc_feature (1)...(531): n = g, a, c or t
aaataatgtctatccatgtatcatgaaggacagtatgcttcaaattgtcttttgaggcagacatgttctcagtactaaaagacatttttagatggattttattctcaacagatgcaaaatgcaaaataaaatattgacaaacaatacagcaacaaataatttactatcactcaggattataaggctggtgttaagcagaacagccattaaatcagcatcaaaagaacaaatagtaaagtccaaagtattaattacagataacttttcaaaaattcatcattcacccttgatttaattatttctctggcaattatttaatanacttctcggagtctgttaagtacttaaaccaagaactaccattattcctactgggaaaacataaacatttctcaagtggaaagtaaacagtggtggcactatttttatatatggttaaagagacctgtcattgcaataaaagccagcattcacaaaatgaggaagataaggaaagtagcataaatattttctattaacatggctttacaa

SEQ ID NO: 6497 - DNA, 265 bp, Homo sapiens
  misc_feature (1)...(265): n = g, a, c or t
cctgggaacgtttggggcaattttatataagcagtacaaccataattcctttactcatcactgactttcatgaaatggaatgttaaactacctgttcattcttatttgttttcataccagaaaaaggaatgatgtcctaaagggcagggtggggagagcaggtcgagtgatgataaacaaaacaacnaaacgttaagtttcattgagccattcctctgaattactgacaaagtgncctactcactggtgnaaggggaaactttgg

SEQ ID NO: 6498 - DNA, 342 bp, Homo sapiens
  misc_feature (1)...(342): n = g, a, c or t
ccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggnggagggagacca

SEQ ID NO: 6499 - DNA, 345 bp, Homo sapiens
cctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagaaatagagagtaaaatggaatggctgaatagccctcaaaaccaacgtatgtctagggatcatctacctaaggtagattctacagttttgtacaagcttttttttttttttttttttt

SEQ ID NO: 6500 - DNA, 310 bp, Homo sapiens
  misc_feature (1)...(310): n = g, a, c or t
cctcacaagcatgagtcctcagccccaggacaagtcatctaacacctctgagccccaggatcctcccctctaagaagctgccacctactttgcagagtcttttgagggtgcgttgtcaacagtgcttgatgactaaaggccactgtcagctctgggggtaaggtgacatctaggaggggcaggtcagctctgggagggggtcatctctcgggattcaagccctggctccagcacgtcctccctctgagacccaggagggacgtactgcacctcagnttcctcccgcgccacacgtcaccccttcccgagg

SEQ ID NO: 6501 - DNA, 285 bp, Homo sapiens
ccaaggaccgctgcaggatcgagatgtctatggctgacttgttcacaaaacttgctatcttcttaatgaacgccaccgaaaatgtatcccaggacactatgccatggtccatcagctcaacgaaggccgtcagggtgaaggacagcatgtctccaaagcaaggcttcatgatcttctgcaatttctggtatcgctcagtgccgctctccaccatctgcgtgaggagagagataccgtccaggtttataaactcctgggcaaacgtgacaccccgggagaggctgg

SEQ ID NO: 6502 - DNA, 491 bp, Homo sapiens
ctgtgagagttaagcagatttttttttaaccctccgcttaccttgctgatagtgaagtatgtgaaggagatctagagctctgacgactgccttttgtgctagctgtaggtagttctaacccactctggaggaatattcaatagcaatcattagtactacctactgttttttagaagataaatatttttaattagctttcacttcatgatgaatgtcatgaaagtttttattttcatgaagtttttaagaaatatttaatagaaggtgctgtattacctgttgaaagtatgtttgaaggataatacggatctcagtattttcttctatgatatcaactaacatttcatcaataactttgtgaagctgtttcatttcacgaagtttgatgtcttgttcttccattgtttcatcttttgtgtctttcaaaagacggatttcctttgtgagttctgcacactgttggtaaataatagtcaattattctataaacc

SEQ ID NO: 6503 - DNA, 365 bp, Homo sapiens
ctgacatgctctcaggggtgaagaagtttagcttaaaatacctgatggcgctgcataaactggggatttgggaactgagtttttagctctgtgacacacaacataaaaaacaaaaatccagtctcattagctaaattcggattaaaatctgaaatgtttttatggagttgccaacaggctggaatgtacctgatacagtttaatctgcttttatttctttggctgtcttccaaaccactttcttcctgtaattcttaagttggctagttctccttcctcagaaaaattacccctaagaatcttcctaatagtgagggtgtacttccgaatagaagagtccttcggctgaaatggcatctccaagg

SEQ ID NO: 6504 - DNA, 247 bp, Homo sapiens
cctcgctggaggccccggggctccaggctccctgtcatgtgctcagcccagtgttcctcggtgattcgtaaggactgggtgagtgaatgatgaagtaaggaaaggtaaaaccagagacgtgagggccacgggtcacctgtgactcggccaagctgctggctccagtgccagcccctggttgtggattccagaactttctaggcaacaaagtaacctcccagcagaggttatcaccaacaagacgcag

SEQ ID NO: 6505 - DNA, 224 bp, Homo sapiens
aaaatgtctttataaaatcagttttggaatggaatgtgtgtgttctggaagggtggggaagggaggttaaaaatcaaagctgagctccagtgagtagggatggggttcgccttgctgcccaagaaggggagggagaagagattcgattctgagtctcctactcccgggttctgcgtagagaagccgactgctgctggaggtcggcaacgcggccacaaccgctc

SEQ ID NO: 6506 - DNA, 170 bp, Homo sapiens
ctgccagtgctgcacggatgtccttcttgccctcaatatccttctggctgcggttcaccacgccaatgtagcctcttctcaacgggagcaacttgttctccaagacgtccctggcgtcggtgccctcgtccatcaggtcaagcttggtgatgacaccgatggtccgtagg

SEQ ID NO: 6507 - DNA, 251 bp, Homo sapiens
  misc_feature (1)...(251): n = g, a, c or t
cctaagtgaggtaatcgatgagatttaaggatgtaggatcacgttaatagtagggaaaaaagtcactttagctatgatgaaaggaagggaactgaattctacaaaggcagaatgagagcttttgatgagtaaccatgatacaaatacacaaacagaaaacatcttacaacatgaagaaacagtgatttctctgtgagtaaaattcaacaatcccattcttaatattgaatggaatctntgagttcaccagg

SEQ ID NO: 6508 - DNA, 126 bp, Homo sapiens
  misc_feature (1)...(126): n = g, a, c or t
ctggttttgtttttgtttttataaacagagcttctccatttccttagaagagctgtcatcttganctttgtgcttgtgaccatgctcacatgttgtttgacaaaccagctcattcttggnccatga

SEQ ID NO: 6509 - DNA, 284 bp, Homo sapiens
  misc_feature (1)...(284): n = g, a, c or t
tggccctgtcctgcagaatgaggtgtccggcccggtacagtgggtgttcatgcagatctgtctgggcgggaaacaccagcagctccggcatcaaggagtccaggagaaaatgcttccccttgagggcttgtaagtcatcaaggctgccagggaagaaccattcattcatttcctgaatttctccctgccaggccctatttcaacggtccattcatgcaacaaatgntaccacagctatggagaaatcaacagggtgataagggaatccgggatccgcagttgag

SEQ ID NO: 6510 - DNA, 247 bp, Homo sapiens
  misc_feature (1)...(247): n = g, a, c or t
ctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatantatctgg

SEQ ID NO: 6511 - DNA, 263 bp, Homo sapiens
ccaagagcccacgccacacagtcttgccagttctgtggacgcactctcaggaccccaagcactggcttcagtaaggtgagtgtcttgtggctcatccatgtctgccagggaagtgtgtgcctgttggtggtggttgatggtctctgcagacagtcggaagagttcttcaaactcatgccgggcccactgcagggtgtgctcggctgtgctagggaagtaccgcacggtacagacagggtagggggcatcctcagaagctgcag

SEQ ID NO: 6512 - DNA, 357 bp, Homo sapiens
ctgacagttctccatggcaactcagtcctccagcagacccctgcatacataaaggtgtaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcag

SEQ ID NO: 6513 - DNA, 287 bp, Homo sapiens
ccaagggtcactcactgggcaggaacattgtcaaggccattcatgcttggaacagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagagg

SEQ ID NO: 6514 - DNA, 267 bp, Homo sapiens
  misc_feature (1)...(267): n = g, a, c or t
ccaggaaatgatnaaagggtagcatttangaaatcagcaaactanagcctcaaatcgaaggtggacaaatgcattctcaactcaaacaggttgggtaatgctttcataagatacattatgnttttgtgtncacagnacacaaattttattatgnctacaaacagattcangaaagacctccaggctatttccccaaatgattgacaaagtgcaaaacaaaacaaaaaagaggagagcacaaatgaatagcccacttagaagctgaat

SEQ ID NO: 6515 - DNA, 369 bp, Homo sapiens
  misc_feature (1)...(369): n = g, a, c or t
cctaagaactgagacttgtgacacaaggccaacnacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtatta

SEQ ID NO: 6516 - DNA, 190 bp, Homo sapiens
ctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccag

SEQ ID NO: 6517 - DNA, 272 bp, Homo sapiens; identical to SEQ ID NO: 261

SEQ ID NO: 6518 - DNA, 308 bp, Homo sapiens
  misc_feature (1)...(308): n = g, a, c or t
aaagtcaactctagagagacattttgtgtgactggtccaaataaaacagcacatttaatgaggtcatattcttcttaaactttttaagagaagcaaaaacaatggaaaagccattaaaatttacacaaagaccactaaaactctactagtgtcaattaaaacaaagccaataaaacatgaacaacttcaaagttaccatcactttccacactgttctacagttatangaatatattcaagcaccatattgatnataggtaggtaaacgatgaagtcctactttggcggtctgacccacgctcacacaa

SEQ ID NO: 6519 - DNA, 306 bp, Homo sapiens
  misc_feature (1)...(306): n = g, a, c or t
ctggaaggtagtattccgccctcacccagccacccgagtaaatgagaatgatgactgactgagaccctgatggtggtggcttangcaagatgaacgtctgaaatggaggcccagggctgccacgatggctctgtagtcatcagggagggagctccttttatcttgttacctactcccctcttgtgcccctttcttcccttgatctaagaaggttgctccggatctcnccatctggcctgcgttcaatcaacataagcttcctggangancaggaggaggcactgtgctcgcatcacataccagtgg

SEQ ID NO: 6520 - DNA, 284 bp, Homo sapiens
aaaaagtctgaagcaagtttatccagtagatggctgggggtgttactcgcgctgtctctgaggccctcctttgcagacatcatgaccgtaaggcttttggggccagcatcttcccagttccctgtaggtcacgaggggccacttctcccacttcctggggtcagcactgtcctctgtgggctgcagagcaggcagctcaaggcacttggtttgggaagcctggtctccctgcaaagccgggaggcatcaagctctaattgtggtgaccaggccctcagtcacag

SEQ ID NO: 6521 - DNA, 480 bp, Homo sapiens
  misc_feature (1)...(480): n = g, a, c or t
nctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttattt

SEQ ID NO: 6522 - DNA, 230 bp, Homo sapiens
  misc_feature (1)...(230): n = g, a, c or t
nctgctccctgagaaagggctgggccttgattccctggcactctgaccttttgagcacagcagagtggggacagtttcgagcagagctgcaggtgggagctgggccagtaggcaccagtcaaggagtgggcagggtaccggcagcccccgcattagcttcctagggctactgtaacatgtgaccacagactgaatggcttaaaccacagaaacctactgtcttacagtgc

SEQ ID NO: 6523 - DNA, 195 bp, Homo sapiens
aaagcttcttgttttaattaaaaacaagcacatattaacagccacatgtgaatgccaaatgattaaaacaaaaaaacaaaaacaagagccatctacactgcagctagggaaagcaaacttcttggcttaagagaagtgagggatgtgtgtacgtgtgtgtgtgtgtgtgtgtgtgtgtgtgtgtgtgtgtgtgtt

SEQ ID NO: 6524 - DNA, 332 bp, Homo sapiens
tgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttctttttt

SEQ ID NO: 6525 - DNA, 283 bp, Homo sapiens
aaaaatctactttttccaaaaacagtaacactgacattcctcccctttttcaagggagacagagtagggtccttcaaatcttatttaccaacagatttgacaactgttttaacatcaaatctaaggttttacttcaaatcaacttcagcaggaaggaaagaaggtccagttggacaagctgatgaattttaagtaaccaggggaaggcagacagtggaacaaataggtgggagaccactgtcaaagcatatttttgcccaaaaggtctgcttacttcagtcag

SEQ ID NO: 6526 - DNA, 500 bp, Homo sapiens; identical to SEQ ID NO: 262
  misc_feature (1)...(500): n = g, a, c or t

SEQ ID NO: 6527 - DNA, 249 bp, Homo sapiens
  misc_feature (1)...(249): n = g, a, c or t
ncggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccag

SEQ ID NO: 6528 - DNA, 334 bp, Homo sapiens
  misc_feature (1)...(334): n = g, a, c or t
aaaaacatgggcttcatgaaaacaccattgntactaacttgggcttagatgggaatctaatgtgaatagttcaagttatgggacttgtctaaatatgtctatactctaaacctgggggaaggnggngnggaacattgacttgactacagccgaatacatgttgggaatcattcccaatcataagacatcgtcgtttctgtaggatgactgcatatgttcanagtanctttttgaatttggttcccttacctttagggatgcgatgtnatagnccaaaatgattacacnaaaacctaagtcttcaaaanccaacttttgttgcttatgactttgc

SEQ ID NO: 6529 - DNA, 441 bp, Homo sapiens
ctgaacacacaactcttaaaccagttacaccaagtgtattactccctcctcccaccctaaaggtaatgatagtagtccataaagctaacctttagtttttctttctttggcttcttgctcttggagtgagtttctctgttgcagacaagtcctgcatttgcttaaaagctcttgcagagttggaattagagctgggtttaactgtttgggagtgtgtactgacaggagcaaagcgagtgccctcaggtcctacaaaaacccagataggaacatttcaaattctaaagccaacactttgatgcagttgtttacagttaattgcagatgtttattttcccaggaatccattctttcctaagaataccctggtttctctgggattcttagaatgataaaaccagaaagccagtgttaagatactacagcatttcattagttgct

SEQ ID NO: 6530 - DNA, 520 bp, Homo sapiens
aaataattattctttttataactaagccatatactggacaagatttataatttagagataatatccccattagtaaagtttatgacccaataaacagctcccactagttaataaatgccaaagccataaaaacaaagactattaatgtaatagaatttctgtacctccctcttttgctggtggtctcaagacactgaagggaaatgctatcttaggaaaaacatttattctcgttatgtaaatatcagtgaattgtcttacaatccatctggaagtctcccagccccccttggtcccaggtggtcctgaaatgctgatgcattctgcttaggtttcaagcagtagataactctggctttcagcacaaataaatcccgaaactaaaattttggggggaggaggactggaatttctgcctcttctcttccctctgcaaaagagaaatcccaactattgtcattgttccagggtaataatttgaaagaagtttcacaacctttccatatacttatattttcag

SEQ ID NO: 6531 - DNA, 292 bp, Homo sapiens
tgctgtccctcctcctgcctcggtccccgccgcaccagtgctgctctgtggctccaccttcacagtgcctgttctgaggctaagggcatggggtgaacaaggtaatgggcatctctggagtttggggtccagcagggataagaatgataaggggatattagagcaggggctctgccatgggtgcaggaccctaggacacacctccctgccaggaaacttgccccaccccctagcagccaccagttctcttcccatttccctgaaggagtgtttggctgccccacaactgtgg

SEQ ID NO: 6532 - DNA, 400 bp, Homo sapiens
  misc_feature (1)...(400): n = g, a, c or t
naaagttgctttgaagctcgtctataaatggcttcaagcaacatgactggttggttgtgagaattaaagggtcattaactgaataactccaaagtcattaacatgaccaaggtaaggatacagaataggaaaaggaaaatcctattccaagttggagggccatgccatcaaccacagtggtctgtgccagagcaacactattcgctagtggttctatactgacttctttactggctttccatctttgtatttattccctctgcaatccgtttcattttcagtagaagccagtgtcgaataggaataaagaatctgtgtattgcggtcagacagatttgggctagaataccagctctagactttctagttccatcactttgggcagatgtcttggcttttt

SEQ ID NO: 6533 - DNA, 250 bp, Homo sapiens
  misc_feature (1)...(250): n = g, a, c or t
ngnaggaagacaaagagtattaactgttaaacactgaaatttgacaagttatgactcaaaatgattaagtataacagttttattttctattagtgatatttgtaatctttactttgcctttatgactttgcactcagttcttggtttacaacagtactatgtagaaacacaaaggttgccatcactagttatttttacctgctacagatattttttacctgccatatttacaatgttgagattcaagttt

SEQ ID NO: 6534 - DNA, 312 bp, Homo sapiens
cctttctcccagggtcttattgaagtttgggttttggcataagagatctaagggttgccctaggaggcagaggatggttccctgatcttaaaggctctcaacctctcctctctcctcccttcccccacagtgtgccagagctgtgtggagctggatccagccaccgtggctggcatcattgtcactgatgtcattgccactctgctccttgctttgggagtcttctgctttgctggacatgagactggaaggctgtctgggggttagtggaagagcagagcatgagagtgtgtttgtgtgtgtgtgtgtgtg

SEQ ID NO: 6535 - DNA, 318 bp, Homo sapiens
  misc_feature (1)...(318): n = g, a, c or t
naaaactaagtcagatttttatttttttttccatagaccacatcatttaataataaaaaaaataaaaataaaaattgaacaaaaggaaaaggtggatataaagtggaacctgtgggaaagaggcaagggctgcaggacagaagagactgggaactgcaggggccctgggactcaggaggagatgctgattcagctcataggtgacccagtcctggccccggctgttcccaagagaaggctgtaagtacccagggaggtggtaagcaggatggaggaaaaatcagaggactggggcacctggctgttccccatctctgg

SEQ ID NO: 6536 - DNA, 395 bp, Homo sapiens
ctgtgcaacttggagcattttagcttggtaacactgatcccctttcaggtgagtattgggcttgtaatttgaatttgaatgagaaaccgtaatgtggctactggtaaggtaaaacggataaatgccccagaccaaaacagctcgcaacgaagtatgtttgccgtaaagtcacacagtccaggcttgataatcttctgagaaattgataaaagatgtgtgatgtagacatgagtagcaaggactaaagagataaattcattctgaaactgctttgaatattgtatgttgttgatgggttggaaatatgtcaccttaggaatgagtttgtttttttttaattggagttttaggagttggtaatatcgtggtcagtatatataggcttcacaagttat

SEQ ID NO: 6537 - DNA, 301 bp, Homo sapiens
ccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatattt

SEQ ID NO: 6538 - DNA, 327 bp, Homo sapiens
aaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactatgatgttggcatctcttattcggcaagcttaaaggctcttt

SEQ ID NO: 6539 - DNA, 302 bp, Homo sapiens
  misc_feature (1)...(302): n = g, a, c or t
aaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggntaaagtgctttggatgcagggatcccagcagtgcaaacagacttnggagt

SEQ ID NO: 6540 - DNA, 342 bp, Homo sapiens
ccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccag

SEQ ID NO: 6541 - DNA, 393 bp, Homo sapiens
cctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttg

SEQ ID NO: 6542 - DNA, 347 bp, Homo sapiens; identical to SEQ ID NO: 5482

SEQ ID NO: 6543 - DNA, 266 bp, Homo sapiens
aaaaattccatgtgattcaattatgtatgattacatttcagttttgctatactttatatttggcttgtatgattaaagtaaacaaagtaaattccattgttataattggttttgagtgttataggtttattcaaatccaagatttgattacagttttgataagagtcacagcttaacaggtatctggagttcacatgtgcatagctatttcactgtataaaaatagattaagatattttgagattttggtgatatttcctgttttt

SEQ ID NO: 6544 - DNA, 282 bp, Homo sapiens
  misc_feature (1)...(282): n = g, a, c or t
nncatcccantcccggctctccctgttgccaggacacaaggtctcctttccccgntcggctggccggatacaaatgtcacccccgaagctgcctggaanttccanctccgagttccctgggaggactttttcanatgttagggacccgctccacagccccctctgggtcaccctgggttcctccanccccaccgantcactcactgnggaccctgcctctgaataatcagnaacngtggcttcanagacgtctcttgngccttccctntggacctcgnccgc

SEQ ID NO: 6545 - DNA, 507 bp, Homo sapiens
gaagatcctggaatagcgtcttccatgtgggacatcttaaaagatagtattttggcttcagtgagttacacaaatgaatcaccagtccttattaattcaatgggtctgtttacagagtgtggtaatttcgttctttagatttgcagaatttataaagaaagaaaattacagcctgcacacccaagaccaggacaattcctccaatgaaactggctgcatcaaaggtagactttcgcacaggttgtgaggttggagtcacagtgttatttgttgtacctgatgtagtaactgtcttggaagttgtagaaggggagggctgaactgtgggtttagctgtagaattggctgttggcactggagtggccgtggaaacggaacagaagtctgtcgtgttccccacttgacaatcactaactgttgagttatgtgaacaatagctctcatctttacattctatccaaaagcaggtaagtattaacaacgctaacattaaaacaggaaacgcag

SEQ ID NO: 6546 - DNA, 103 bp, Homo sapiens
  misc_feature (1)...(103): n = g, a, c or t
ggcttgctctattactgtgaagcactaacaaanacaaacctccaactccataaagcancttgcctggctctgaaaatccttnaggntactgaaagcattaaaa

SEQ ID NO: 6547 - DNA, 234 bp, Homo sapiens
gccgccaccaaaatgcagattttcgtgaaaacccttacggggaagaccatcaccctcgaggtacgggccgggtggtcatgaggaagccaaggtccgaataaggtcctgaggtggattttaggaccggcgctgctttccatgtcttagaccatgattccgaatttgggttctaaaacttaagctttgaaatgagtaccttttgctgagcaacgacctagaggtgattttcggtgg

SEQ ID NO: 6548 - DNA, 619 bp, Homo sapiens
  misc_feature (1)...(619): n = g, a, c or t
ngcatctnacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaaganggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggagg

SEQ ID NO: 6549 - DNA, 255 bp, Homo sapiens
gcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccag

SEQ ID NO: 6550 - DNA, 149 bp, Homo sapiens
ctgaagttttaggagacagcttagggtttggtgcgggccacggggaggggaccgggaagcgctggggcttgtttctgtttgttacttacaggactgagacatcttctgtaaactgctacccctggggccttctgcaccccggggtgagg

SEQ ID NO: 6551 - DNA, 603 bp, Homo sapiens
  misc_feature (1)...(603): n = g, a, c or t
tgtggggagatttcantgcattgcctcccctgggngttnttcatcttggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcangacggcgcccaaaggaggagattgtatttcgttactaccacaaactcaggatgtctgcggagtactcccagagctgg

SEQ ID NO: 6552 - DNA, 258 bp, Homo sapiens
ccatctcagaggcacatttagtgtttgttctacttatgaaatcaaggacaaccaattgtacttatcttacaactgatgttctgggatgggactggaaaacattgattccagaaccactctttttcttaaaatcactggcttttatgacaatgtcttccaagagctcattagaatctataagatcgcaggaatttcgccaagaagggctgcatagaaaccacagagacaactcggccagggctgctcccattgtggtgg

SEQ ID NO: 6553 - DNA, 562 bp, Homo sapiens
  misc_feature (1)...(562): n = g, a, c or t
nctgtagcagcttctccgccacgtggacaaagtgtgtgatgaccagggcccgctgcggggctgtgggtttgctgaggatcatgagctgcacccactgtgagacgctgttgaagagggagatgaaccgctccaggacggggttgtccacagtgcagccatgagtcacgaaactgtgatagtcctgaaacaggatcttgcagaaggagcgatactccaagtaggtgagatgctccgccagctccatgggctccaggtggtcaaacaacggggacatcttgcgctttttctgtcccacagggttccgctgagtcacctgccgcttccacttgtaggtagggacgctgtctatgtcgatttggctgctgtgccgtcggttcccttcttggtctagcagagccttcagctccttgatctgctcagccaactccgggttcaagtcaaactccgctgggaaggcggagatccagtacctgaccaggtggcacgttttcacctgcanggaattggagttgtccttccgggactgttggtagatgtggaacaacttggccgccanacctgc

SEQ ID NO: 6554 - DNA, 181 bp, Homo sapiens
  misc_feature (1)...(181): n = g, a, c or t
agttcagtgacctcggcggnatccacggaatagctgttgttttccttggagagtttttccacggcgtanacaatttcattgtgtaggcgaatcaagtagctgacgagagcggtagcacagaggcccaggccccgtcggcgtggcaagaggatctcaaactcagtgtccanatccaagtcag

SEQ ID NO: 6555 - DNA, 232 bp, Homo sapiens
aaagaacagtcccaacaataaccacagagctgacaaaaatgccacctaatctgcatcatttccaggagctctgccacatattcttcctggcccgtaccaagtctcttagcccctctagaagagctaagaaaatgcaggtgtgcacctctgaacagcccatacttggcttttctgaggcaaattcccatggaaaccacattgaaggaagaggcaaaggctggtaggaaatcag

SEQ ID NO: 6556 - DNA, 285 bp, Homo sapiens; identical to SEQ ID NO: 418

SEQ ID NO: 6557 - DNA, 312 bp, Homo sapiens
ggcagtagctcaacaaggaatagagggaggagtgtaattttggtagctggtgttgaatagggcctttgagaatcagactgaacacagtgaaatatgtgcccaaagttcagaaagatgaagtttccagaaactaagaaggtagcacaatatgtggcatcatactcagaaaggaagaccatgccatggggccagaaattcagaaacgtaattcttacattgtgattgcaatggatactcatggaagaaagtgggtagtggccgatttgacttcagagtgacaggtagagaagggaagagcgtgtagaactgtgg

SEQ ID NO: 6558 - DNA, 727 bp, Homo sapiens
  misc_feature (1)...(727): n = g, a, c or t
aaatgtttgaagaacagcaaacatcaaataatataataccaaatagaatattatagtctctatgagataataactcatcagctacaaccacctaaaactgaaattttctgtacttagtttctattagtacaacaccttcattcttaatgcttcttagggcatcacaggttttagaaattaatgtatttttagcattccacagtaatgatcactttcaaaaactgcaatatacatctgcatgttacactgacatacaacacataagtattttgtcacacatcaacttttagcctcaaataatagaatacaaaaagctacactggacataacgccacagaacttttgaatatccccttttcccaattgttaacaggtagtacttttttctaaagagaaagtgatgaaaaatccaaaatttctgcatccagtgtttgactccaactttctactttatcgtctcctggtaccaccatatcctgatgcagttctggttttcgtgtctgagtttgaacataccgaatagctgcccgagcctccatgaaggggtgagtaagccctattccacgtgccagggtaggagggaggataggacgggtagtaccacgagtctgagaagggtgttgccgctctattgctgncaaacaaatatcctagtattccaccagttcccaagcctgtccagaaccctgggcctggaatttcatatccttggtggcctgnaaaagca

SEQ ID NO: 6559 - DNA, 320 bp, Homo sapiens
ctgaaggagagccgccaggaagagatgaattctcagcaggaggaagaggaaatggaaacagatgctcgctcgtccctgggccagtcagcgtcagagactgaggaggacacagtgtccgtatctaaaaaggaggtagggattggagctgagtgtggaaggaaagccaggagatgggacttgggtacggaaataacacaatttgtaagtgttcagtaagtaatagcttctattttgtgccaatttccgccctcagcatcttatagatatttttcatttaattgctttgagttccaagtactatacgtgcctacattttacag

SEQ ID NO: 6560 - DNA, 410 bp, Homo sapiens; identical to SEQ ID NO: 4733

SEQ ID NO: 6561 - DNA, 372 bp, Homo sapiens
aaagccattatttctcaaaaagaacggtttatgttttagctgccattttaattaagcttgttaaaaatgaaatggcctaaggatgaactctgtaaactccacatgggcagggccactgttgtatcatggctttgccagtgtggtgatgagatcaggacctggcagatgtgcttggtgaacctaatgaacaaccacctgaggaatgacgtgaagggggaggagattaccaccactaccattggctactaattcaaaactactgtgatggcgtagagcttattttagatatatctgtgattcattattcttttgtcacacttcagcttgccaattctgtaactccttgggatatcttgctgagcttaattgcag

SEQ ID NO: 6562 - DNA, 239 bp, Homo sapiens
gttgtgaggtgagctttttcagaagcgcgatcccaggacacgtcgggaagcaagcatccccagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaattt

SEQ ID NO: 6563 - DNA, 287 bp, Homo sapiens; identical to SEQ ID NO: 263

SEQ ID NO: 6564 - DNA, 400 bp, Homo sapiens
  misc_feature (1)...(400): n = g, a, c or t
cgtccttgtctcacccanaatnacgacgctntcagttcaccaacaaacacgattcagtgctgctagngctgggtcctgttctgggggctggtgatgaggccaagagggaaagagggagctctgtgttccatcgagggggcgacaagcctggaccagatgaaagtgactcatgttgttaattancggcttagggncaaaggtggcccctggaccagtggcctcagcatcacctgggaaaaggttanaaatgaacattcccaggccccacctcagcctcctgaatcagagcatccctttggcaaaccatactganaaacaaccacgtgcatcaccaagcgctgtgaagaaggcaaagctttgagaccttgaaggaatcatcaaactctgggcctcggtgtgc

SEQ ID NO: 6565 - DNA, 316 bp, Homo sapiens
aaaatgccaagataagaaacgatttattatagagagaagaaaaatttctcatccaaaatatagaaatctgtacaactttgccacaatcaatatacatgaactgtacaaatttacaccagttcataatttaccaaataaaagatgactaacaaagttcacaaaatagatggtggtttgtggaaaagacttttacccaattaagtacaaggaaagttacaaaccagacctccactttctaaaaataagaagtttactcagtcttagaaaactacaagctagcaaatgtacagagagctggctggtgctaacaccacag

SEQ ID NO: 6566 - DNA, 271 bp, Homo sapiens; identical to SEQ ID NO: 419

SEQ ID NO: 6567 - DNA, 157 bp, Homo sapiens
cctatcaacctaagcaacagaaataatctgacactaccttatcaggcagattggggaggggagggtgtatctagctctagttcaaattatttggaagtgttcccttgagaaaacccaccagcctaagaagctctggccccaagcttgtcactagcag

SEQ ID NO: 6568 - DNA, 522 bp, Homo sapiens
  misc_feature (1)...(522): n = g, a, c or t
ngcatntaataactacaagttccttgcaactagattactgatattggncngaacaaccatccaagcccttaagagggctntttttcaaaggacacccaatatcatcagcaggttcttggctctagcacttctacttttgtggaactccaaatctcagtaacaccgtcattctttagtttannctgaaatgctgaacatgtgaatggtgaaaaagccgttattcggaatgaagatattctgtctctcctagtncctaaacgttagttgagtattacaatccctgcattcacagaaattattactgaggaagataagactaaaaattaaattattgacgttatgaataaagagaaaatggttttctaataaggaatgaatagtggaatacaacttcagatagaatgttgattccaagaaagccccttggaggaacttctactggatacttaaagactgagaacccagccagatacagggaaaaaaactgggntgaggactatttcaggcaaanggataaaaaaa

SEQ ID NO: 6569 - DNA, 237 bp, Homo sapiens
ctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccac

SEQ ID NO: 6570 - DNA, 381 bp, Homo sapiens
  misc_feature (1)...(381): n = g, a, c or t
cctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacncagatagacnaggaatttcccatggtaaaaagggatattagtaattaagaagaccnngagactnaaaa

SEQ ID NO: 6571 - DNA, 262 bp, Homo sapiens
aaaatgcatgtattataatcatataatcataactgttgttaattcttgattatatacctagggacaatgtgtaatgtaagattactaattggttcttcccaatctcctttcagattttattaggaaaaaaaataaacctcctgatcggagacaatgtattaatcagaagtgtaaactgccagttctatatagcatgaaatgaaaagacagctaatttggtccaacaaacatgactgggtctagggcacccaggctgattcag

SEQ ID NO: 6572 - DNA, 379 bp, Homo sapiens
aaaatacaatagaattaaaatgtaaacctcaaaaaaggggtgaggaatggagggaagatatgtgagtaggccaggacagaatgagagcgtcgttgtgggttcctgagacaacagttatccaatgtcattgttatttttaatgaaattcaaggaatttgcatttattccaaattggaaaagatgtgaaccaggaacaacctgcctgacagtttatgtatctttggtgattttcctttgaaccatgggaaaaatcatgtttatcttgtagtttacattgtaattctcatccactcctctgtgaagacgtggaactgtgccacccagaacctcctgcaagagaagacttgcttgcccaactgagggggaatgaagtaagcag

SEQ ID NO: 6573 - DNA, 101 bp, Homo sapiens
  misc_feature (1)...(101): n = g, a, c or t
ccacgctaagggcgaattccagcacactggcggccgttactagtggatccgagctcggtaccaagcttggcgtaatcatggtcatagctgtttcctgtgan

SEQ ID NO: 6574 - DNA, 393 bp, Homo sapiens
  misc_feature (1)...(393): n = g, a, c or t
nctggagagagatcaatatgctgaacaaataaaaggagggagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctcagaggtggagctgcaagacctgaggaaggagctggagagagtggcaggagagctccaggctcaggtggaaaacaatcagtgcatcagtctcctgaaccgtgggcaaaaggagagcttcgcgagcaggaggagangcttcaggagcagcaggagangcttcgggaacaggagaagangcttcagcag

SEQ ID NO: 6575 - DNA, 249 bp, Homo sapiens
  misc_feature (1)...(249): n = g, a, c or t
ggtcttttgcaaaatgaaaagaagcctgttcccaagatgaaaactttattctcaaacatgacagagcgttccttttatcaatggcnnatcgagggaaacataccaatggttcccagtttttcataaagagtgttacaccgtgcgctccaaagagttgccgtgtcagagcttcaccttgggtgaaggaagatgggcaggaattctggaaacagaactcctgagacctacctctgcctgcctaaaaanggg

SEQ ID NO: 6576 - DNA, 335 bp, Homo sapiens
ccaagaaaagattagcagaaactcaagaagagattagtgctgaagtagcagcaaaggcagaacgtgttcatgagttaaatgaagaaattggtaaattgtcagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcataataatgacagacgactggctgatcattttgggggtaaactgcac

SEQ ID NO: 6577 - DNA, 274 bp, Homo sapiens
ccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttattt

SEQ ID NO: 6578 - DNA, 687 bp, Homo sapiens
  misc_feature (1)...(687): n = g, a, c or t
gctgtgcttttcacatcaagttggcttagttcttggaggaaagtcttagtgactaaaattgtacacagatcacaggacaagagaactagtctaacaaattcaataagaaatcaggacaactgtagactatataaaaactgtcttagaaaattatttacaactttatcatagtgtaaatactctaaatgtaaaataaatctatggattttatataaaaatactccaaagtacaaatgtaagttaaatgctgaataaaacattttcaccttttccagtggatgctattactaagactataatctaggtgtcaaaacttaaagtgataaccacaaagcaatgttttcttaatcactcataattttacatttgttagtagtcatcacgaggtttagagttccactgaaaaagtctcatttttacaaatgcaactcatacactttccttcatggaccctttctctgtttaacacatgttaaaaaagtaaaacaaaattcttagtcaaaagttgacatgctatgtgaagcatataaattgnaaaattatcagtcttaaatacctagttgattctctttacaaaagaaacagtcatgtaatacatcagaaaatgcaaagcacactgctacaaggnacctactcaatctaaaaataatggtccccacttgggaaaatggtaagcactaaatcttt

SEQ ID NO: 6579 - DNA, 313 bp, Homo sapiens
ctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaa

SEQ ID NO: 6580 - DNA, 285 bp, Homo sapiens
ctgtttccaggagatcagaaaagggtaaatgaatactcaagatttacagcgtcaaaaggctatgttgaggataattcttatgactatgtaaaagacaaggtagtgaaattgtgagggccctgggcccggccactcacagaatgactgaagcatgctgcagtggagaactggaaatgtatctcttgttgccctccatctccacccaccctcaagactgggacttagaattcccacgtccagcactgttgtagatgggaggtacgttgtgctgaactgctgcgctgg

SEQ ID NO: 6581 - DNA, 385 bp, Homo sapiens
aaaagttaacttgaaaatcctcgttgataattcagcagcatgcttctggtcagcctatacagtctctgtcctggtgaggagcatgatcaccaacaggcaagatcttctggccttgaagtttcgcttgagttaaaagagctcatctcaggtaagtaacaggccaagaatggtgggcaccgtgaccactagccaacttgcaatccattctactccaaaggaccgggccagggtacagggtggactgaggcagaccgtgccattcttgctgctcacagaattgctgacttggcaagtataacacctggagtaattatgtggcataagggtggtttcaagcacactgttctggagctcctttgggaagggccttttgtccccataccag

SEQ ID NO: 6582 - DNA, 332 bp, Homo sapiens
  misc_feature (1)...(332): n = g, a, c or t
aaaagaggtatgagggctgggcgtggtggcttatgtttgtaatcccagctacttgggaggctgaggttgcagccaagattgcgccactgcactacagcctgggcgacagagcaagactctcaaaaggaggcatgaaatgcacctcaatcttttgctccaagtctgccaaagattgtcaaaccctccctgttaaaaaaaaaaatcagtttacctactctcccttctatataaaggaccctaaaattaaatgtcaatgccaaaatgcgaagtgcanatcgtnttctctccaaataanagttacttggaatccttaacaaatccaaggagaanaa

SEQ ID NO: 6583 - DNA, 390 bp, Homo sapiens
  misc_feature (1)...(390): n = g, a, c or t
nctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccag

SEQ ID NO: 6584 - DNA, 358 bp, Homo sapiens
ctggacgtgcagggaggtgaagggctccacgcggatgaggtagtgcatcacgcctgctgcattggagtagtgggtgccatagtggaacttgtcaatggtccctgctgggtcctcaaagctttcatacttctccctcacgagctgggcatgcttggggttcaccacaccgatgggcttagacaggtcccggaagacggctgggttgctgaggtccagggttggggacacgtagtcctgcaggacccaggggaacacagggtactgagacaggtcattgtaggtccgccccgcaatggtgttgagttgcatcaagtactcgaagttggatatctcacgctgtacccatttctgggtaagg

SEQ ID NO: 6585 - DNA, 449 bp, Homo sapiens
  misc_feature (1)...(449): n = g, a, c or t
nctggcagggcagggtcagcctccttggggggaaggtgctgacacaatgaggtcaatgacagactggcgccccacccacgcggggcactcatggctatgttcccaaccaaggccaattaggtatcaattaacaaggacactcgcccaaccacacacccctgtgtagcacagaagcttgagagccaccattcatggggcccatcatggcagcagactaagcagcctcctgcctccccttccttctaacttcccaagctggtcatggagctctgtgcacggcaccccacatcctcgtctgctcctgtgactcctaccctggctcagcctctccctgaagttggcttgacccacactagattccagaatgagtctccaaacctccaggctgacagtccctccctagctccaaactatgctgtgaccatgacctcacacggagggccacctgg

SEQ ID NO: 6586 - DNA, 317 bp, Homo sapiens
ccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagagg

SEQ ID NO: 6587 - DNA, 263 bp, Homo sapiens
aaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcag

SEQ ID NO: 6588 - DNA, 514 bp, Homo sapiens
  misc_feature (1)...(514): n = g, a, c or t
naaacttaattaaagagcttgacaagctctgcatattcatgtgtcataagcagtatgtgacaaaaaaaactgtgcagtatataccccctcacgaaatttagtttggcagggaaaacaagatgcacatgttattataaattagaaaatggaagagaagtagaaataaatccatgagtattatatataagtaacagaacaaaaacaacaggataatgtatcccccccaaaggcccagtagagaccatcaaagctcattctgggggtagtcaaggagggagtggagggagaaaaagaacgcagaccttcaaccactaatgaaagaactgaaacatctgtatgtagaaaaaaggtaaaatcaactcactatcatcttcagccttttggttatctcatttaatggtcacagttaagtccgtgagtagggtttttgtacttgaagttcaaatagaagattaagataagcaacttcctcaaggtaagcaaactaattaatagatcaaggttttgaactttt

SEQ ID NO: 6589 - DNA, 331 bp, Homo sapiens
  misc_feature (1)...(331): n = g, a, c or t
ggcatgcannggncaggtccttatgacagacctggggctggtagagggtataacagcattggcagaggagctggctttgagaggatcaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcccgctcaa

SEQ ID NO: 6590 - DNA, 236 bp, Homo sapiens
cacagccccagaagcgagaggagcaaaccaagaaggagaatgaagaagacaaactcactgactggaataaactggcttgtctgctttgcagaaggcagtttcccaataaagaagttctgatcaaacaccagcaactgtcagacctgcacaagcaaaacctggaaatccaccggaagataaaacagtctgagcaggagctagcctatctggaaaggagagaacgagagggaaagttt

SEQ ID NO: 6591 - DNA, 343 bp, Homo sapiens
caggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtagg

SEQ ID NO: 6592 - DNA, 297 bp, Homo sapiens
  misc_feature (1)...(297): n = g, a, c or t
nccatcaggaaggtgaaagaggtctttgggacaggggccatgagacacgtggtcatccccttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccag

SEQ ID NO: 6593 - DNA, 284 bp, Homo sapiens
ctgtactgggcatctcagaatcaccgggaaggctgaaggggtagaattggaagacgggcagaaataacggtcgctaggtggttgcaccagaaccaaaatcatgctagagaatgaccctaggaaaaccactgttgctgctgacggggctgagcacgacaccactgatggcattggggcaggttgcgttccctggaccaggatgtttctgtctgcagcagaatttctctgctgagtcaccaccacatgaccgtaaatccaaggtgacatatctatctccagcctgg

SEQ ID NO: 6594 - DNA, 236 bp, Homo sapiens; identical to SEQ ID NO: 6590

SEQ ID NO: 6595 - DNA, 293 bp, Homo sapiens
  misc_feature (1)...(293): n = g, a, c or t
ctggtacacggcagggtcagggttctggatatcaggtaaaacagtcaattgtgtcccagatccaaaggtcagttgccttgcagaaccagaagactccatgtcacccacgaggcagtagtacacagcagtgtcgctcagggaaacccggggcaggctcagagtgctggactttctgtcggcagggataaacagggaggccacttcgtttgtaacttttgncttgnatccttgaataataaatcgtggtccttggctgggaaactgttggtaccacgtgatataatcatttgtag

SEQ ID NO: 6596 - DNA, 286 bp, Homo sapiens
ccttgctgaccctgtggcctttagcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagccgacattgaacttggctgcggcaactttggctcagtgcgccagggcgtgtaccgcatgcgcaagaagcagatcgacgtgg

SEQ ID NO: 6597 - DNA, 371 bp, Homo sapiens
aaaaaatgtgagaagagaaaaaccaggcaggaagcccattttgcgggatagggcaccaggaggtgaagaatgtacacatgtacagttgaggattagatgaatctgagcttgaaaaaggtaataccatgcacaggggaattttctaaaccaaaccacagagatcagtcaattccaatgttttctttctagactgaatgttccagaaatcatctctaattaaggatcccaaaagataatgtacaaaattctaaaaagtaaacagagataattttggataagctgagtaaaatcatcttctgaatgacagagttttatcttgaggctctccacttcacaataattataattaaaaattatgcatctgaatctca

SEQ ID NO: 6598 - DNA, 425 bp, Homo sapiens
aaaagagcctagaacctgggtcctagtttgcacctagaatatgaggcaagtggcgagagtgatcgtgttcctgaccctgagtactttgagccttgctaagaccacccagcccatctccatggactcatatgaaggacaagaagtgaacataacctgtagccacaacaacattgctacaaatgattatatcacgtggtaccaacagtttcccagccaaggaccacgatttattattcaaggatacaagacaaaagttacaaacgaagtggcctccctgtttatccctgccgacagaaagtccagcactctgagcctgccccgggtttccctgagcgacactgctgtgtactactgcctcgtgggtgacatggagtcttctggttctgcaaggcaactgacctttggatctgggacacaatttgact

SEQ ID NO: 6599 - DNA, 369 bp, Homo sapiens
ctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcag

SEQ ID NO: 6600 - DNA, 374 bp, Homo sapiens
  misc_feature (1)...(374): n = g, a, c or t
ctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggncgagaaaagctttgaaacagatacgaacctaaactttcaaaacctgtcagtgattgggttccgaatcctcctcctgaaagtggccgggtttaatctgctcatgacgct

SEQ ID NO: 6601 - DNA, 324 bp, Homo sapiens
aaaactcagtgaggacttagatgggaaagaatgaggtaaatacaaaggattacaggacaacaactacagcgttgtgtactgtgggaaggggagttgggcactcttggaggactcctgctgaaggtggtcagcctgcctgacaatggaagacatacttgaatggggagcagggtatgtgctttcatatgaaaaaagagctgatgttaaaactcatttggtgaggtcaacgttgtcacataccttcacataagggatagtatattttgggttgcagtcaaacttgtgctcagactggtgaaactgagagtcaggcttttacatttt

SEQ ID NO: 6602 - DNA, 336 bp, Homo sapiens
ccaggaactgaagcgcaggagcccctcccggccattggtggcctcttcctcagggaatggcagcagaggagtggggggaagcctcgtggaagcacagaatctcttgagtgactccaccaactccccccgcccattcatctccatgaagccccgagaccagcacacaaagctggggggactattgagtagaggctgggaaccaggagaagagaaagcaagaagaaaaatattgaggaaaatgaaaaaaaaactgacatgttgggtagaggatcggggttaggggtaaggctcagtatcctccatggggaacgcgagtggggacaggggggccttcag

SEQ ID NO: 6603 - DNA, 190 bp, Homo sapiens
  misc_feature (1)...(190): n = g, a, c or t
gagcagagagactgttcccttgggtgganaggtgtgggcatganagccacccattgccaagcagcaagaatgttcgtgcttttttccagagaggggaaccccactggtttttgtggaaacaatggaaacttacagatgcctgcctgggatgatgaggcacattcagaacaaatgctttttttttttttna

SEQ ID NO: 6604 - DNA, 232 bp, Homo sapiens
ctgaggtttctcctgctccagggccctcagttcctgcctcatctcatcactcagagttgtctggtccagccccaggcgtatgagtttgcaggcaggatgcctgagcccctcacagagcagtcgcacgccaacgtcatccaggttgttctgctgcaggtctagctccttcaggctggggctggcactaagcacagaggccaggtcctggcagcagtcagacgtgaggccacag

SEQ ID NO: 6605 - DNA, 230 bp, Homo sapiens
ctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatcccttt

SEQ ID NO: 6606 - DNA, 338 bp, Homo sapiens
ccattcctaaatgaggtgctgactctagatcatcacccttccttcatgcatggcagaacaatcaggaggctcaattagtgtgctatttgtcacactacttagtatcttctgtttaagtagcattttgtgcaattatttaagtcacatgagtcaccagaggaaaactgtaaataatggttagataaaatcacaagcagcctcttaattacccatagtgatcctgccacgaaacctaggaccctttagagggttcagtagagatttttttccagttctgccttgtaaaacttgattttttaagagatgaagtcaattatagggaaggagcccattcattt

SEQ ID NO: 6607 - DNA, 442 bp, Homo sapiens
  misc_feature (1)...(442): n = g, a, c or t
ccaccacccccccccgccacgccttanagcagagcagcccctcctctcatttggtgcagaaacagtcaagaggaaccattggcctagagctcctgtgaccgagagcgccacggaagcctggggatgatgtcgggcagcttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagccgcagagacgctgaggcccaggcaggtgaanaagaagtggctttgggttttt

SEQ ID NO: 6608 - DNA, 546 bp, Homo sapiens
ccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaacttttttttcccccttttgactccttgggcttcctctcctg

SEQ ID NO: 6609 - DNA, 468 bp, Homo sapiens
  misc_feature (1)...(468): n = g, a, c or t
ctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctcaagtttcattgactttttttcttcacagcttatccatggttttaaggttgtatatattagatcttctcataagacatattaatatgtggctattaaaatgtaacattcaattactactgtgaacttttcacaaacgaaataacaatttagaaatcagaaatcaatgtagaaatatggaaaccttaaatagttatttatagaattctaagtttttccagttatagaatcagtaaaatcaaattgaatataaagtaaatgaaatctgnttt

SEQ ID NO: 6610 - DNA, 506 bp, Homo sapiens
  misc_feature (1)...(506): n = g, a, c or t
ccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagtnctgtacttaaggagcaagtnactacaaacccagttcct

SEQ ID NO: 6611 - DNA, 240 bp, Homo sapiens; identical to SEQ ID NO: 326

SEQ ID NO: 6612 - DNA, 461 bp, Homo sapiens
  misc_feature (1)...(461): n = g, a, c or t
ctgtgcaacttggagcattttagcttggtaacactgatcccctttcaggtgagtattgggcttgtaatttgaatttgaatgagaaaccgtaatgtggctactggtaaggtaaaacggataaatgccccagaccaaaacagctcgcaacgaagtatgtttgccgtaaagtcacacagtccaggcttgataatcttctgagaaattgataaaagatgtgtgatgtagacatgagtagcaaggactaaagagataaattcattctgaaactgctttgaatattgtatgttgttgatgggttggaaatatgtcaccttaggaatgagtttgtttttttttaattggagttttaggagttggtaatatcgtggtcagtatatataggcttcacaagttatgtaatttgtagtggggacatggaatagacatttcatctgtgtcaccccgaggnggttttagggttt

SEQ ID NO: 6613 - DNA, 313 bp, Homo sapiens
ctgaaagagacagactccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatgtctataatgaaggcccagcagaatggaatgtgtgaccatcttcaggaagaaaataatgaatacatgagtacaagaaaataaattacaaataaaagtcaaacttgaattctatatgtattaaaaatttcattt

SEQ ID NO: 6614 - DNA, 212 bp, Homo sapiens; identical to SEQ ID NO: 6127

SEQ ID NO: 6615 - DNA, 286 bp, Homo sapiens; identical to SEQ ID NO: 421

SEQ ID NO: 6616 - DNA, 274 bp, Homo sapiens
ctgacaagacacctacaccttcccactaccccttgtcctgcccctcagggattagcacccagaattccctgagctgctctccaccccaccagtccccagccctagaggacattggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccagg

SEQ ID NO: 6617 - DNA, 314 bp, Homo sapiens
ttgttgcactgcaactctgcctcgaattgggctatgcccgagtatcctcagagtttagatgggcagtgtatttttgcttaagtagaagaatgtagttgtgccactgagaaggataaccagaaaaggttagatatatttgtcagttcacttttactcaaatttccattgagttacttaagaaatcagttcttcaaagtggatatgtacattacaggctctgtcacctacacatacacaggaatcttttgaagaataagatctgggtaatactggagtaggatgtaggaaggttaatgttgtatagatgatgtttt

SEQ ID NO: 6618 - DNA, 304 bp, Homo sapiens
aaatctgggaagctggggggacgagctgtgtatgacatagttcattttcagccatattcctggattgatgggtggagaagttttaacccaggacatgagcatccagatcagaactcatttacttttgcccccaatggacaagtatttgtttctgatgctctctatggacccaagttgagccaccttaacaatgtattggtgtttgctccatcaccctcaagccagtgtaataagccctgggaaggtcaactgggagaatgtgcgcagtggcttaagtggactggcgaggaggttggtgatgcag

SEQ ID NO: 6619 - DNA, 292 bp, Homo sapiens
aaaagacatcggtcagtaacgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtgg

SEQ ID NO: 6620 - DNA, 175 bp, Homo sapiens
aaaattagggttcacaagttctttacgattagaacactgaagtgcatttccataaactaagtccaaagcacacagcagcaggtgataagaattgaccaaatcatcactaatcatggggaaattaccgctgtttccttcctcgctgctgacgaggttgctcctcttgagggtattt

SEQ ID NO: 6621 - DNA, 214 bp, Homo sapiens
  misc_feature (1)...(214): n = g, a, c or t
aaaattttatctcttattcagtaaaaaacaacttctttgtaatcgttatgngtgtatatgtatgtgtggnatgggtgtggtgtttgtgtgagagacagagaaagagagagaattctttcaagtgaatctaaaagctttgcttttccttggtttttatgaagaaaaaatacattttatattagaagtgttaacttagcttgaaggatctgttttt

SEQ ID NO: 6622 - DNA, 349 bp, Homo sapiens
  misc_feature (1)...(349): n = g, a, c or t
cctcgagggagattgccagcaccctgatggagagtgagatgatggagatcttgtcagtgctagctaagggtgaccacagccctgtcacaagggctgctgcggnctgcctggacaaagcagtggaatatgggcttatccaacccaaccaagatggagagtgagggggttgtccctgggcccaangctcatgcacacgctacctattgtggcacggagagtaangacggaagcagctttggctggtggtggctggcatgcccaatactcttgcccatcctcgcttgctgccctaggatgncctctgttccgagtcaagcggccacgttcagtcacacaggcccttgcttgg

SEQ ID NO: 6623 - DNA, 174 bp, Homo sapiens
ctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaagg

SEQ ID NO: 6624 - DNA, 298 bp, Homo sapiens
ccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcag

SEQ ID NO: 6625 - DNA, 481 bp, Homo sapiens
  misc_feature (1)...(481): n = g, a, c or t
ccactgcaatgactgtaattaggcccatgataacagcaattaaagtgaaaataaatctcttagatctttttagaattcactgtaacacttcattaattaaatgtattgaaggggaggattcccaaggtctgggcaaagttaccggaatccagattccttcttgagctcgaaccaacattacacttttcctggaatcaaaatgggagttaatacaagtgtataaatgacaattaatgcattggacagtttgattgttcatccaaattttgatatatctcactaacagcatgcaaggaggcttaacagaactctgtatggaaacaggttggaggtaggtaaagcagaatgtctggatctacgttgatactgagagagggagatggtagtggggacaacagacagaatagtttctgcttnccatacttgcagtccagacatggcaatagccaatttccaaagttctgggtggtctgggtcagaa

SEQ ID NO: 6626 - DNA, 360 bp, Homo sapiens
  misc_feature (1)...(360): n = g, a, c or t
cctcttaatggatttcaggcacaagataatttgtggtttcttctactttatccctactgcaattaattccacttttcaaatcccaaactaggaaggtgctgatattcccttttcaattgatatgctttgctacaaagcattagaaaataatcaacattttgcccactcccccaaataagaatctttttagaaggcatgacttcccaatggagatttacacaggccttgtaaatagaacatcacccaaatgcacagaggcactaagaaaaagccggagggtactgcttaccattttaggtgcggncacccagacttattcaaaactagatttcaaaagaaaaaaaaaaattttcactttgg

SEQ ID NO: 6627 - DNA, 372 bp, Homo sapiens
  misc_feature (1)...(372): n = g, a, c or t
tcttggcacctctaattgctctcgtgtattcggngccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgnttctcagtgccattgtgatgatgaanaaccgcagatccatgccccatgaagagggacaaagaatgggatataggagtgcacagcccagcctgacctgtgacatctctgtgnttcagncactgtggagcaacatataggcaacattttcatgtttantaaagtggacct

SEQ ID NO: 6628 - DNA, 155 bp, Homo sapiens
cctatcaacctaagcaacagaaataatctgacactaccttatcaggcaaattggggaggggagggtgtatctagctctagttcaaattatttggaagtgttccctgagaaacccaccagcctaagaagctctggccccaagcttgtcactagcag

SEQ ID NO: 6629 - DNA, 334 bp, Homo sapiens
aaaatgaattccggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggttt

SEQ ID NO: 6630 - DNA, 420 bp, Homo sapiens
ctgcttgggattagaagtttttactgactgaaaaaacagtgggtcccatcctctctgaattttccctgaggagagtcagttcaaccttattacagcagcttttacaaatctatctctaaagtctccctgccgactcaagtttccactgacttgtccccctgcatgcgatgccatgaccttcacaccaacatccaaccacatgtctctcctttggaatctgtgtgccccaccaccaggaacctgttaggcaaaggtggcaccatctccctctgtaaggctgcagcgggtgtctgtcagcatctgacaggggccctttgcgtgctgtgtgttgaatgttgcacttgctgaatgcatgcagttcccgtgagcctgtggctgagctgaaactgacagcgctctgcagcccgatccatcttccag

SEQ ID NO: 6631 - DNA, 309 bp, Homo sapiens
aaaacaacttttaacagatataagatcagtatcattcacattcacacaaacatacacacactttagaaagactgtgtgcttggcttcggcatatttaatatcattaaagaatatatagaatcatccttttatcataaggaatttacatcattgttttctcaaaagctgctattttagattgaaacagcattcagaaaaaaagtacatttcagatggtcagcatcaggatttactacagactttgtaaacagatatctataaataaataaactagggtggagaaaagaatatcctgaggtggctctgtgg

SEQ ID NO: 6632 - DNA, 315 bp, Homo sapiens
ccttcctccgcttccgctgcacctcttccttgtctgggggcagaggaaaatgagattgagcccagttattgtgtcatgcctcaggggcccttcccagaagagccctcagggccggctcctaggaagcacctcctgggaccctcgcacttctgacttggctcatgcatccccacatctagctcttgggaccttcttctagcccagcctggccccccgccagcaccctgaggtcctcagcccagctccaccttccaccagagggtaataggtgaactgtttggaatcagacacgtcccctcctcgcttgcgtttcag

SEQ ID NO: 6633 - DNA, 306 bp, Homo sapiens; identical to SEQ ID NO: 264

SEQ ID NO: 6634 - DNA, 129 bp, Homo sapiens
  misc_feature (1)...(129): n = g, a, c or t
gtaggaagtgaagagaaccagggcatctggtcaggaggatattgtaatgattcagataagagatggtggcagtggaggtggtaaaaagtgggtagatactagatgtctttttttttttttnaaanaaan

SEQ ID NO: 6635 - DNA, 341 bp, Homo sapiens
atctcaaacaaacaaacaaacaaagaaaaaaaactcttgtctccttaggatatgttacctgctccactgcagactagagaaataaatgtgtattgaaccttttactgcaaacttgaaaatgctagaaaaccaagcatgaagaataaatacatggtgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccattttt

SEQ ID NO: 6636 - DNA, 367 bp, Homo sapiens
  misc_feature (1)...(367): n = g, a, c or t
aaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttacctgnccgggcggccgctaangcgaat

SEQ ID NO: 6637 - DNA, 262 bp, Homo sapiens; identical to SEQ ID NO: 6571

SEQ ID NO: 6638 - DNA, 155 bp, Homo sapiens
ccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccag

SEQ ID NO: 6639 - DNA, 171 bp, Homo sapiens
ctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaa

SEQ ID NO: 6640 - DNA, 274 bp, Homo sapiens
ccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacctaaagatttatcaaatcagtcagtgcaaatgtcagatacaatgtatttattt

SEQ ID NO: 6641 - DNA, 397 bp, Homo sapiens
  misc_feature (1)...(397): n = g, a, c or t
ctgcatagtgcaaaggggtcctcccacacttgtcctttttatggaaatctgctccgctgctctgcaagagttttatacattccacattacctcctgcagcagcagcatgaaggcacgttcttccaaatttatctggggtgtctatttcaaagcccgatgataacaactttctgcagcagtcagagtgagcatttagggcagctaaatgtaaagggaacatgctatggattccacacttggctgtgtcagctccgctggttattaaggtgttaatcaaaagctcatgaccgtatcttgcagccacatggagaggagtgttgccgtccttatccacacagtcaatttcacctccattctgaatgagggtctgtgaccgtgtggnaccttccatggacag

SEQ ID NO: 6642 - DNA, 270 bp, Homo sapiens; identical to SEQ ID NO: 2914

SEQ ID NO: 6643 - DNA, 195 bp, Homo sapiens
cctgctctctttttctccagggtcagaaacaggaccgggtggaagggatggggtgccagtttgaatgcagtctgtccaggctcgtcattggaggtgaacaagcaaacccagagggctccactaggacttcaaattgggggttggatttgaagacttttaagtttccttccagcccagaaagtctctcattctagg

SEQ ID NO: 6644 - DNA, 244 bp, Homo sapiens
  misc_feature (1)...(244): n = g, a, c or t
ngtctggncctgcanacaggtgctcttgtcctgagtgacaacggcatctgctgtatcgatgagttcgacaagatgaatgaaagtacaagatcggtattgcatgaagtcatggaacagcagactctgtccattgcaaaggctggggtcatctgtcagctcaatgcgcgcacctctgtcctggcagcagcaaatcccattgagtctcagtggaatcctaaaaaaaacaaccattgaaaacatccag

SEQ ID NO: 6645 - DNA, 343 bp, Homo sapiens
cctgaaggacccagggccctctggctggatgcgtttgcctatcaggacccagaattacttacagacctgtttagggctaggcttggcctctttcttgagctcatctggaggggtgtgacaacactcattcttcatccttattctccctggctgtgggcaacacttgtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagccttcatcccgtccatgtgggaaggaacttgggtcc

SEQ ID NO: 6646 - DNA, 306 bp, Homo sapiens
  misc_feature (1)...(306): n = g, a, c or t
ctggtgtgggtgagtgtcctcggggctggtgaggggacagcagcttcagtggaaacccttccctatgtgtggccgagggcctagaacacgtctgagcgggtcaggtgggttcttcccactggagggcgtggcctcaggctgagagtgaagacggggaaggggaggaagagaacagctcgggctcctgagaccagganccagacctggtaagtacatgaccttaggggctgggcctttgcctgnaatcccaacgctttggaggnccatgcaggaggatcggatcacttgaanccatgagttaaaacc

SEQ ID NO: 6647 - DNA, 471 bp, Homo sapiens
  misc_feature (1)...(471): n = g, a, c or t
aaatgttttacttctttgataaagcagagtacaatagaaaaaaaacaattagtttccagtaatatctatatctctaatcagaattaagtcttccaagacatattacctggaaataaaagcctgttacaataagcaaagcttcaaccagagcggctacttttcgtgccaggaaaaagttcatccctataggaggaatgatgtgctatgtaaaatggctgtaaggtcacagccttgagggcattggaagtatattatcctattccacattaagtatttcagcgaatttcaaacatcagtttatctgcaaccatgctggcaacctttaactgatatttcaatcaaccggtaaaaaataaattaagaaatcccttcacggatattcccgggatttacactgttaaaangtacactgttcattaacatgtaattctggttcagaattacctttgagactccttgctcaaaaattgg

SEQ ID NO: 6648 - DNA, 467 bp, Homo sapiens
aggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaatt

SEQ ID NO: 6649 - DNA, 338 bp, Homo sapiens
  misc_feature (1)...(338): n = g, a, c or t
aaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgnctagtggaaatgaataatatcccagccactagtgtacagggtgttttgtggcacaggattatgtaatatggaactgctcaagcaaataactagtnatgacaacagcagttctttgnaataactgaaaaagaatattgtttct

SEQ ID NO: 6650 - DNA, 366 bp, Homo sapiens
ctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccag

SEQ ID NO: 6651 - DNA, 287 bp, Homo sapiens
ccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagagg

SEQ ID NO: 6652 - DNA, 138 bp, Homo sapiens
ccatgttgaaggcaaggaagaaaaaatggaaatggcctgtgccagctatatatatcgccttttatgagggaaagcaaagctttctcagaaatcccaaatggattttcccttgacttaattgcctgaccagttaaatgg

SEQ ID NO: 6653 - DNA, 248 bp, Homo sapiens
  misc_feature (1)...(248): n = g, a, c or t
ctgctttgaaggctgcacagaaaaccttacttgtttccacctctgcagttgataataatgaagcacagaaaaaaaaacaggaggcattgaaacttcagcaggatgtaaggaaaaggaaacangaaattttataaaancacattgaancacagaagatgttaatttcaaaactggagaaaaacaaaacaatgaagtctgaanataaagcagaaanaatgaaaactttagaggttttgacaaaaaanatt

SEQ ID NO: 6654 - DNA, 305 bp, Homo sapiens
ctgagttcccttcccgaaggtcagctcggggctcccgacgatcatgcagaagtagatgccactgtcttccggcttcacgcttgtgagattgagaatgaaccggcttgcatcccgaaacacagctatcttctcctgttccacctcttcaccgtggatagtcccttttgcggaatcccagagggccaggaactcgtggtgactgtcactgctcggtgcctggcgctgtctcagccagtagatgcgcatgttactgagggagattttagcctcgcaggacagcatcaccatcttgttggtttgccctt

SEQ ID NO: 6655 - DNA, 236 bp, Homo sapiens
  misc_feature (1)...(236): n = g, a, c or t
aaaaaagactatgtagaaaagaggtctataaaattgtgcaaaatacccagcattaataaacccgtttcaagtattgccagcatgagcataacccacccatgccgggacctggcttgggagagaagtggaggggcaggctgggatcccttaaagagctctccatgggcaggggaaggaccaggctcccacttccactgtgctgcccaggaactgcacaggagctgaggctgnngggt

SEQ ID NO: 6656 - DNA, 357 bp, Homo sapiens
aaaacaggtacaaaatattgaaatgaccaacgttacatgatttcaagggttgtcctttctgtgcttttatctgtcacgacaggaaggtgtggaaagtttatatccttaatttgactactcttggatattaaaatctttctattaattaaaaagacttttagacaacctcttaaatggaattacactatggaaaacagggctcccccaaaaacacctaggcagaactgagagttctttgaaaaccattcccaataaaaactaaatgaaaaataaatataaaacaaagcttaaaaaaatatgcattacctgacaccaaccttttctggctgacaatatttattcatgaaaacatatcag

SEQ ID NO: 6657 - DNA, 343 bp, Homo sapiens; identical to SEQ ID NO: 6492

SEQ ID NO: 6658 - DNA, 298 bp, Homo sapiens
ctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagactaggcaaacatacaagctttgcccaagg

SEQ ID NO: 6659 - DNA, 453 bp, Homo sapiens
ctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtc

SEQ ID NO: 6660 - DNA, 359 bp, Homo sapiens
  misc_feature (1)...(359): n = g, a, c or t
gtctacctgcagcacagcacactccctttgggcaaggacctgagacccttgtgctaagtcaagaggctcaatgggctgcagaagaactagagaaggaccaagcaaagccatgatatttccatggaaatgtcagagcacccanagggacttatggaacatcttcaagttgtgggggtggacaatgctctgttgtgatttcctggcacatcatggaaccgactgctggacttaccattattctgaaaaacccatgaactggcaaagggctanaanattctgccgagacaattacacagatttagttgccatacaaaacaaggcggaaattgagtatctgcagaaaactctgcctttcagcc

SEQ ID NO: 6661 - DNA, 368 bp, Homo sapiens
  misc_feature (1)...(368): n = g, a, c or t
cctcgggtgatctgcccacctcagcctcccaaagtgctgggactacaggcataagccactgcgcccggcctggtccaggttttctaagatgcaggctgcagattctgtgttctccagtggacacttgcagagganccaggaaggaccacaggtcccttttggaaggaacgttgggcctgtccccangaatgcacactagtatcctttctagtggagtgtctgaggctcacagcctcttgcttaccccaggctcanatcactgagccttagcannggtctctatcctgtttcaaggatgccaananccacaagacaaatggacgtttcagaaggaactctgacggccgagtgancancctgtcctgagg

SEQ ID NO: 6662 - DNA, 147 bp, Homo sapiens
  misc_feature (1)...(147): n = g, a, c or t
cctccaaaagcgagcctctaggtgcacatgtaactatgtgtcttctctgtgcatgcacatgttcaggtctgggcccacccatgagaaacaggagcacccgcagcagaccattttaggaatgtgagctctggggcccatcntgtgttc

SEQ ID NO: 6663 - DNA, 347 bp, Homo sapiens
  misc_feature (1)...(347): n = g, a, c or t
ccaagaacaaggcgtgtgccacagtcacgtagtgacacaggtcacatttgctttctgccagcagaagagactggactccagtgcaggggagtgtgcaaggacaggttctggggggtggaggcatctgtggacatcccagggcaggggtgagggccagaacatccctaggtcctgagactacagtttctccacatttagatcagacattctcttccaaggaaggaaaccaagagaggctggtgaaccgtctggtaatgacaagccctcacttttgcagccctcttggctggtccctcagcaggtcttccctatgaacctgcaaaggagacaggcaggaatganttcca

SEQ ID NO: 6664 - DNA, 168 bp, Homo sapiens
  misc_feature (1)...(168): n = g, a, c or t
cctatggaagaagaacacaaaggaactatatctgtagtagaagcccatcctaactactaagaaagccacacgataccctttagatttcacattagaattcctaaactgttagcctaacacctggccctcatnctgaccaacaggaagagganttctgaaccacccatc

SEQ ID NO: 6665 - DNA, 368 bp, Homo sapiens
  misc_feature (1)...(368): n = g, a, c or t
agggcgaattgggccctctagatgcatgctcgagcggccgccagtgtgatggatatctgcagaattcgcccttagagcggncgcccgngcaggnccatactaaccctgntaaaatgcccatnttacctggatggcnacccancantgctcctgcccacctgcccctnaatcctcctagaattcagnccccaattgcccagttaccaataaaaacttgtacaccanncccagggacagtctcaaatgcaaatccacagagtggaccaccacctcgggtanaatttgatgacaacaatccctttantgaaagttttcaagaacgggaacntaangaacntttacgagaacagcaagagagacaacggatc

SEQ ID NO: 6666 - DNA, 396 bp, Homo sapiens
ccacataccaagatgtgaacatattcttgtcttatataagaaaaggctcaggttgtatgccacaaactttgaattaaattccagggaaatattgctttggtaacatgaacaatttgtaccacattccattaaaaaaagatttaataaaatccctcaaacagcacttttctacttgtttcggagtacacaattcccaaattagcacaaacaaaacaaagcaaaaaaagaaaaacagacagaatgtaaaatgaaggttgctacttttatgatatcacttccctttcccttccttagctagtgttcttttcctttcccttaatagtaaaggatggtgaatagaaaatgacctattcttatccccatccatttgcttctaggattcctgcttaaaccaaa

SEQ ID NO: 6667 - DNA, 234 bp, Homo sapiens
aaaaagtcttcaggcagagtaatcatgttagaggtggtattcgatggaagaaagtttagagagttaggagtgggggtagaattctagaatttataagagtccaggaagcatagcagtcaggggcaaaaattagcgtaatatggagtaggcaatagaggagctactggagtcagaagtcactgcagagtgcaacataggaagatggactcctagcttacatgagattccctgcag

SEQ ID NO: 6668 - DNA, 245 bp, Homo sapiens
  misc_feature (1)...(245): n = g, a, c or t
ctgcaagaaaacatacctgtcccccaaaagttgtttttatgcactgtgtctcgtctangcaagcgcttncaagaagccaggattcacttgagaatgtgtctctctctggcaggtctcgacatgacaactactgtgtangtgagggagggaactttcaaagcactttgttttcccacttactatgtgtgagaagttgctcctgctctagatctcatgtgccagtactcaccaatttgnaaaaggct

SEQ ID NO: 6669 - DNA, 247 bp, Homo sapiens
ccttcccagtccccacaggtccccgtcctgataggtccctggagctccactggccctcaggtaaactccaagcgccacactactgtctacaaacgctggtgatctgggcctgcagcccttctcgccttggtggaggcccctccccacgctctggaaagtgcctcaggccctctcagctctggtctctgcaccttccattcccctcacctagatcactcctctaccaaactcctgcacaccttccagg

SEQ ID NO: 6670 - DNA, 225 bp, Homo sapiens
aaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagtcaaaaaaaaaaaaaaaaaaaaaaccc

SEQ ID NO: 6671 - DNA, 172 bp, Homo sapiens
ctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccggagcctgcctgtcagcccag

SEQ ID NO: 6672 - DNA, 340 bp, Homo sapiens
  misc_feature (1)...(340): n = g, a, c or t
ctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttancatctgtgacaccttcaacttctccgact

SEQ ID NO: 6673 - DNA, 101 bp, Homo sapiens
ttctgagaagctgattaaagctgtgcccaaagaagtgaactttggtttggttttgaatggtgaaggttgccactgctgactatatcaagctattgagacag

SEQ ID NO: 6674 - DNA, 101 bp, Homo sapiens
cggccgaggtctgttttattgctaaactatcatgatacaagccgtataaaaatactttacatataggaaaaataaactacattaaactggagattaaaaac

SEQ ID NO: 6675 - DNA, 199 bp, Homo sapiens
ctgtccccaccaccaccctgtgcagcaggggttaacagacctcactttgtggggggaaaacagaggcttggagaggtcccctaacttgcccactgtcacacgtagtgagtccagagctgggactccatgtttggcccccccctgcactacctctgtggacaggacactgccctccttgcccttggtctctctttcagag

SEQ ID NO: 6676 - DNA, 204 bp, Homo sapiens
  misc_feature (1)...(204): n = g, a, c or t
aaaggatctcatgatttntagtattccaagaattttctttcaccaagggcgatttaatatgggtcattcatacttctcttggatttcttgcctttttttaatctccttgccagccaaatgataaatgccaacccanagaatgcagtnaccatgactgccactggaatgaanagggggtnataatcaccctccttaatcattgag

SEQ ID NO: 6677 - DNA, 217 bp, Homo sapiens
aaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttatttt

SEQ ID NO: 6678 - DNA, 296 bp, Homo sapiens
  misc_feature (1)...(296): n = g, a, c or t
ctgtgttggcatgcacctgcagtctcagctacttgggaggctgagacaggaggatcactcaagctcagaaggtcgaggttacagtgagctatgatcatgacactgcactccaacctgggcagcanagcaanaccccgactcaaaaaaaacatatgaaaagaaaaaagtatggancatanttggggaaaagcaaatagccntatctgagcacagtcgactcatgatgctctcttctactataactgcctttacttttctcataaaagttgaaaaataccattctgccatttgtgcat

SEQ ID NO: 6679 - DNA, 103 bp, Homo sapiens
  misc_feature (1)...(103): n = g, a, c or t
agggactgatgccacaggccaggctgcctctggagggtcctgggctggtggcagcttctaatgctctatggaatgaggacatatccttcttcttnnagaatct

SEQ ID NO: 6680 - DNA, 278 bp, Homo sapiens
aaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttgttcaaatgattttaattattggaatgcacaatttttttaa

SEQ ID NO: 6681 - DNA, 201 bp, Homo sapiens
  misc_feature (1)...(201): n = g, a, c or t
ctgccttttggctcagtcagaatattcaagtctccagttccaatctgagaggactttgagagcaaccctgctttgcagacatctggttttgttctcagagcttcagactttgtatttagacaggaagaaatttcctctggtaaactttgtttatgacatccttgaggaatttttgctccaaggttangtggagagttggca

SEQ ID NO: 6682 - DNA, 223 bp, Homo sapiens
  misc_feature (1)...(223): n = g, a, c or t
ccttccgggccctcgtgcaggagaagatacaaaaaaggaatcagaggcaaagtggagacagacgccagctacccccaccaccaacaccagncaatgaagagagaagaggagggctcccacccctgcccctgcatccangtggagaccaangaggccctccagtgggtccgctctccctggggctggcgacagtggacatccagaaccctgacatcacgagttc

SEQ ID NO: 6683 - DNA, 100 bp, Homo sapiens
  misc_feature (1)...(100): n = g, a, c or t
ggaaagaatagggcacaggtggggatggatggttggttggatatgtcacttttcttatggnaaacaattaaatccatattctctctgcttaaaagaagaa

SEQ ID NO: 6684 - DNA, 448 bp, Homo sapiens
ccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaac

SEQ ID NO: 6685 - DNA, 429 bp, Homo sapiens
ccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctaggttagtacaaactcgcattcatggcttggtttcccagaagatctccatttaactttttt

SEQ ID NO: 6686 - DNA, 286 bp, Homo sapiens
ccacttcaagtcacacaggtagataaaaacaggtccttttaggggccaaaggagaggttatcacagcagcagtttggttctcagcagaaatgcccagggcccctgttccacatcaaagctacaagcactgttgtcagggcatggagagtgacgggaccagagccctcctcgtctcagggcagcctgcctggcttcaaggtggagatcacagcgtcctctggggtcataggttcccccactgttccacaggagggaactggtccacctcgcccacctctgtgctcag

SEQ ID NO: 6687 - DNA, 240 bp, Homo sapiens
ccattgacttttctgtcgccaacagatctggcaaaagcaggcttttactacataggacctggagacagagtggcttgctttgcctgtggtggaaaattgggcaattgggaaccgaaggataatgctatgtcagaacacctgagacattttcccaaatgcccatttatagaaaatcagcttcaagacacttcaagatacacagtttctaatctgagcatgcagacacatgcagcccgcttt

SEQ ID NO: 6688 - DNA, 219 bp, Homo sapiens
  misc_feature (1)...(219): n = g, a, c or t
aaaaatagccatctttgtacttttttgcaagtttctctataagcttgaaatagtcatgtgatacttcgacaaacatcatatgccttgcagtttttctcggncgtgttctcagggttgagtagtccccttagctacctaactttactttcaatacaaagcacaaaaaagaatatcttcaaataaaagnttgcctgcagaacctggcaaaatgacccatta

SEQ ID NO: 6689 - DNA, 118 bp, Homo sapiens
  misc_feature (1)...(118): n = g, a, c or t
agtgtgatggatatctgcagaattccagcacactggcggcngttactagtggatccgagctcggtaccaagnttggcgtaatcatggtcatagctgtttcctgtggncgntntacaac

SEQ ID NO: 6690 - DNA, 308 bp, Homo sapiens; identical to SEQ ID NO: 3350

SEQ ID NO: 6691 - DNA, 226 bp, Homo sapiens
ctgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacatttt

SEQ ID NO: 6692 - DNA, 180 bp, Homo sapiens
ccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttgg

SEQ ID NO: 6693 - DNA, 378 bp, Homo sapiens
ctggctgcacccagccctgggcatccttaggcttcctggctcctggcagattgctcctgtacggactgccacagagctctgatgttgccctgaccaaagccagtggccccctgcctccgaatcagctccaggaagaaagtgtcctcagtaaaaagggacttggtgaagacctgaagcagaaacttgcctttatcaccatctagcaggatcccctgtcgagcaagcagatgaggctcgtgccctgcagctcggatctgcctctcctttcctggctgctggtagtatgccccagggggagccaggaactggcctccagcagttgccaccccctcagtggcctccacaatgttaggcgtatacagccccacgtgctgcagg

SEQ ID NO: 6694 - DNA, 52 bp, Homo sapiens
ccaccctgaccatcaacagggtcgaagccggcgatgaggccgactattactg

SEQ ID NO: 6695 - DNA, 449 bp, Homo sapiens; identical to SEQ ID NO: 52
  misc_feature (1)...(449): n = g, a, c or t

SEQ ID NO: 6696 - DNA, 493 bp, Homo sapiens
cagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatca

SEQ ID NO: 6697 - DNA, 369 bp, Homo sapiens
ctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcag

SEQ ID NO: 6698 - DNA, 484 bp, Homo sapiens
  misc_feature (1)...(484): n = g, a, c or t
ctgttcctggggctgctcccacagactatgagactcagcagcccccaggcccaccccagcagcctgtgatgaccccaaacttcacctggtagccatggagttctctgcacccctcattcactcccctctggtcatttcctgagtctaacatgccctttgaggaaggcaggaggccgatccgtgaacagagagacactgggccccagaggtgacggggctccagggacagacacatctctgccctaagagactgtctcctttctggtgactgtcctgggagggttggattctggcacctcacccagtctcacccgtccctctgtgtccccatgtcctcatgacccagcacaggccacagagctgcagcctagacccagagccctctctgtgccctccattggtctccccttggggtgacctctgtgtcaccaggccgtgtggccctnccangctggattggcatccagtcctcagcctagaccct

SEQ ID NO: 6699 - DNA, 121 bp, Homo sapiens
gggggaagaggtttgttaatacgttcgccatgtgctacgatcttgggacgaactgagccacgagcgtggctttgagggccgtccgaacgctgcaggccggccaggtccctgggcgtccagg

SEQ ID NO: 6700 - DNA, 459 bp, Homo sapiens
ccttgctgaacaggcaagaagattctatgaggtgcctggctcaggaggacacgccactataataattcttttttttgagacagagtcttgctctgttgcccaggctggagtgcagtggcgcgatctcggctcactgcaaactccgcctctcgggttcacgccattctcctgtctcagcctcccaagtagctgggactacaggcgcccgccaacacgcccggctaattttttctatttttagtagagacagggtttcaccgtgttagccaggatggtcctgatctcctgacctcgtgatcccacccacctcagcctcccaaagtgctgggattacaggcgtgagccaccacacccggccaataattcttacctctacaagctagtggggggcaaaggtacacccaggacccaaggaactatctatttagaactgaggggtttcccaaggactatgggcat

SEQ ID NO: 6701 - DNA, 140 bp, Homo sapiens
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcg

SEQ ID NO: 6702 - DNA, 248 bp, Homo sapiens
aaatgtatttacagaactattcctgcataagttataattcagacatccaaattcaggtaattgcctcttgggtaataagacaaataatgatagtctcaacagaaaaaaagcagctcattagtatacacacagattctaatttgcttcattatttagccatctttgccacaaactacctgctaacagttaaaattctgacatggacacgttttagttgagaagttcaattttgcaaagaatttaatttt

SEQ ID NO: 6703 - DNA, 278 bp, Homo sapiens
ctgacactatgggaggcaagtaatgccttgcgtgttgggcttgtatttgaaataactctgatcaaagaccccttgcccgtttcaataaaacactgccacctcacctctatttgcctgaagggcatcttacctgagttttcttttgtatgctggatgctccagatctgggaataaatcgggttgctatctccaggatttacattgctgtacattggctccagctccattggggctagtggtttagagtgagtgggctcttgagggtctatcctggaagg

SEQ ID NO: 6704 - DNA, 337 bp, Homo sapiens
ctgccaccacggcagggcatgggctttgggggcaacaaggagagacaggctgtctcctctaggaacaactcattattcagctaaacgaaatggaagagctccatgtgaccaacaaacccaaattgagccaaaacaacaggcgtccccaccccccagagggataatgtgccaccaccctgtgtgcagtgggagagcaggaatggaggaaatattcctggttcagttacactcctcgtctgtcaggacagatgtgtcaccctatctcggattccgggagggtggctgggggtttccctcaactctgcagcaaatacttcaatgctactgtcatttgagg

SEQ ID NO: 6705 - DNA, 472 bp, Homo sapiens
ccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagctta

SEQ ID NO: 6706 - DNA, 339 bp, Homo sapiens
  misc_feature (1)...(339): n = g, a, c or t
ctgatgcctcactnctagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttcccttttttttttttgagacagantctcgccctgtcacccangctggagtccagnggcacaatcttggctcactgcaacctctgcttcccgagttcaagcanntctcctgcctcancctnctgantagctgggattataggcatgcaccactcacacccagctattttttg

SEQ ID NO: 6707 - DNA, 244 bp, Homo sapiens
cctggtctctggaagatgaacttaaaaccagcttctcaaggtggttcatttaccacacatacttcagtgctcttttctgatttcatgtcccttatcaaggtttatgatttggggaccctcaggatttaagtgatcatggagaaaggaccataggtattgctggctcttaacagggcagttaacatagctgaaggatgtgggctttcttatgttctccatgcctaggacttcctccgtcaggcag

SEQ ID NO: 6708 - DNA, 486 bp, Homo sapiens
  misc_feature (1)...(486): n = g, a, c or t
ccttgcctcacatccaaggtcactcggaagaggccatgtctaccctcaatgacactcatggaggaaatgctgagagaagcattcagatgcatgacacaaggtaagactgccaaaaatcttgttcttgctctcctcattttgttatttgtnntatttttaggagttttganngcaaacatgacnncacccagaaattcantnaatgggactttcccggcagagccaatgaaaggccctattgctatgcaatctggtccaaaaccactcttcaggaggatgtcttcactggtgggccccacgcaaagcttcttcatgagggaatctaagactttgggggctgnccacgattatgaatgggctcttccacattgccctggggggtcttntgatgatcccagcagggatctatgcaccccatntgtgtgactgtntaggtaccctctntggggangcattatgtatattatttccggatcactcctggca

SEQ ID NO: 6709 - DNA, 305 bp, Homo sapiens
  misc_feature (1)...(305): n = g, a, c or t
ctgcaaatggttcnncngaaacatctgccttggacacagggttctcgctcaacctttcagagctgagagaatatacanagggtctcacggaagccaaggaagacgatgatggggaccacagttcccttcagtctggtcagtccgttatctccctgctgagctcanaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatcta

SEQ ID NO: 6710 - DNA, 420 bp, Homo sapiens
ccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtcc

SEQ ID NO: 6711 - DNA, 262 bp, Homo sapiens
ctgcaaagtaaatattgagcagtttctgcaaaagaatagcagaattatgaacgtgcattcattctctaatggtttagattgcattatacttagttgttaggttgagcgtaatttttcttgtttcaaattaaatagacagtttcaagcattactttctcaggatgatctctttttgatgcttttttcttacagttacagatttatggtaatggaaagactaggaatagatttacagaagatctcaggccagaacggtaccttt

SEQ ID NO: 6712 - DNA, 292 bp, Homo sapiens
aaatttgtgagcctgcttgggatccattacctagccattcagagatcctgtcaaatgcacagcagattggatactcaccatcccaaaggggttcctcccacctggatggggccaatctctagttgacagtgcccctcagagtgcaccatggagatggaatgtcccttccagagagacttttacacagggaaaagcatttgttggctgggctccaactctcatttggtacaaaaagctttacattcttttccctttttacattacattcttcaaagacttccgtgcttgccag

SEQ ID NO: 6713 - DNA, 515 bp, Homo sapiens
ctgattgagcgaaggaacgagtgagccgagccagtcagcagcattagtgtgatacgtgttgcttttcaattaaagctctctgcctctcggttgagcaactctgagagccggggtccccacccttctgtccccctcatggtgggtcttgtacccaacagcttgccagagcagagagccatgaatagggtttggtttcaggaaagatgaccaggagactcagcccaggagtcagcctgagttcaaatcctggccccacgcttcctgccttgtcaccctgggcatgtgattcagttcttggttcttgtacatttgggtggaaactgacaactgcctgccatggggagaaccagcttgcctgccttctgcaccacggctggcactgatcattagcaggttaaaaaaaaagctttgccaatacgccgggcacagtggctcacacctgtaaccgaggcactttgggaggccgaggcgggtggatcacctgaggtcaggagttcgagatcagcctggacctc

SEQ ID NO: 6714 - DNA, 525 bp, Homo sapiens
ctgttatttccccagtggggcctcccaaggagcttggctgcttggcttgagtgggacaagggcaggggtccctgactccccacctgatcaaaggctggggaggtggtagggagcacccagaactgccggacgggcctcccacaccccaggtgagcaaacaagcacggagcagcttcctgcggttccatctgagtgacatcctcacgggggcagggcacggcttcctggggcctggggacttccctgcctcagtgtgtttcttacacttccctgcctaaggtgatgccacggaggggatggttgagatgactcccacgggccccttccagtccacctttctccgttccgactctgagtttcctcgggtctatagcttatgggaagggagtgaggaggggacaagccagcctccttccccatcaatgcccacaacctcccatcccctggacccagccaccctaggagttctccaccccaccccatctcgcctggcggaggggaccgccgggtttgattgatccatct

SEQ ID NO: 6715 - DNA, 237 bp, Homo sapiens
ccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttccttttttt

SEQ ID NO: 6716 - DNA, 343 bp, Homo sapiens
aaagccattggatgtgccacaatgatgacagtttatttgctactcttgagtgctagaatgatgaggatcttaaccaccattatcttaactgaggcatccaaaatggtgagttggggaacatagagagtacacctaagttcacatgaagttgtttcttcccaggtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcatacctttt

SEQ ID NO: 6717 - DNA, 66 bp, Homo sapiens
  misc_feature (1)...(66): n = g, a, c or t
ctgtagcttctnnnggacttccactgctcaggcgtnaggctcanatagctgctggccgcgtacttg

SEQ ID NO: 6718 - DNA, 199 bp, Homo sapiens; identical to SEQ ID NO: 53
  misc_feature (1)...(199): n = g, a, c or t

SEQ ID NO: 6719 - DNA, 513 bp, Homo sapiens
  misc_feature (1)...(513): n = g, a, c or t
gagggaaggaaattantgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagacctgcccgggcggccgcccgggcaggtaaatcaattcaaaatatctcttaaatgcctttgtaaaatcagctctatacta

SEQ ID NO: 6720 - DNA, 373 bp, Homo sapiens
  misc_feature (1)...(373): n = g, a, c or t
gcctggatgcacctggaatatgccancannacctgctccacctggtgtgcgctcttaggttcctggaatatcttcttcctggcagccanacggnccagcangccacccttctcccantgggcatggacctggcgcaggtactcgtaggaggggaagaaacagaccacccctccaggaaccacaccgcacaggttacaganaatgcgacccacctngtncatcatctgangcanctctnttttctggaacgtgaattccagcggctggttgganatcccgctgcagatgacgaggggcaggatgttgtctggagggatcacntgaccacaggaaaactccaccacgcgctcagnttncaccccggcacaggcca

SEQ ID NO: 6721 - DNA, 407 bp, Homo sapiens
cctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgtcccccggctcctgcaggactcccagaaaaaaatcatcagcaacctgtttctgggccgcgcaggcagtgccacggtgctctctggctccatcgcgggcctggagggcggctcgcag

SEQ ID NO: 6722 - DNA, 292 bp, Homo sapiens
ggaagcagcactggtggtgcctcagccatggcctggaccgttctcctcctcggcctcctctctcactgcacagactctgtgacctcctatgtgttgactcagacaccctcagtgtcagtggccccaggaaagacggccaagattacctgtgggggaaacaatattgggagtaacaatgtacactggtattaccagaagccaggccaggcccctgtcctaatcatctcttttgataacgaccggccctcagggatatctgagcgattctctggcttcaattctggggacatgg

SEQ ID NO: 6723 - DNA, 575 bp, Homo sapiens
  misc_feature (1)...(575): n = g, a, c or t
aaatattgcgtgactggggcttttctcttcagcaaggtcacaggcacagagcaggtcggaatcgattgagatgggtttctgcttaatccaaaacttagtgctggctttctgattcgtaacagggtctatctctactttgtctccagagatacctagctgtacgtcggttgtgaatcgcggtctgtggatcatgctgactttgaatgacttgtaatgatggctgctaagcatatcctgtactgtggctatgtcaatttgcgaatcctcctcaaaaaccccgtctgcccttgaacctgaaactttctgggatccttttcctcgcttcactgccttcagtaagatttccttcatggtaacctttgtgttgtccacctgaataagggagaatccatgagcagcatttattcgaacaaagagtgactctttggatgtcagaccaggagatgagtacttttcaaccagggccaaagtactgaagccaaacttatgaatgggctcattggaatccagcggggggaaatcggtgtccacctccccatcatnctcagcantatgcaggcagtaggcactgacat

SEQ ID NO: 6724 - DNA, 315 bp, Homo sapiens
ctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcag

SEQ ID NO: 6725 - DNA, 461 bp, Homo sapiens
ctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggagcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcag

SEQ ID NO: 6726 - DNA, 146 bp, Homo sapiens
ccatgattacccccggcaccttccatttttcctaaaaaaaaatgattacagtagttgtccaaaaatgaaggagctctgttgtcccatgggtaagtctatggcacacaatgtaaaaaatgatctagacacagtgatttaaggatttt

SEQ ID NO: 6727 - DNA, 406 bp, Homo sapiens
ccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccag

SEQ ID NO: 6728 - DNA, 111 bp, Homo sapiens
  misc_feature (1)...(111): n = g, a, c or t
ccaggctggtctcnaactcctgacctcgggtgatccacccgcctcagcctcccaaagtgctgggattacagacatgagccactgcgcccggcctcttaattaccttttttt

SEQ ID NO: 6729 - DNA, 285 bp, Homo sapiens
aaaaggcaaacactcccaaacagacaaacagtaaacatgcagaaaacagactggagtagaaatcaacaaattagcaattacattatacctgaggtgctggaggatgctgtggcattccctggggacttgtctgggcataataggctgcttgttgtctataatactcagcccaggctgcactataatctggctgaccacctggaggagccccagtcggagcagggactgcctgacccattttcttgtagtactcttcccaagccttggtataatcaacctgtccag

SEQ ID NO: 6730 - DNA, 517 bp, Homo sapiens
  misc_feature (1)...(517): n = g, a, c or t
cctcggatgatgaagacagtgcccaccacaatgcccacgaggcccacagacaaccccagggcgcagaccacagtctctgtgagctctgacataggggctggaatctcaggctcccagtgtttcagaagaggcttgtccagtccccagtgctccaccttgcagtcataactctcctcagcagaagggaggagggtgaggtaactgatcttgaagaaggaatgatcactcttggagaggaagctggtctcagaaacaccttctgtgactgagtgcccattgctcagccatgtgatgttgaccacaggaggaaagatgttgtccacaagacagatgaggatgttgggctgacccagtgtcacgggagacttggaaaacactgtgacctcaggaacctcattggtagcagcggtagagttggagcgtttaatcagactgttcaagttatgttttangacagcgatgtttgtcagngcaaattgcgggtnaatctaaattgnctgagaacaggcaaacacca

SEQ ID NO: 6731 - DNA, 434 bp, Homo sapiens
ccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtttggatttgaaggctgccctgcccccgactctcctgccgcacccctgg

SEQ ID NO: 6732 - DNA, 513 bp, Homo sapiens
ctggtggccctgaagaagatcagactggatttgtgagtgctgggacggcccctgagttacccaccctgggccatcacaacctgggcgctccctgatccgttccctctttcctggagtccacgtttaactcctctgggtgctgcccagcagcccttacctgtcctctccccagttcactgccttctgaccagcctttgccggggccctgactgtggagtttggtggatgacgtgccaaggagcacaggtctccattgccggggccctggtcattctgtggggttaaggagaagccgatccccctggctggaagtgcccttcttggcccaagtctctgcccacggctgtgcccttgtttcttgcagggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaaga

SEQ ID NO: 6733 - DNA, 378 bp, Homo sapiens
ccagtcaggacacagcatggacatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 6734 - DNA, 294 bp, Homo sapiens
  misc_feature (1)...(294): n = g, a, c or t
ccgggcaggttgggggtaaatcaggggtgctgctattcccccagctacctggaccagccctgccttgagaccgtcaaccgcatcaagttgtacagtgagtccctggcccggtatggcaagagcccatatttatacccgctctacggcttgggcgagctgccccanggttttgcaagattgagtgccatctatggggggacatatatgctgaacaaacctgtggatgacatnatcatggagaacggcaaggtggtgggcgtgaagtctgagggagaggtggcccgctgcaagcag

SEQ ID NO: 6735 - DNA, 580 bp, Homo sapiens
  misc_feature (1)...(580): n = g, a, c or t
ccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagacctgcccgagcggccgcccgggcaggtccaaagatggctcagaacagatctcacagaaacggtctgagtgtccgtggttaggtatcaggattagtgagagcccagaaccaggtcaaaggactttcacaacattaagttctgtcaactgcccttttataagtactctgaatactgaaggctgttcaagcaatttggnaaattggnaacgatgattatgtttcagaaccccagcaagaaccttgcccatatgcttgtg

SEQ ID NO: 6736 - DNA, 443 bp, Homo sapiens; identical to SEQ ID NO: 541

SEQ ID NO: 6737 - DNA, 177 bp, Homo sapiens
ccaaggaccacctgggctcccaaggagtggagggaggagggattcagttccacaggaaataaatgggaacagcccggtggagaagacaatgacaactgcaggacaacacctcaaccactccagaaaacagcccttgctcctccttctggccttttcatatttccaagttactgtttt

SEQ ID NO: 6738 - DNA, 260 bp, Homo sapiens
aaaatccattttattttcaatctgtaccactggggataatgtacttcataattctaccatagtatgtgtggagttttacagtgaggcttcagttttattaaaattctctgttgtggcttctatgctgttaataatttctgatttttcttctacctttgttattaatattaatattactaatattataaacacagcttaaagagttgtgggtctttttttcaaatttatggtcctttattttaatgtattttttacctgcc

SEQ ID NO: 6739 - DNA, 223 bp, Homo sapiens
cctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacacgggccgctcagacacccag

SEQ ID NO: 6740 - DNA, 363 bp, Homo sapiens
ctggtgtgggtgagtgtcctcggggctggtgaggggacagcagcttcagtggaaacccttccctatgtgtggccgagggcctagaacacgtctgagcgggtcaggtgggttcttcccactggagggcgtggcctcaggctgagagtgaagacggggaaggggaggaagagaacagctcgggctcctgagaccaggagccagacctggtaagtacatgaccttaggggctgggcctttgcctgtaatcccaacgctttggaggcccaggcaggaggatcggatcacttgaagccatgagttaaaaccagcctgggcaacaaagcaagaccctggtctccaccaaaaataagtaattaatttttt

SEQ ID NO: 6741 - DNA, 316 bp, Homo sapiens
aaaatctccaatttatgatttcccttggaaaacaggaagttctggtaacactgagactgcattcgagggtcccacaaaccagacttggtttctcacttcccgtaacagtaacgaatggaagacttgatgatttacattacctgcctggcccctgtagcaacttgagttcaaaactgttggacagggtcatgattccttaacatggtattcaaagcttcatgattggctgggtgcggtggctcacagttgtaatcccaccactttgggaggccgagatgggtggaccacttgaggtccaggttcaagaccagcctgg

SEQ ID NO: 6742 - DNA, 520 bp, Homo sapiens
ctgtggcttcccggcatgccctgtgaccccaagccgcagggtacaggaaagaagtttgtgctgggggactcaaagacccagaggttaattaacaggaaccagggccaggggccttcatctagaggtcagtggagtctccagggcactcatcactgtggctgggagactacagtgtctcggctgcggacttgtggaagaagagggggaaggatgggagaaggggtgactggatgccagccaggaatcctggccttagccctatcctggcctcgcctaatcagccatgtcgttattcttacacctttcttcttgggagacccaacattattctgagatgccatgagactgtttagcttttcttcatggccccagggagtgaggctgagggcagtcacttcccctccaatgccctcgactgcccagtaaaagaatggcgggacccaaggaggaaagagtggggggcagacaacgcttgggggatcagtccactttctctacattcaaactgcagaccaaatag

SEQ ID NO: 6743 - DNA, 605 bp, Homo sapiens
aaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccgggaatatggatctactggaacagcccatgctgatagtgaatatgaaagaagaatgatgtctgtatataatcatgtcttggaggagcacacagcatgcctctgcaatgccatcattgctttgctgaaaagttcccctttctttccagagatattttttccagaaactacagtctaccagcatcaagcttgctctgtca

SEQ ID NO: 6744 - DNA, 402 bp, Homo sapiens; identical to SEQ ID NO: 3672

SEQ ID NO: 6745 - DNA, 243 bp, Homo sapiens; identical to SEQ ID NO: 622

SEQ ID NO: 6746 - DNA, 204 bp, Homo sapiens
  misc_feature (1)...(204): n = g, a, c or t
cctgggatgcacgnagaaaggctgaccacaagttgagacaagatacagaaacaaacaaaaacagcagaaagtccgatcgatggtgtaagtgttgtgttcactgcttanngtgcaggtgagcttgatcgaggctcccagtaaggcagatgtagannggggctgagtcancacaggcagagcacagnnacctgtggagaaaatgaa

SEQ ID NO: 6747 - DNA, 422 bp, Homo sapiens
ccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtct

SEQ ID NO: 6748 - DNA, 273 bp, Homo sapiens
  misc_feature (1)...(273): n = g, a, c or t
ctgcagattanatcacattccacagaatctctaagatggtaccaaggcatgccaggaatttcagaaagctttacatctaaatagcttctcgaacattttcgcaaccaaaacacatcggcttcagttgttatctgagaatatcaagaagctgctggccgaaaatgcaaatgtgagctgggtgtggaccatgcttcctctgggctctggggctgtcacacaacgtggggctcaagacagatttggggccatgtgggagaatttcctggggactgg

SEQ ID NO: 6749 - DNA, 263 bp, Homo sapiens
ccaaggctgctcaaagccctggacacctcacgtttatatcaacagagcagttgctagaggaagcagcctcccgccctccagaggggtgtctggtgcccgagccctgttgtttgtgtaccttgtctcagtagtgtccagaggggctcatgcagcatcgcctcatggactaagaggtgacctcacctggtgcaggggactgtgcccggggcactcctccagtggctccccttcctgcccacccctgaggaggcagccctaggtag

SEQ ID NO: 6750 - DNA, 373 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtggccgagggggcagccttgggctgacctaggacggccagtttggtccctccgccgaagacgacatggtcattattacgatcccacacttgacagtaatagtcggcctcatcgccggcttcgaccctgttgatggtcagggtgg

SEQ ID NO: 6751 - DNA, 255 bp, Homo sapiens
aaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaagg

SEQ ID NO: 6752 - DNA, 350 bp, Homo sapiens
ctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtggctaatctttgattctatgtttttgatcctcctggcactccagacctgggtgatatgcaggagagcacactgatagaaatccttgtgtccagtgcccagcaactcctgcctcagcctcccgagcagacctgcccgggcggccgctcaagccctatagtgagtcgtattaga

SEQ ID NO: 6753 - DNA, 342 bp, Homo sapiens
  misc_feature (1)...(342): n = g, a, c or t
aaaaatggagcacanngacnagaatattcaattctggatggcatgtgaaacctataagaaaattgcctcacggtggagcagaatttctagggcaaagaagctttataagatttacatnnagccacagtcccctagagagattaacattgacagttcgacaagagagactatcatcaggaacattcaggaacccactgaaacatgttttgaagaagctcanaaaatagtctatatgcatatggaaagggattcctaccccagatttctaaagtcagaaatgtaccaaaaacttttgaaaactatgcagtccaacaacagtttctgactacaactcaaaagttt

SEQ ID NO: 6754 - DNA, 206 bp, Homo sapiens
aaaaagttgttaggtcattatttgtcggggagggaatgacagaggcgactccttctctcaacactggctaaaaacaagacaggcaaaatacaatacaatattctggttgggatcctggaacagaaaatgaatgttagcagaaaaactggtaaaatattaataaagcgtgtagttcaattaatagtattataccaatgttaatttcc

SEQ ID NO: 6755 - DNA, 338 bp, Homo sapiens
  misc_feature (1)...(338): n = g, a, c or t
cccggagatctgttgctagacgactgttttccaactccagttgttctgtttggcctttgcactcctctaactgggcagagacttgttccagcaccctagaaacctcctgcttttcctcaattgccacatcacgttcctgcagggcttgctggctcttgactgtgagtttctctgtgagttgtcgggaccgactcagcaaagctgtccatgttgtataatccanttgcatggacctccagtcttgttgcaaggtnnaagtaagactcactgtctgctgaaccagctcttcntgcttggcatgaagccctaccagttgggtctgggcatccttcagaagg

SEQ ID NO: 6756 - DNA, 118 bp, Homo sapiens
gtgaatggagcagttctgagaaccacccttttgctaagggagcttgggagccacatggctgctcccttcacactgggtaacagtgtagtatcctgtgagagaataaatgtattcattt

SEQ ID NO: 6757 - DNA, 265 bp, Homo sapiens
aaaatccagaatgcacaaagtactgcacaatttgatcactaaatcattagttgataagcgaacctcacacaacagcttcatgtcagccaaggccacaaacaccgtgtaccacacatgtgaacggacagattgacatgttaaaaacacaacatcagtgcatgttggggattcctggtgccagaaacaggggtgacgggagggcagaactagtccttagcagcttcctcctcctttattttagctgaggcactctctcgggctttgg

SEQ ID NO: 6758 - DNA, 408 bp, Homo sapiens
cctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaaca

SEQ ID NO: 6759 - DNA, 272 bp, Homo sapiens
ctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagagg

SEQ ID NO: 6760 - DNA, 244 bp, Homo sapiens
  misc_feature (1)...(244): n = g, a, c or t
aaatctcacaaaattgntttgataaacatactcttataattcttgcaacaccttgggaaatagttggttctatattactgttttatagctgaggagaaagactcacatcatttactaagatcatatagctagctagtaaatgtttgagtgaaaatacaaacaaaggttttctgactttaagagctagagttttttccactataccatattgcatctgttgtaattgttaactaatgtgcatttt

SEQ ID NO: 6761 - DNA, 200 bp, Homo sapiens
gggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcag

SEQ ID NO: 6762 - DNA, 93 bp, Homo sapiens; identical to SEQ ID NO: 55
  misc_feature (1)...(93): n = g, a, c or t

SEQ ID NO: 6763 - DNA, 493 bp, Homo sapiens
aaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtat

SEQ ID NO: 6764 - DNA, 229 bp, Homo sapiens
  misc_feature (1)...(229): n = g, a, c or t
gccaccctgaccaccaacagggtcnaagccggcgatgaggccgactattactgtcaagtgtgggatcgnaataatgaccatgtcgtnttcggcggagggaccaaactggccgtcctaggtcagcccaaggctgccccctcgnncactctgttcccgccctcctctgaggagcttcaagccaacaaggccacactggtgtgtctcataagtgacttctacccgggagccg

SEQ ID NO: 6765 - DNA, 372 bp, Homo sapiens
  misc_feature (1)...(372): n = g, a, c or t
aaattttctggnncatgagaagaaatgtggattgctaattcaaaaagaatatatgaaaatcatatatatatactcaatttttatttacccttagagacaatgattattcattagatttttatccacaggaaatcttgtaatattttaagttttaggataatctattctcagttgctttattaacatttcagctttcctttattttaattcatttatcattttagtcattagaatgaatgcctgttatatggtagatactgtcataggcacaaaaatgaataagacacggtccctatccatcatcaaggagcttataatctgaaaaggggggtggtggcagacacataagaaactagttacaataaaaggcag

SEQ ID NO: 6766 - DNA, 79 bp, Homo sapiens; identical to SEQ ID NO: 54
  misc_feature (1)...(79): n = g, a, c or t

SEQ ID NO: 6767 - DNA, 334 bp, Homo sapiens
  misc_feature (1)...(334): n = g, a, c or t
aaaatgatgtaaagatgtaataaaattccttttcattgtaaaatagtaattaagtcaatttacacagacctttgtatttaatatgtctccctatttgtatagaatttcagatgggtctanatgagaaccctatgcataagcttggatcttgatgaaaggttaccaggatcangatcaaaaattgggaaatactaagctcttgaagatatttttctgatataattagattgaaaagagcaattttgaaaatgctgtgtttctccannaagtacagggngcattatttgacatcaattacttaaagaagttatgagttgttccccanacagatttt

SEQ ID NO: 6768 - DNA, 260 bp, Homo sapiens
aaaccaaaatatgtccaactgcaaagcatgtaagtaacaattttagagggtatacggaggtgaccctaagtaacaaggaatcacatatagtgagcaagcaatttgcttttcagtttttggtcaatccttatgattatttagaggagaaagctcagtttggtgctggtatatcttatgtttatcacccgacagttgttaatctctttttaacaaagaatacaggccaaggccctgtgactttagctggctttggtatttgg

SEQ ID NO: 6769 - DNA, 527 bp, Homo sapiens
ctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagccttgtgatgaataaaagctttaactgctatttcagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcga

SEQ ID NO: 6770 - DNA, 232 bp, Homo sapiens; identical to SEQ ID NO: 57

SEQ ID NO: 6771 - DNA, 182 bp, Homo sapiens; identical to SEQ ID NO: 4551

SEQ ID NO: 6772 - DNA, 191 bp, Homo sapiens; identical to SEQ ID NO: 58
  misc_feature (1)...(191): n = g, a, c or t

SEQ ID NO: 6773 - DNA, 346 bp, Homo sapiens
ctgagtgagttccctgggagggctctcttcctggcttggagacggcctccttcttgctgtggccttacacggtggagataaagaactctggtctctcttccactttcttacaagggcactaatcccatcatggaggccccatcctcatgacctcatctaaaccaattacctcccagaggctttacctccaaataccgtcacattgggagtgacagcttcaacatgaatttggggaagacaaaaatattcagttcataagagaggcttacacaatagtctaatcaaatgacagtattgagcaggggcagtgggagcagagagaaagggacagactcaaagacatttt

SEQ ID NO: 6774 - DNA, 545 bp, Homo sapiens
ctgtgttcttaggggttctgagggccatgcagctctgttgcaccatgattctgtcttctctcttgcccactgcctgaaggaaatttggagtgggctgggcccagagctcccctgtatagcaggccctgtcctggagggcctggcagggacatggcttagcctgttggcccctagtcccgagacctcataggccacaggggtccactgtggcttgtttgggcctggggtggggctcatggagtggtgggtgttggactgagactctgaccagggacagggggatggggtcacagccaagccactccacccctaccccatgcacacagcactcagagcccagaccctctcctaagagcccccaccaaaatcctctctaggggcaggggatagagcaagacatgtcccccacccagagcaggggctgcggtcagggagctcaggggactcagccactccatggcagagccctgtttaatacaacttgtgtctgggatggcctggatcagagaccctatctaaggagcatgttcagaaaccatgttgct

SEQ ID NO: 6775 - DNA, 517 bp, Homo sapiens
ctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagtgggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggtt

SEQ ID NO: 6776 - DNA, 426 bp, Homo sapiens; identical to SEQ ID NO: 56
  misc_feature (1)...(426): n = g, a, c or t

SEQ ID NO: 6777 - DNA, 526 bp, Homo sapiens
ggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataat

SEQ ID NO: 6778 - DNA, 638 bp, Homo sapiens
ctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttctttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctgggaaaaagaaaactatccgaggaaagaaatatgattcagactctgatgatgattagagctca

SEQ ID NO: 6779 - DNA, 410 bp, Homo sapiens; identical to SEQ ID NO: 60

SEQ ID NO: 6780 - DNA, 332 bp, Homo sapiens
cctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcag

SEQ ID NO: 6781 - DNA, 385 bp, Homo sapiens
ctggcttccgagaggcaattctgtccttggaagccaggtttgaccatctgtaatcagccttgtgagaagtctcgtttgagggggccagggatggaacgggagggcgcatatcgtatgaggtatgggcattgtgttaagctgggggaagttgcagcttgtcctgaattacatggagaggaataaagtgggtgagtaggaggagccatttcatctgaaagcctgaggcccctctggtcccctcgataaaccccactggtgtcccaggccacaggtaacaggagaatagacatttaatgtcacagaatgtcagagcaggcaaggccttcagtgatcactctttctaggcttaggacgggttggggttagaaagggtgatcactgaagg

SEQ ID NO: 6782 - DNA, 482 bp, Homo sapiens
ccacaagatatgttctagagacgtccatgagtcctcttgctgtgtgggagcggcatccacagacttctggaataattggcctgtgaggaagctcatcaaagctgcaaacagtacaatgaatgcaatagagagccagagggccttattagcctttctgatggaggacttgagatttgttgcccaggaagctattgtgtcataaactgaagagacatcccactttgatggattatttttcttttcagaaagacttggcttccttgtcctttctactgtttcttctccagatggctctgagtcatctttagttctgtaaataaatgttgtttttaatatttgaaactaaggataatatgctataattattcataaaatattgctgaatcttactgtaactcaagaggctcacaaatatttgttctgttttagggaaagttgataaatatctaactctaaaaatcaaatcaccagatttataattt

SEQ ID NO: 6783 - DNA, 309 bp, Homo sapiens
ccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagacttt

SEQ ID NO: 6784 - DNA, 254 bp, Homo sapiens
  misc_feature (1)...(254): n = g, a, c or t
aaatgaatttggggaaggaagtgcgctggagaaatccttanctgtcagccaaggtggagagctctatgaagagtggctggaacttagaaacggttgcctctgctgttcagtgaagtgaggaatgtgtttactgtgtacatggtttactagaaatgtttattgattatatttccagctttaattntcttgagtaatttaactgaatttacacagtttgcttcattgtattttcaaacaaatagaaaataaactta

SEQ ID NO: 6785 - DNA, 259 bp, Homo sapiens; identical to SEQ ID NO: 59
  misc_feature (1)...(259): n = g, a, c or t

SEQ ID NO: 6786 - DNA, 415 bp, Homo sapiens
  misc_feature (1)...(415): n = g, a, c or t
cctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagttttgcacaaggagaagaaaaagcaggaggaggaggtgtccacgttacgcaaggatgtcaccgccctaaagatcatgaaagtgaactatgagcagattgtgaaggcacaccaggacaaccccatgaaggggaggaccaggtntctgaccaggtcaagttcaacgtgtttcaaggcatcatggattccctgttccagtccttcaatgcctccatctcagtgg

SEQ ID NO: 6787 - DNA, 327 bp, Homo sapiens
ctgacatctggagttcatagcaccataaaggttattaaggccaaaaaaaaacatagagaagtaaaaaggaccaattcaagccaactggtctaagcagcatttaattgaagaatatgtgatacagcctcttcaatcagattatctaggggaagctccagcttctcatctgcttgatttgagtcccatggagaagctctgatatgtggtaaggtggaaaaatatgacacggtgcgatcaaggcattagaggatgaagctattgaagtgaaaacaaaattgaagaggcaaattcttttgagcagagggtaatttttttcttatttcattt

SEQ ID NO: 6788 - DNA, 132 bp, Homo sapiens
  misc_feature (1)...(132): n = g, a, c or t
gtgagtccaaactccagagaaagntgtgtgtgtgtgtgtgtgtgtgtgtgtgtgtgtgtgtgtgtgtgtttgtgtgaggtctgggggcttccccccanatgggtgtgagtgcatggtcctactgtacacaca

SEQ ID NO: 6789 - DNA, 342 bp, Homo sapiens; identical to SEQ ID NO: 306

SEQ ID NO: 6790 - DNA, 269 bp, Homo sapiens
ccactcctggaaacccactgatagatgagtttcccccattcttctggcctccgccacatgatcaggaagctggacttgctcttatccaaccactcgaggttccctttcttcctcagttcctctaatacaatctggatcgactccacaggaagctttcgctgtagcttgacgttgttgaagagcgggctctcctgagcttccatcaccgtcatgctggactgtttgtgcaggcggcagaaggacaggaccagcgagcaccaggcggccag

SEQ ID NO: 6791 - DNA, 361 bp, Homo sapiens; identical to SEQ ID NO: 61
  misc_feature (1)...(361): n = g, a, c or t

SEQ ID NO: 6792 - DNA, 298 bp, Homo sapiens
aaatgactgtgctgcccctttcacatcaaagaactactgacaacgaagtccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagttt

SEQ ID NO: 6793 - DNA, 262 bp, Homo sapiens
aaaggtatgtctcagtctggatttgaaacctcttagtatcaacaggaagaaacgttttgtatctattacaatgaggaaatctttttcaaaagatatttgggacaaagtacttccatccattcctgctctccaagctttcaagccctccccaggggttaaataggaaatgtatgtttgctggcctcctcaccgtccaacgtgacatttttttggtaccatctattctgctgtaatagaactaaatcatccatcgatgtcccag

SEQ ID NO: 6794 - DNA, 345 bp, Homo sapiens
cgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 6795 - DNA, 341 bp, Homo sapiens
ccacagctaacatcattgcagcacctttactccttcggctttttgccagcaccaacattggccccttccaggatagaccctcaagagcccactcactctaaaccactagccccaatggagctggagccaatgtacagcaatgtaaatcctggagatagcaacccgatttattcccagatctggagcatccagcatacaaaagaaaactcaggtaagatgcctttcaggcaaatagaggtgaggtggcagtgttttattgaaacgggcaaggggtctttgatcagagttatttcaaatacaagcccaacacgcaaggcattacttgcctcccatagtgtcag

SEQ ID NO: 6796 - DNA, 244 bp, Homo sapiens
aaagggaaaagtaaatttaacagttgcctttttttttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcag

SEQ ID NO: 6797 - DNA, 437 bp, Homo sapiens
ctgtctcaaaacaaacaagcaaaaatacaaagaaaaatctggttatcaactgaaggctttcagcagaagcagcaccaccattatgtgttttgttttgttccctgacatatcccagattagaatagtaccttacacaggtgatcaataaatgttaaacagatgacagcacttaatagcatgggctctgacaagcagttagcactcaataaacacttattgtgtaatggtttgttttgttcacggacgtatatgaagcactagaacagtggctgctaacagagtagggctgaataaatatttgttaaacaggtgaaaacaattagtaaaaaaggacctagcacaaaatgagctctcaatacttatgtaatactttgctgagtgtctagaattatgtctgtcatatagtaggtggtcaatatacctaacttgttaaacag

SEQ ID NO: 6798 - DNA, 371 bp, Homo sapiens
ccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagaccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccagg

SEQ ID NO: 6799 - DNA, 216 bp, Homo sapiens
aaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgttt

SEQ ID NO: 6800 - DNA, 368 bp, Homo sapiens; identical to SEQ ID NO: 62
  misc_feature (1)...(368): n = g, a, c or t

SEQ ID NO: 6801 - DNA, 383 bp, Homo sapiens; identical to SEQ ID NO: 63
  misc_feature (1)...(383): n = g, a, c or t

SEQ ID NO: 6802 - DNA, 389 bp, Homo sapiens
ctgctgttgtgaacttcattctgccttttctttctaattctctgggtccagatctgtttacaccacctcctggtacaacacccctaagagctgactttggcagttgtgtatctctgttactggggcttgaattaaacatcttagtgaacaaactttagctttactcttcaatactgaaaaaaaaaatgttatgcccatggttaaaccagtatcctactcaatccttctgtgatgttactcacaaaatgaattgcataaaatcggatacctgagattgttttggctgggaggatccttgaattataaagattaaattagattaatcaggaatgacctctgttactccttatggggacattcaacttctgactgaactttttttttccttt

SEQ ID NO: 6803 - DNA, 547 bp, Homo sapiens
ccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttg

SEQ ID NO: 6804 - DNA, 309 bp, Homo sapiens
cagcaaggaacacaaaggcatctgccacctgagcaagtatcgaacaccatcacctgcatccttcaagggttccaggtagatctccagcctcttgtaggagagaaccaagttgaaaaggtcaaacgctggggacttggtaggaaaaggtggagactccaggggagcctcgggcatcacgctggggctcagctccggcccactcccctcacgttctgatgtctgcatcccggccgctggctccgtgagggaggcggcagggtcgggcaggagcaggggtagagccactgggccccggagcgtttcttcagg

SEQ ID NO: 6805 - DNA, 435 bp, Homo sapiens
ctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcgcacagtggaaggtaatgacgaaagatgggcagtggtttacagactgggacgctgttcctcacagcagacacacccagatccgacctaccatgttccctctgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacag

SEQ ID NO: 6806 - DNA, 227 bp, Homo sapiens
ctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacag

SEQ ID NO: 6807 - DNA, 347 bp, Homo sapiens
aaaaagcattcagattaagagattgaaaagagcgaggcatctaaggctggggggtggggaaggaaaagctgtggagcactacccctcccccaggccacaaaagtcaagggatgtctcttccactggtagcctcaccacacagcttactgaaatcaacaatgttaaatatttagcttcacaaactctgtaaaaatgagttgttgtgacctacaaaaaaggtatatacatattttacataatacaatatcttaaaggtcatatttacaaaaaaatctattcacagaaacactgcgagattctgattcagaatgcagtacctggccttgggttttcagaagtttattttt

SEQ ID NO: 6808 - DNA, 299 bp, Homo sapiens
tccacctcggagagctgggccaggcgcggggccctgaggctcacgtccatctcgtccccgatgcaggccagccgcagggccaatgcgtcactgccctccatgcattccaaagaatcgaagtcctccatagggtccaggtcctcttcagagtcagtcatgccaagaacctccatggtcgggggttccaggagctgctcatacaggagggtctccatcaagatgtctctggagaggggtcttacttcagacatttctcctctggcggcggcgatgctggcagcgtctgtaagccacccggg

SEQ ID NO: 6809 - DNA, 306 bp, Homo sapiens
  misc_feature (1)...(306): n = g, a, c or t
cgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaanaaacagattctgcgcttgatttggggaatattcgagcagaaccttt

SEQ ID NO: 6810 - DNA, 226 bp, Homo sapiens
ccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagagg

SEQ ID NO: 6811 - DNA, 456 bp, Homo sapiens
aaaatcccagtttcagggaacaggactcaggtgggagccacgcctaaaagccttccacagagagagtgtggttaagcgcataggcgtcgctatcctcttcctccaaaagcagcttgtcgatggtcaacgagctggcggctcttctggggtcttccatgtcctgaaggactggctctgggatagagatggggagctggacaaactggggcccaggtagggctggggccggaggctggtactgcagggtggaggtgggtagtgtggaaaggggctgaggccacgggaaataggtgaggggtgcctggtgctctgggccctccagcgggggccccactgcgggcgtggcggagcttcctgtcgtgacattggtgatgagtggcggagaggcataggtcaacactgaggagggccccaccaccgtgtagccggggcacacgggctgcacatacatgtcag

SEQ ID NO: 6812 - DNA, 301 bp, Homo sapiens
ccagaaccttggcctggtccacagcgtcgagcaggttcttggcgtccacagccagggtgtgtgaagccgtcagcatctgcctcttgcactcctcactcagggaggtcacggcgttctgctgcgccagccgcatcttgttgatgagctctgccaggtctttgttgagcagtttctgggtgccctcgatctctgtccgtgaagatgacggcaaggaaggcaggagatcatccacgctcccgatgagcttccgcagggtcagccccacattcttcaccaccaccacgtagccctcggggggcag

SEQ ID NO: 6813 - DNA, 443 bp, Homo sapiens
ccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaagg

SEQ ID NO: 6814 - DNA, 448 bp, Homo sapiens
ccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccag

SEQ ID NO: 6815 - DNA, 545 bp, Homo sapiens; identical to SEQ ID NO: 307

SEQ ID NO: 6816 - DNA, 393 bp, Homo sapiens
ctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcag

SEQ ID NO: 6817 - DNA, 332 bp, Homo sapiens
ctgctcacctcactggtctaaacactcatgggctaaccttgtcctagtccatgatttcagtggtgtttggaaaagatgatttttctaactcagtcactcattcacatttatgggccgacattcctttttgttgttgtttttttgagacagagtctcattctgtcacccaggctggagtgcaatggtgcgatctcggctcactgcaacctctgccttctgagttcaagcaattctcctgcctcagcctcccaagtagctgggattacaggcgtgtgccaccacacccatctaaagtttgtatttttagtagagatggggtttcgccatgttgg

SEQ ID NO: 6818 - DNA, 244 bp, Homo sapiens
ccagaaacatttggacaactgtgtctcaaaaacagtgtgttctcgtttcgcttctgtgcctcagtctttaagatacaaaactatctcaggacaccacatcctgggcccagcctgcagagtggtcacttttctgccactgccctcaatatgagggagcactgaaaggctcttgacttagaaccccttcccctttctgtctaaagccgaggagccatctgtggttgcgagcacgcagcacaccagg

SEQ ID NO: 6819 - DNA, 429 bp, Homo sapiens
ccaggtggctcatgcagtcaccggagctttgcttcaggacatgtgtgctacaagtccaggctggacaaccccaagaactgtgagggttcagcaagcggggtgggtccactgagctctcaacacaagcttccgggacccagaccctcatctggaaaccacacaggccagccctgcgatgctctgtgtagcagggagcaagggtcacaccacagccacatctgcttcattcgggggatccaacttggcatgtcttggtaaaggcattcatggtgctgcccaggacaccagcaagcactgaagtcctcacaagttacttcaggagtttaaccctgcacacgcccaacagaagggttttcaccagctctgagcctggacacttacaggcacactgtatgttcaagtcagttattctgtctccatctagaaagg

SEQ ID NO: 6820 - DNA, 103 bp, Homo sapiens
ccagggcgtgtaatgacttcagtattggcctcgtgttgttggtactcactatccgatccaggcagggaaatggtcagtgcgtgtgtgtcgggtggggtggggg

SEQ ID NO: 6821 - DNA, 302 bp, Homo sapiens
ggcccggcgatgtcgctcgtgctgctaagcctggccgcgctgtgcaggagcgtcgtaccccgagagccgaccgttcaatgtggctctgaaactgggccatctccagagtggatgctacaacatgatctaatcccgggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacag

SEQ ID NO: 6822 - DNA, 571 bp, Homo sapiens; identical to SEQ ID NO: 625

SEQ ID NO: 6823 - DNA, 277 bp, Homo sapiens
gcttgaaggaatttcacttccttgggtgctggtaccttattcacagcagatggtcatgcttagaaaaccctgcttcagggtcagtgactgaaaaaccaggggtgccatgccagtgcctttgtcagggctgttttctgcttaaccactttctcagaataatgcagaagaaacccagtccgctaccttttgagtgtgtgggaaataagaacggggtgggagaggagatgggagatgcaggtcgaaggacaaaaaggagcagatgagcaggatgaacagg

SEQ ID NO: 6824 - DNA, 287 bp, Homo sapiens
cctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagccgttcccgcctagccagggccatgtctta

SEQ ID NO: 6825 - DNA, 334 bp, Homo sapiens; identical to SEQ ID NO: 65
  misc_feature (1)...(334): n = g, a, c or t

SEQ ID NO: 6826 - DNA, 214 bp, Homo sapiens
ccacaccttgatgaaatcattttcctcctcgacctccaactggcatcactctggatctcaattttgatatttaccaccacaccaagtatgttccttcacatgtccatacctagttttctttttttctaaataataagtgatcctcccacttcagcctcctgagtagctaggactacaggtgcacaccaccatacccaactaattttttgttttt

SEQ ID NO: 6827 - DNA, 377 bp, Homo sapiens; identical to SEQ ID NO: 66
  misc_feature (1)...(377): n = g, a, c or t

SEQ ID NO: 6828 - DNA, 330 bp, Homo sapiens; identical to SEQ ID NO: 308

SEQ ID NO: 6829 - DNA, 373 bp, Homo sapiens; identical to SEQ ID NO: 6

SEQ ID NO: 6830 - DNA, 80 bp, Homo sapiens
aaacaagaatgaatcattactgtgtatgttagggtattaaaactgtttcaccagtacagtgaaagttgtttcaacatttt

SEQ ID NO: 6831 - DNA, 281 bp, Homo sapiens
cctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtgg

SEQ ID NO: 6832 - DNA, 159 bp, Homo sapiens
aaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttctttt

SEQ ID NO: 6833 - DNA, 465 bp, Homo sapiens
aaaggtggagcttttcaaaaagggaaactgggagcacttacagcccaggtctatgttactggtaagaagtggtttgtctcaggaataatgtaccctgtggagagtactttgtgtcagcctcactgagaacaaaaaaagcactcctttccccatgattaacactcatgtgtcaggaaagtacagtcaatgtatgctaaaaatccacttgaacaattagctcgcttttttccctcatttgctttcagagtaaatgtgctttcagagtattaggtcggcctaatacatgatacattttaagaaggggaggaaagcgcattgtataccctgatgctgggacccaatagaagacaggccccctggctggcctttggttctccctggagctgacaaagggaaggggcttggaaagcagccactgtccccgcctagtttgggcctttacagacacacctttccttttggcag

SEQ ID NO: 6834 - DNA, 536 bp, Homo sapiens
cctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataa

SEQ ID NO: 6835 - DNA, 553 bp, Homo sapiens
ctggagcagaaggcggcccgttcacttcagccagatccacttgtctcccacctcggtgttgtacccagggctgtacttgcggcccggcagctctctgaactgatgtaagacacggtcagtctgatgagctccaatggtgacttccgggagaaagataggaatgcttgtgtaattcagcacctcaaacttatcctgaaccagtaatcgcaggtggtataaagtgcgattgtcctgcttgagccacggccctttatcgaacttcaggtattcaatgtcctctaccaccttttttgaatcttgagcttcccttgcagaatattgtaaaacctcacatttttcactcatctcagggagaaaggttttcttataggcattctcaatgtcctgtagataggcagaggtgatcttcatttcatgtggctaaacagaagcagaaaaatcaaactgggaaacatttagagttcattctctttgacctgtgcgtatataaaatgcgaagacaatcactgaccaccaatttcttacaactcacaccgggcactgtggggactgc

SEQ ID NO: 6836 - DNA, 251 bp, Homo sapiens
aaatgaaatttgaaaaccaaatagtaagaaatggaaagagatagttgtaagaatccatttaccaattttacagctaaaaattaaagtgaagtagaaatagcaaaagataacagacaaatatattattttaggtcattaatttatagtgccttatcatcttaagttataaatagaataaggattttgttatataaaaactatcaaaaaagtatcagtgaaaagacatgacctccatgaaatgtgctgagtgg

SEQ ID NO: 6837 - DNA, 443 bp, Homo sapiens
  misc_feature (1)...(443): n = g, a, c or t
aaaaatatttttagtagagatgggttttcgccatgttggcacactggtctcgaactcctggtctcaagcaatccacccccctcagccttccaaagtgctgggattacaggtgtgagccacaacacccggccggctcttttttttttttttcttctttanagacagggtttcgtgctgttgcctaggctggagggcagtggtgcaatcatagctcaatagctcactgcagcctcaaccctctggctcaagtgatcctccctgctcagcctcccaagtagctgggactacaggggcgcaccatcacaataactaattttttatgttttgtagaaagggagtcccactatgttgcccaggctggtctcaaactcctggcctcaagtgcaccatcacacccgactaatctttgtatttttagtagagatggggtttcaccatgttgg

SEQ ID NO: 6838 - DNA, 289 bp, Homo sapiens; identical to SEQ ID NO: 4564

SEQ ID NO: 6839 - DNA, 300 bp, Homo sapiens
ccataaagatgattttgtcatcacaaaagaccatgatagtatcagttagttcataaccaaagagccatgtctgtaaggcagttgatttggcataaacaatttcttcatcaacacccactgatacaacaatggcatcaacgttggcatactcatcttctcctttccgccaattgctgtacagtctcttcactcgccgataataagcgtctttgtccagagtcacagccatagccccggacgccgcttctcctcgggttccgagaatcacgcgaggtcccggctcagccacccgctctcggc

SEQ ID NO: 6840 - DNA, 240 bp, Homo sapiens
aaatatgggaaggcaatgcagaactcttgggaattatcgagttctgataccccaaaagaatgaaatcaaacttctgttaatgggatgatgggtcgtggaatgggacaccttgggcacttgctaacaggaacataggaaaattggagttgaaacttcgcaggctctgtaacgaatgtggatgactgctacagaataaggctgacttcctgtaattatgatatttagtaacgcgatgtgttt

SEQ ID NO: 6841 - DNA, 51 bp, Homo sapiens
  misc_feature (1)...(51): n = g, a, c or t
gatcctgcgttaatctatgactatgccattgngctattcaagggtcaagga

SEQ ID NO: 6842 - DNA, 189 bp, Homo sapiens
ccaaataaccaaggtgaagaaaggtaaggggaagaaaaaaaaagaaaaaaaagggctgtatccaaacaaaaacaactcgagatcagagaattggtctatatttcattaagataaattgtttcaaatgaaacatttggtaattgagaatactactttaatatctgagctacttagggccctttccttttt

SEQ ID NO: 6843 - DNA, 463 bp, Homo sapiens
  misc_feature (1)...(463): n = g, a, c or t
ctgtgcgtggaccanntcagcttccggntgtgactggagcagggcttgccgtcttcttcagagtcactttgcangggttggtgaagctgctcccatccatgtacagctcccantctactgatgtttaaggatggtctcggtggttaggcccactanaataaactgagtccaatacctntacacagttatgtttaactgggctctctgacaccgggaggaaggtggcggggtttaggtgttgcaaacttcaatggttatgcggngatgttcacagagcaagctttggtatctagctagtctagcattcattagctaatggtgtcctttggtatttattaaaatcaccacancatanggggactttatgtttnggttttgtctaagagntannttatctgcttcttgtgctaacanggctgtngntgntagggcccnttatacctgggggccagcctttggaaat

SEQ ID NO: 6844 - DNA, 520 bp, Homo sapiens
cctggcagcactggagggcaggcagggaaagtagggtgggtaacccagcctggcaaatgcacggcagctagaaaacctcttcaggttctggggtggctgggccatgagaggggaggccaggcagggctgtcaaggtaaccggggtcagatcatggagttgcctgccaggctccacaggagtgggggacagaagcagagcaacccagctaccagccgggccctgagctccctcagggtgaccagggaggagctgtgactggctggggaggcagggctggggccgaggttccccaggacgacaggagggagccaaggcactctaagaggtggaagaagaggaccagaagctggtgagtgcatcactggagcccataggagggctcctgactgtcctcaaaagcctcagacctcagtgtccactttctccatccaagaaatggggctgtgatctctgcttatgacagcacaagcttgcacagaagtggaggcgggaaataagcacaagtgtgccttcccagcc

SEQ ID NO: 6845 - DNA, 418 bp, Homo sapiens
aaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcag

SEQ ID NO: 6846 - DNA, 479 bp, Homo sapiens
  misc_feature (1)...(479): n = g, a, c or t
ccttgcctcanatccanngtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcantaaatgggactttcccggcagagccaatgaaaggccctattgctatacaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccancagggatctatgcacccatctgtgtgactgtgtggtaccctctctggggaggcattatgtatattatttccggatcactcctg

SEQ ID NO: 6847 - DNA, 486 bp, Homo sapiens
  misc_feature (1)...(486): n = g, a, c or t
ctgtgctggccccgacacagctccagttccacccatgacatctggctgaggaggcttatgggagcggcttctcatgcacagttactgtccctctctggagggtcctttaatggggactgtgcaaagcagtgacactaactgccagtacactcacttttctgaggtgaaaataaaaaggtttattcaaggataaatgaactctggttaaattactacttcattttcattactacttcatatattagatttcagagtgtgtgagatggacagtgtattctggaaattttaatttaacacccatccacaaatacttatttcaaggaaggctaatcatcttcattaaattgnncactttttcgtgtagactttttctctccatgtttactaaaacagggagatccacgangcacatttttttaacctcgcaaaactcttaattctaacttaattactaaactctgccttcaaccaaattttcaatatctt

SEQ ID NO: 6848 - DNA, 223 bp, Homo sapiens
ccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcag

SEQ ID NO: 6849 - DNA, 249 bp, Homo sapiens
ccttcatgtgtatgtctggcaatcactttgacctacttagtaggtaacaaacatgatgccaccagctacagtgattatttaggcttatgtaacactataaatgaaaaggggagtagtagagcacccccattatctaaagcggggatcagcaaactttctctgtgaagagctagacagtaaaattttaggttttatgggccgcatagggtttgtgtctcatattattctgtgtcgttgtcataacccttt

SEQ ID NO: 6850 - DNA, 361 bp, Homo sapiens
aaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggcttt

SEQ ID NO: 6851 - DNA, 494 bp, Homo sapiens
ctgcaagaggctgacagaggccaccaccagaaattccttgaggtgagtttcaatgttcttgttgtagagcgtgaagagggcagcagacacctggatgatggctttggtcaagcaatgaatattgttgttgtaaccatccttctcaatgctataaaaggaagaagggtcagtggcaaggagtgggagggaaactgccagaaagatcaagagcaggcaggccaccttatattcctcctcaggagatgaagtatcagctttcagattagcaatggcagccaccaaggctgggtcaatgtcacagcccacacctgcagcagatgccagctcaaagatactcaaggtcaccttgatgtctgtgtctggagtgacaaactccttcaagcactcaatgggacccataagaaatgggcagtgggaggagaaaacctcccgaagtccctcttgggccatggccctgaaactgaggataaccccaatgatggtcatgcgcttta

SEQ ID NO: 6852 - DNA, 189 bp, Homo sapiens
ctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccagg

SEQ ID NO: 6853 - DNA, 295 bp, Homo sapiens
aaacagaggaaccgaaaaatgaggtttacagtctcatcacatgaacactcaaatctgtacccaaggaaacagcggtattatatttactgtcacagctagaccctatcaggtgaacagggctctccacctgcggctgttgcttcgcaaaatatctttcctctccacgtgaacaagtagctctagagtgcttttaggcagagtgacggtgatgtcatgggcaccacgccaatcttattcctggacaatgacttaagccccatcgtgagaatggttttttcctcttcaacacattttt

SEQ ID NO: 6854 - DNA, 186 bp, Homo sapiens
aaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcag

SEQ ID NO: 6855 - DNA, 357 bp, Homo sapiens; identical to SEQ ID NO: 87
  misc_feature (1)...(357): n = g, a, c or t

SEQ ID NO: 6856 - DNA, 308 bp, Homo sapiens; identical to SEQ ID NO: 88

SEQ ID NO: 6857 - DNA, 326 bp, Homo sapiens
cctgaggctgctggaggttgctacatgggtgatgaccccatctctgctatcttccccctgcccgttgtgtaccatcttgctcttgggaaagtggcattcacacccccttcctggctgggttagtctcatttgaatacttccacgtgctcccaccctcggcattcaacttcccacacaggtgggggctgtctggatgcacagggtgattcctccagaccttcctttgattgggtctttgtctgttgattgacactttgtgacaggtcacctttccattgcaatgtctagttgtgaggctacctcatgactcaatttccagtgggttt

SEQ ID NO: 6858 - DNA, 495 bp, Homo sapiens
cctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaatttttgg

SEQ ID NO: 6859 - DNA, 418 bp, Homo sapiens
ctgggccttcaggaaggtggtccacttcttctgcagcagcttttcgccgcccacgtcattcttgcagactctagccacccgcgatgtgtggagcctctcaaagaagtcaaactcgctggctgtctcctcgaagaagaagtagacgacctgggtcgaagggatggctgccacaaaggaggcgtcatgatgcagccagcggaggaagttgtcggtcttgaggacaagctgggatcccagtgtgcgcatcaggatgggctcactgcccaggaagttgttcatagtaccagaatagagcatcccatccaccaagacagccgtatgcttgtgagcggggtcaaaggggctttggccttttccctccatgaccttgtcctccgagatgggcaacaggtaggaatcttgaagttcctaaatgggg

SEQ ID NO: 6860 - DNA, 269 bp, Homo sapiens
caggctccaaactccactaaccagagctgtgattgtgcccgctgagtggactgcgttgtcagggagtgagtgctccatcatcgggagaatccaagcaggaccgccatggaggaaggtcaatattcagggatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaaca

SEQ ID NO: 6861 - DNA, 192 bp, Homo sapiens
cctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcag

SEQ ID NO: 6862 - DNA, 206 bp, Homo sapiens; identical to SEQ ID NO: 89
  misc_feature (1)...(206): n = g, a, c or t

SEQ ID NO: 6863 - DNA, 417 bp, Homo sapiens
aaacagagaacaaagggattcactcagagatcagaatacgaagcttcctctcagcatcatgggaggagataaaataattcattctatggtctttgttccattaagacttggtgctttcttcagtaacagtatgtgaaatgtggctgactttgagtcccccactgtgtaagtggaattatttttcactgcagcatttctgagtctttttcttgttccttactctgaactgtaaaattaagttcataaaggcatttggcaagggtggaggaagcttccatgttactaatggctagcactgataagttattttcatgtctctttaacaatctttctaaatatggaaggctgcacagcaaaattctttttcaatcttcattcatgtttctagaaaatttagaaaatggtgtcagaaaacag

SEQ ID NO: 6864 - DNA, 336 bp, Homo sapiens
ctggcaggtagaattcagggacactgctaaacatcctacagtgcacacccacaacaaagaattaattggtccaaaatcaccatagtgccacatttcacaaactctgagccaagtcatccttttccatcacagtgtgtcagcggataatatcgaaaatgtaaatatcaagtagcaaaaataggtgttcagagattgagtgatagatataaaattaaatagctgaaggctcagagtgagaagtaaggctgggttggtggggtttcatcatgacaatccttgtggaactctttgtttctgtaaactctgtgtatgtgtatgtacaacttttgatatttt

SEQ ID NO: 6865 - DNA, 373 bp, Homo sapiens; identical to SEQ ID NO: 90

SEQ ID NO: 6866 - DNA, 545 bp, Homo sapiens; identical to SEQ ID NO: 307

SEQ ID NO: 6867 - DNA, 428 bp, Homo sapiens
ctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttgg

SEQ ID NO: 6868 - DNA, 347 bp, Homo sapiens; identical to SEQ ID NO: 91

SEQ ID NO: 6869 - DNA, 308 bp, Homo sapiens; identical to SEQ ID NO: 3350

SEQ ID NO: 6870 - DNA, 299 bp, Homo sapiens
cctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcag

SEQ ID NO: 6871 - DNA, 421 bp, Homo sapiens; identical to SEQ ID NO: 92

SEQ ID NO: 6872 - DNA, 406 bp, Homo sapiens
ccagcagaaatggtctataaatctacacatttgtcctaaaacctaaagccatgtagaccttttatacagtaagatacccacttacgtgcagtgaggtgtattcctataggtgacatcaaagtcatgcaacaagacactggcgtgaagaagtaatttctgagagtcagacagaacaataatatgaactacatagaactggataataccaatcaaaaagcgaaaatgcgaaacagctttcctgggacaagagtcaggtaattttgttcataggtaatacaaatgcacttacacacacctctaaaaacatactttcttggccgggcgcagtggctcatgcctgtaatcccagcactctgggaggccgaggcagacggatcatgagatcaggagttcgagaccagcctgg

SEQ ID NO: 6873 - DNA, 589 bp, Homo sapiens
ctgctgtttacttatcaaggttatagttcgtgcttctaactggagcactagctgctaatgcatatctagagaaaaaaatcttcctttgcagttagtgccaaaaggattcaaggcttgtctggctgcaaaatgagatttttatcaggcatcttgagcattattataaagcagatgacagtatcgtgtttggggtagtgaaattaaagcccataccaaagtgggccagccaagagcaggtgtcagcctgggacagatgtgaacaccaggaataaaagagcagttatgtaatccatttcgacgcacttctggaactgtaaactgtaaacaaatgctgcaaaggttaactattttctaaaacttacttttttccagtgggaaaacaaatatttggtatggtaacccaaacttatcactgcttttttgctcagtttcacacgttgtaactcaaattactctaaacgtgtttaactgccaaacagctacctgcatgttagaaaccagacaatacaaaccacctaataagaaaggttccctaatagaaatactaatacaaaaaaatgccttagctggagcaacttaaaaatcaaat

SEQ ID NO: 6874 - DNA, 470 bp, Homo sapiens
ccttggagactcacgagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccatttttt

SEQ ID NO: 6875 - DNA, 324 bp, Homo sapiens; identical to SEQ ID NO: 93
  misc_feature (1)...(324): n = g, a, c or t

SEQ ID NO: 6876 - DNA, 366 bp, Homo sapiens
ctggaagaagaaaagaaagcaaacaatgagaaacagaaagctgaaagggagctagagggtcaaatccagagattgaacatagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccag

SEQ ID NO: 6877 - DNA, 600 bp, Homo sapiens
  misc_feature (1)...(600): n = g, a, c or t
ccttgcctcanatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctcttgctgccatttctngaatgattcttttcaatcatggacatacttaatatta

SEQ ID NO: 6878 - DNA, 605 bp, Homo sapiens
gtcattgttttcaacagtgacttttatttacttaaagccagcagtagttcccattactctcataatgttatagttaaggcttgatttagttccagaaaataaatagggtaaatttttaatatttccctagctctgtctgctatagggaatttcagagtatgaaggtaagatgaagcagatatataagaacatttttagataatgacaatttttccttaaaatttggtgagaatttagtttcttctcaagattctgtacttctatccataaaagtaaatttctattttagtagctctgtaagaactaggccagagaagagtattacccataatagtaaatagcaaatactttggcaagtctgaattagagtacaagtgaagacattcacaaacacactttttacatctcctggatgtggtacgggctgtatgttagaattaaagcatcacaactatctgattgtagggtgctggtgggcaatgcaatcaatcaacacgtctaccccaacagatgtggagacgcatggaaaaaatacatcaaccaaagtggtcagggagaacaaaacacagaaaacaccataaaactgaagacattatctcttcttg

SEQ ID NO: 6879 - DNA, 227 bp, Homo sapiens
aaagtttaacttcctggttctcttcacccccttgcctctagtttcagtaaacaactttcccgccagtcctaatcactagttcacatctgttaccctggtcacctgctccatcctgactcatctcggtcacctgctttgaccggagtcacctttagttacctcttcctaaccgtccttcccaccaaactgctcaccccgccactctggctcgtactcctgctctcttt

SEQ ID NO: 6880 - DNA, 322 bp, Homo sapiens
aaagttgctgagctgcactatcttatattttagttgcttaggaaatgatttataatcccaacaagataatctccttgagaataagccttatgtctcattcattttggtgaaccccataacaaatacagtgcctgttaatagatgccaataaatgtttgagcaaagagtgaatttcagaaggactatgctctacctgagaatccatcacatttagtacaatcacccattttggaaaacagttcatactcccttttaagggtgtcattctgattaactcagttgctgacctactcatttcaacaatagaaaacactaggaattt

SEQ ID NO: 6881 - DNA, 403 bp, Homo sapiens
aaaatctcttaggccaaattaccttattgaggaggaagggagaactgaatttgaatcaactaaaataagattgatatctttcctcattggaaaaaaacatgaaaacacagggactcgtaagaatgctaacatttgtatgttgtttccatttctactccaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaactttt

SEQ ID NO: 6882 - DNA, 508 bp, Homo sapiens
  misc_feature (1)...(368): n = g, a, c or t
ctgaacaatatagaaaagtgcagaggcaagtgcctttccagaaccgcgtggtgacttagaagcggggcttgcgcttgcggccggtgtactgggtgtcaggtctgacttccctgccctggcgcctgtgccgctccttcttctccagcacccatgcccgactcttcctcaccattccccgcctcgacatccttaatgggaacctgtggcggagacacagctatgagctgatggacagacctgcccgggcggccgcccgggcaggtgtacaagcttttttttttttttttttttttttttttaccanagttgacttttaatttgtcctaaagccgctgaagcaaaaaccatgataaaacattctgctttcttttcttttacaaccccacgaacgcaaaaaaaaaaaaancaaaancaaaacnaaaaaaagaaacancatacnaaacccaaactatttgtaggaaaaaatggttttgtncatgggatgaaacaatntaaattcaaaacttac

SEQ ID NO: 6883 - DNA, 214 bp, Homo sapiens
  misc_feature (1)...(214): n = g, a, c or t
aaaaacaaaaaattanttgggtatggtggtgtgcacctgtagtcctagctactcaggaggctgaagtgggaggatcacttattatttagaaaaaaagaaaactaggtatggacatgtgaaggaacatacttggtgtggtggtaaatatcaaaattgagatccagagtgatgccagttggaggtcgaggaggaaaatgatttcatcaaggtgtgg

SEQ ID NO: 6884 - DNA, 354 bp, Homo sapiens
ctgtccctggatagtgccacctttgcctctccccaggattttgggcttgttttgcaaacactcaaagagtacaacctagccctgaaaagactgagcttccatgacatgaatctcgctgactgtcagagcgaggtgctccttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcag

SEQ ID NO: 6885 - DNA, 150 bp, Homo sapiens; identical to SEQ ID NO: 94
  misc_feature (1)...(150): n = g, a, c or t

SEQ ID NO: 6886 - DNA, 167 bp, Homo sapiens; identical to SEQ ID NO: 95
  misc_feature (1)...(167): n = g, a, c or t

SEQ ID NO: 6887 - DNA, 442 bp, Homo sapiens
ccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcgagaacctgaaaatgaaggtggagaaggagtacggtgtccgagagatgcctgactttgacgacaggagggtgggccgccccaggtctatgctgcgctcatacagacagatgtccatcatctctctggcttccatgaattctgactgcagcacccccagcaagcctacctcagagagctttgacctggaaattagcatcacccaagacgccgagagtggagcaggaggaaccgatctccccggggagcaccctgcctgaggtcaagctgc

SEQ ID NO: 6888 - DNA, 442 bp, Homo sapiens
  misc_feature (1)...(442): n = g, a, c or t
ctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagangatcgagcagtgtgactaccccccactccccggggagcactactccgagaagttacgagaactggtcagcatgtgcatctgccctgacccccaccagagacctgacatcggatacgtgcaccaggtgg

SEQ ID NO: 6889 - DNA, 395 bp, Homo sapiens
aaatgaagaagatagcatttctaacctgaaattagggacattaaatggatctcaggaagaaatgtggcaaaaaacggaaactgtaaaacaagaaaatgctgcagttcagaagatggttgaaaatttccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccag

SEQ ID NO: 6890 - DNA, 307 bp, Homo sapiens; identical to SEQ ID NO: 96
  misc_feature (1)...(307): n = g, a, c or t

SEQ ID NO: 6891 - DNA, 337 bp, Homo sapiens; identical to SEQ ID NO: 98
  misc_feature (1)...(337): n = g, a, c or t

SEQ ID NO: 6892 - DNA, 342 bp, Homo sapiens; identical to SEQ ID NO: 99
  misc_feature (1)...(342): n = g, a, c or t

SEQ ID NO: 6893 - DNA, 366 bp, Homo sapiens; identical to SEQ ID NO: 100
  misc_feature (1)...(366): n = g, a, c or t

SEQ ID NO: 6894 - DNA, 285 bp, Homo sapiens; identical to SEQ ID NO: 321

SEQ ID NO: 6895 - DNA, 260 bp, Homo sapiens; identical to SEQ ID NO: 548
  misc_feature (1)...(260): n = g, a, c or t

SEQ ID NO: 6896 - DNA, 293 bp, Homo sapiens
  misc_feature (1)...(293): n = g, a, c or t
ttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtnnaggagaggggctgggccangacacctgtgaaaaggtgacttgggagggct

SEQ ID NO: 6897 - DNA, 305 bp, Homo sapiens
ctgcaggacatgtagagaaaccaaaccgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtgg

SEQ ID NO: 6898 - DNA, 571 bp, Homo sapiens; identical to SEQ ID NO: 97
  misc_feature (1)...(571): n = g, a, c or t

SEQ ID NO: 6899 - DNA, 131 bp, Homo sapiens; identical to SEQ ID NO: 101
  misc_feature (1)...(131): n = g, a, c or t

SEQ ID NO: 6900 - DNA, 330 bp, Homo sapiens; identical to SEQ ID NO: 102
  misc_feature (1)...(330): n = g, a, c or t

SEQ ID NO: 6901 - DNA, 192 bp, Homo sapiens
tctgaacacagaatctgaggagcacactgttcaaacagttgggacagacaggtccctgcaaaggctactgcctttttaaaacacatggggtggggatcatggacggcatggaaaggggagagaaggtgaggaaacaggcggcggggagagaatgagaagaggaacaggtatgcgctggggaagatggggcag

SEQ ID NO: 6902 - DNA, 369 bp, Homo sapiens; identical to SEQ ID NO: 103
  misc_feature (1)...(369): n = g, a, c or t

SEQ ID NO: 6903 - DNA, 459 bp, Homo sapiens
  misc_feature (1)...(459): n = g, a, c or t
aagctttttttttttttttttttttttttgnttgnacacagatgctttattttggatgttaatatgtcaacattgtatgcaagattctcttacaatgaagttttccatatatcacaaaactcaatttagtcagggtaattgctgtattaatgtgaaaaccttacaataaaatgcagtattatgtatgtgtagtcagtttccatgcaagtatggctgctacatgttatgtctggcatttgtataacatactggaagaaactcanaggaacaaaacagtataaaggtgacttaagatgcctgacatgtttaanataaaaaatcttgcaaaaagcaacaaagcagctaactgaaggattcaaccagtaccaacccaaatatgtattatgtccaataagcccagacttatccacaatatattaccatttaggataatttaatgctcaagaaaaaatatgcttt

SEQ ID NO: 6904 - DNA, 454 bp, Homo sapiens
gtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcggatccaggtgccatgtctcgtccctttggagtagcattattatttggaggagttgatgagaaaggaccccag

SEQ ID NO: 6905 - DNA, 479 bp, Homo sapiens
aaactgataagaaacaatgaataggaaaggaaacctgctaaaatctcttagaatttacacgattcttattctactacaagaaagcattatttggtacaaggtgtatttgtggatgtacatgaacagtatatatattatccggatcatgttgtgctatgtacaggtctttacaattcttcctgaaggttaaaacagttcattagaattcaaaatgcgtaatcatctgtaagttggcacttgttaggctcttgtcagcattgataactggcatgttttattgcagcccagttccagccagtgtttgccaacttgtacaacagaagtccagcaataggtgggtagagtgcaggaaaaacagtgccatgtttctcaattggagaccctgaaataagtgaagttactagctgctaaataaatgtcactcaaaagcagtctcttggctttttcttacacagcgggcaacttttcttttacctcgg

SEQ ID NO: 6906 - DNA, 305 bp, Homo sapiens
cctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcag

SEQ ID NO: 6907 - DNA, 135 bp, Homo sapiens; identical to SEQ ID NO: 322

SEQ ID NO: 6908 - DNA, 487 bp, Homo sapiens
ctgttcctggggctgctcccacagactatgagactcagcagcccccaggcccaccccagcagcctgtgatgaccccaaacttcacctggtagccatggagttctctgcacccctcattcactcccctctggtcatttcctgagtctaacatgccctttgaggaaggcaggaggccgatccgtgaacagagagacactgggccccagaggtgacggggctccagggacagacacatctctgccctaagagactgtctcctttctggtgactgtcctgggagggttggattctggcacctcacccagtctcacccgtccctctgtgtccccatgtcctcatgacccagcacaggccacagagctgcagcctagacccagagccctctctgtgccctccattggtctccccttggggtgacctctgtgtcaccaggccgtgtggccctcccaggctggattggcatccagtcctcagcctagaccctcag

SEQ ID NO: 6909 - DNA, 299 bp, Homo sapiens
  misc_feature (1)...(299): n = g, a, c or t
ccttttttaagtgacctgtaactcatatcagtgaaaaagaacatgctataaaaagattccacaaagtgagagcattaagctcaaaggtcctgaggtaggtgtgtttgaggagctggtgtgtancggctgtataagaagtcaacctccttattttcaggtacatttattattattttaaccccaagcagaattgnctanntgggtccctcacctttacacaatagtcataggatttgactgttatcaaaaagtaaatccactctnagaggccatanatttcctattactgangttcttca

SEQ ID NO: 6910 - DNA, 254 bp, Homo sapiens; identical to SEQ ID NO: 104
  misc_feature (1)...(254): n = g, a, c or t

SEQ ID NO: 6911 - DNA, 373 bp, Homo sapiens; identical to SEQ ID NO: 107

SEQ ID NO: 6912 - DNA, 75 bp, Homo sapiens; identical to SEQ ID NO: 108
  misc_feature (1)...(75): n = g, a, c or t

SEQ ID NO: 6913 - DNA, 485 bp, Homo sapiens; identical to SEQ ID NO: 109
  misc_feature (1)...(485): n = g, a, c or t

SEQ ID NO: 6914 - DNA, 265 bp, Homo sapiens
cctttgtgggatttacttgttgtccagcaagaaactgtaggagcttcctaatatctatgtgcacttcagccatgtgttccacgtttctgtcctcatgggtgctttcagaggctaatggaggatttccaagatctttaaactgaactcaaagaatgcaaaagcggcaagttcagacaaggcaagaacaggacctttagtccattttaagccataaatattacacaaaatatgcctctaactgaaactgagaggtataaaaacatat

SEQ ID NO: 6915 - DNA, 337 bp, Homo sapiens
cctggcaaggaacatggtgcatggtaggtggcagaagggacctctgtgctcagagctgtgcctcaggacccatcgttcagatgggaagactgaggttggggagatgtgtcttgggttaggaagctgggctcggggcaggggtcagcgcgggcatggcaggcacggtgaatgtgaacttctcagtctggacaaaggcaacgcccttctcatagtaggcagcctcgttaatgaacacggggtacaccgtggactctccctcatagagcaggtcctccccactgaacatctggaagatgggagcaccaggctgcagtggctggaagtctcggtcctgcag

SEQ ID NO: 6916 - DNA, 399 bp, Homo sapiens
tcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgcttttt

SEQ ID NO: 6917 - DNA, 561 bp, Homo sapiens; identical to SEQ ID NO: 110
  misc_feature (1)...(561): n = g, a, c or t

SEQ ID NO: 6918 - DNA, 340 bp, Homo sapiens
ccaacatggcaaaaccccgtctctactaaaaatacaaaaattagccagcgtggtggtgcatgcctgtaatcctagctactcgagaggctgaggcaggagaatcgcttgaacctgggaggcagagtttgcagtgagccgagatcgtgccattgtagtccagcctgggcgacagagtgagtgagacttcgtctcaaaaaaatagaaaaaatacatataaaataaaaataaatcaggaatgcaagatccaagtaactggactcccagtccagtgttcttggtcgagttgctctttgagctgttcaatcaaccaataattactgggagccaactatgtgttagg

SEQ ID NO: 6919 - DNA, 366 bp, Homo sapiens; identical to SEQ ID NO: 105
  misc_feature (1)...(366): n = g, a, c or t

SEQ ID NO: 6920 - DNA, 485 bp, Homo sapiens; identical to SEQ ID NO: 106
  misc_feature (1)...(485): n = g, a, c or t

SEQ ID NO: 6921 - DNA, 255 bp, Homo sapiens; identical to SEQ ID NO: 111
  misc_feature (1)...(255): n = g, a, c or t

SEQ ID NO: 6922 - DNA, 120 bp, Homo sapiens
ctggtgggagggagcatggatttggaggtggagaagtcactcctggtcctcggagggggtgggctgtgtgcctagttcagtgtgactcggggattggtgagggcggacaggtttctgagg

SEQ ID NO: 6923 - DNA, 433 bp, Homo sapiens
cctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctgg

SEQ ID NO: 6924 - DNA, 98 bp, Homo sapiens
ctgatgatcgggaagaggatggctgctcccaggccgttccattggtgccactcacagaggaaaatgaggaagccatggaaaacgaacagtttcagcag

SEQ ID NO: 6925 - DNA, 365 bp, Homo sapiens; identical to SEQ ID NO: 112
  misc_feature (1)...(365): n = g, a, c or t

SEQ ID NO: 6926 - DNA, 517 bp, Homo sapiens
  misc_feature (1)...(517): n = g, a, c or t
cctggagaacatangtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggcccagagcaggggctgttgccgaaaggctgtggagcaacaagttgacatctgacctgacatttgcctatgaacgtttgtcacacttccgctgtgagttgctgangcgaggtgtccaggcccaacccctcaatgtaggcttctgtgagcaggagtttgaacagacctgagccccangcaccgaggagggtgctggctgtangtgaatggtagtg

SEQ ID NO: 6927 - DNA, 525 bp, Homo sapiens
ctgacccctttcccgcgcactgaaagggcagagggtgaggcagtctggcccttggacccttcggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataaga

SEQ ID NO: 6928 - DNA, 341 bp, Homo sapiens
cgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcag

SEQ ID NO: 6929 - DNA, 192 bp, Homo sapiens
cctaagcataatataatagattctggggattcagtggaagagtgagagtggggtgatggataaagtactacacactgggttcagtgtacactgctctggcaacgagtgcaccaaaatctcggaaattactgctaaagaagttactcatgtaaccaaacaccacctggtccccaaaactactgaaattttttt

SEQ ID NO: 6930 - DNA, 94 bp, Homo sapiens; identical to SEQ ID NO: 114
  misc_feature (1)...(94): n = g, a, c or t

SEQ ID NO: 6931 - DNA, 369 bp, Homo sapiens
ccactctgtctgcaagatgttttagtggaatgttgtagccaaagttagatctgaagttggaagcttcttctcttgctatgtctgctaaagaacgagcatctgccaacaaacctgctactgccattccaacatgccgatcaacattaaaaagtcttttgttggaaccttcttcataaagtttagaaaggactaatttttctaccccaaagacaacaccatctttgcatctgattccaatagctgtactactattttccacagccttcatagcatattcaacttgaaaaactcttccgtcaggagagaatgtagaggctgacaggtcatacccagtgccgattgagctcatcgtgctaaacccaaagggac

SEQ ID NO: 6932 - DNA, 297 bp, Homo sapiens; identical to SEQ ID NO: 323

SEQ ID NO: 6933 - DNA, 563 bp, Homo sapiens
  misc_feature (1)...(563): n = g, a, c or t
ccacacattctctaagaagtcagcactttcctggactgggcacttgtggctagaagggtatgcactacttgctaatttctaaaacctcaaaccttaattttcccccatcttaaaatgggaatcagcttctggaaaagctaataactgtttacaattgtcagacttctaaaaagtgctaatttgttcccttaacagagcaaatgatgagagacaccattttcctgcagattaaaaacaatatataaacatatgattcaacgatgtcaacagctttcagtctatgaatcttgtccaggtcactttgggtcacttggttctttcatcagaacatgttcaagatttctgacattcctttttccgaactttcgattttggtgcatttggattttcttgtttgtagaangtctttaacatttccactgcttcctcagcccgatatccagggatacactgaaatggtcccccagtgtttggtaggtcagcagaggcaatatttagaacagagccacaaccaccaaatcgttcattctganagccatatacaaccagcgggattttcatca

SEQ ID NO: 6934 - DNA, 66 bp, Homo sapiens; identical to SEQ ID NO: 113
  misc_feature (1)...(66): n = g, a, c or t

SEQ ID NO: 6935 - DNA, 491 bp, Homo sapiens
  misc_feature (1)...(491): n = g, a, c or t
ctggcagctcacattttacattagagagtggggtccccacattttacattacagagcggggtccctgagctgcaggaggagagcctgcagggctcttgggtagaattgcacttttgcaataagggaaacgggagcaatgtttcagcctcagtttctatttataatactgacacaaaaagaatattgctggatacatagcatggatctagatagagcagctccaggagttctcacggtgacagcccccctcactcacagacaccatgtgatactaatagggcttagacacaaagcactgaattcccaaagcattgaaggagaaagacagctctcagtctgagtaaaaccgtattgagagaagaaaagaggntgaaagaatcttaaaagacaaattcagattacatgtaacattggtcaaattgaccagaaaatattcttccaaaagaagttcttctctaaaacaccaaaagtgcacagntactctcagcatg

SEQ ID NO: 6936 - DNA, 386 bp, Homo sapiens; identical to SEQ ID NO: 115
  misc_feature (1)...(386): n = g, a, c or t

SEQ ID NO: 6937 - DNA, 365 bp, Homo sapiens
cctatttaagggttcccagcagaatgggccattgtccgcctctccagttgcatgactggagtttgatggccttttgttctttctgagctgtagctggagcttgcttgttggttcacaggaacaagcaaggttcatctaaactgtaggcaaaaacttaaaaacaactagtgagtttagaatttaatggcaaatgtatgataagttttgaaacacaatttctttctctctagtcctcatttttggaaaaaacaaacaaaaaaacataaatcatgataggactgagttgtttgcaaaatagattgtagtcttacacttggtctgattatttgcataaagtgcaagaggaataattatttctacatagg

SEQ ID NO: 6938 - DNA, 511 bp, Homo sapiens; identical to SEQ ID NO: 470

SEQ ID NO: 6939 - DNA, 308 bp, Homo sapiens; identical to SEQ ID NO: 117
  misc_feature (1)...(308): n = g, a, c or t

SEQ ID NO: 6940 - DNA, 203 bp, Homo sapiens; identical to SEQ ID NO: 118
  misc_feature (1)...(203): n = g, a, c or t

SEQ ID NO: 6941 - DNA, 293 bp, Homo sapiens; identical to SEQ ID NO: 119
  misc_feature (1)...(293): n = g, a, c or t

SEQ ID NO: 6942 - DNA, 436 bp, Homo sapiens
  misc_feature (1)...(436): n = g, a, c or t
ctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccanaagagaatcacgccaggaaagcgacccggaggatgatgatgttaaaaagccagcattgcagtcttcagttgtagctacctccaaagagcgcacacgtnggagaccttatccaggatcaaaatatggatgaaaagggaaagcaaaggaaccggcgaatatttggcttgttgatgggtacccttcaaaaatct

SEQ ID NO: 6943 - DNA, 266 bp, Homo sapiens; identical to SEQ ID NO: 120
  misc_feature (1)...(266): n = g, a, c or t

SEQ ID NO: 6944 - DNA, 335 bp, Homo sapiens
aaaagaaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgagg

SEQ ID NO: 6945 - DNA, 188 bp, Homo sapiens; identical to SEQ ID NO: 116
  misc_feature (1)...(188): n = g, a, c or t

SEQ ID NO: 6946 - DNA, 193 bp, Homo sapiens
cctaactcagggtcccgaccctcaagggcacagagagcagagcctacgatgactggggtctcctcccctttatagccaaactcggtgagcagctcccggatctccagttccaccagttccaccatctcagagtcctggacagcgtcagccttgttcacatacaccaccacatgctccaccccaatctgtctgg

SEQ ID NO: 6947 - DNA, 268 bp, Homo sapiens
cctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcacttt

SEQ ID NO: 6948 - DNA, 282 bp, Homo sapiens
cctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcag

SEQ ID NO: 6949 - DNA, 345 bp, Homo sapiens
aaaagctagtaagaattgaaatttagcatcacagttcttgaccagaatataattacagctacccctaatgtgagggtagggacagcgatgtgtgttatatccccagcatctagcagtgtcacagaagagacaaagacatttttctggtatgcatgagtataagaatggtttgcctaaataagactgtcctcatggctctgtgactgtgcctcttgtcaggtgtatgagtttagagtcaaagaatctagcatcatagctccagctcccgctgaggatgtggatactcctccaaggaaaaagaagaggaaacaccggttgtgggctgcacactgcagaaagatacag

SEQ ID NO: 6950 - DNA, 521 bp, Homo sapiens
cctcaggaatagtacggaatgcccgaagaaaattattgccctggcaagggtcaccacgagagaggtccaacatgtgaaacaggaagcccagctcacatgccagacagaactccttctggcaaaggtggttttgaattagacagcgtacaggctccaggaaatagagcacctggatcatgcagttacagtaggcgttgggaatgtggggctctaatccagcaaacaaggtcttattgtagtgtttgaagtcaaagtcctccagccctagcttggaatatttgatggtcaccttgcggtatttcttagaaaccatgtggagatgtggttcctcttctcgtcctactggtgactcagtgacctggctgaagctgtcaaattcactgtctgactccttgagtctgtagggtatctgattgcgcagcctggtgcggggattgggcgcatagccaatgaagcccaccttcttcatggtgcgcagaatctctgcatccacgggtggtgctcgcctgggagctggagca

SEQ ID NO: 6951 - DNA, 425 bp, Homo sapiens
ctgttacttcacagctctgacctcagttttctcatctctaactaggtcaccggcacttccctcagggtttgtgagagttaaatgaagtcaagtgcggaacacccagcacaggccctggtgcatcgggaacgaatctgctctgggtgcaccctcacctcacagccagccacatgtgcaagggaagctttcagaatgtccttgagtaagggtgccagcagccctttcttgatcctgaccaggtcctcaagggagaacaggtggagctcatcagtcaagtgtcccggcacctgctcgaactcctttaatgcactgccagagaggaaacaaagaggaattcagaaacccacccacacagaggacagggaagaatggggccagttgttttctcttggcactcacacttaattttttttttaactcaattt

SEQ ID NO: 6952 - DNA, 373 bp, Homo sapiens
aaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactgg

SEQ ID NO: 6953 - DNA, 210 bp, Homo sapiens; identical to SEQ ID NO: 121
  misc_feature (1)...(210): n = g, a, c or t

SEQ ID NO: 6954 - DNA, 310 bp, Homo sapiens
aaagtacttttaagaaaaaaagcagggccttggaagttttggttcttttttcctcccctgttgcaaattctcatggtttgggttgggtggtggagagcgcgtgtcatctgcgggtggcactgcccacggtgggcgggcgggcctctctactcgaaggtgaccacgtttagattctgagacgggaagtggagggtgaataggtcacggcggcctttttttttttagtttaacttttccttttttgctgtctagtcatcctcgtcggtcttctgcttcttggtatcgacatcgtcatcctcatcatcttcag

SEQ ID NO: 6955 - DNA, 292 bp, Homo sapiens; identical to SEQ ID NO: 122

SEQ ID NO: 6956 - DNA, 400 bp, Homo sapiens
ctgggtttatccaaaccaataaataatgctacattagaatcctgagccagggactgtgatggtgttagacaatccatgatgtccacaagttaataaagaccccactttaagaacaaaatatggctgggagcggtggctcatgcctgtaatcccagcactttgggaggctgaggcagtggatcatgagttcaggagattgagaccatctggccgacatggtaaaaccccgtatctactaaaaatacaaaaattagctgggcatggtggcatgtgtctgtcgtcccagctactcaggaggctgaggcaggagaatcgcttgaacctaggagatggaggttgcagtgagccaagattgcagcactgcactccagcctgggaaacacagcgagtccccgtcttt

SEQ ID NO: 6957 - DNA, 550 bp, Homo sapiens
  misc_feature (1)...(550): n = g, a, c or t
ccagtctctcagaaatgtcctctgaactggcactcaattttgtagcacataatccttttccagttttctctaaatggactgtgcactcaggggaactgttctctgtggtttccagatagttgttgggaacagatgcctgcaagaagctgtcctgttgaccatccaaagtgtcttctacgcccaactggatggcttcggcaatttccacctcatctgcaatagccatcaaacggcgacgcatcctggtgaagtgagtggaactggaaacactcagcatttctaacagttttgaaaacacatggggtactgtagtaaccattcttgcagaactcaagtagatccttctggaaagtttgccaaccattgagtgggaattatcaatggactgcaaagcaaaggttaagagggacagcagcttcttatacctgatttcaacaggctcagcttgtgaaacatcagtactgacaatatgaggataaaattcagcaggaaattccaacaacagtctatctataagacaaaggcggncaagaagttcttgccaattgtt

SEQ ID NO: 6958 - DNA, 357 bp, Homo sapiens
  misc_feature (1)...(357): n = g, a, c or t
aaattttgaacttgtttcaatcaagttgtagccaaaacaaaaaggtcataattactgtgctcatataagagatgtgacgagggaaggagggagggagaaatgcaggaaaggagtggggagaggaggaagggaggaagagagggaggaaagagtaaggtacacatcangttaaaaggggcagaattaggaataaaactaagcacttaatctaatctgatcaggaagaaactttgccctttattcagattttattgcatttcataatcacagaaaaanaacatccaactttattcttaaatgtgnctcaagntaaaaatggcaggaatgaatagcccttanttagcacacactattttt

SEQ ID NO: 6959 - DNA, 413 bp, Homo sapiens; identical to SEQ ID NO: 324
  misc_feature (1)...(413): n = g, a, c or t

SEQ ID NO: 6960 - DNA, 537 bp, Homo sapiens
  misc_feature (1)...(537): n = g, a, c or t
cctctggccggagctgcctggtcccagagtggctgcaccacttccagggtttattccctggtgccaccagccttcctgtgggccccttagcaatgtcttaggaaaggagatcaacattttcaaattagatgtttcaactgtgctcctgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagntttttttgttgntgngtttttttgnttttttttttttggtagatgcatgact

SEQ ID NO: 6961 - DNA, 507 bp, Homo sapiens
ccttgctgcagggtgtgacagtgagcgattccatgcctgtgcgggggttgtagctcttctgcttacagaaccctggatccagcacataaatgatgccctcaatggtgagtgatgtctcagcaatgttcgttgccacaaccacctttcgtgccccaggtggtgtgggctggaagatacgggcccgcatgtcagagggcagattggcataaatgggcagcaccaggagctcccggattttggagcccaggcggcggcagcgatcctggagcatctcacaggcagcctcaatctcctcctggatagagggtagggagagcagcaggggtcccagagtcacagaaggccaacatgccggccctgtcttcccctgggatacatcatcccctctccccaccatgtcaggcacctgtcctgtcaggaacaccaggatatccccagggggctgggtcacatggatctgcaacacagatactacacaagcttccaagtagtcagcctctggagcct

SEQ ID NO: 6962 - DNA, 243 bp, Homo sapiens; identical to SEQ ID NO: 622

SEQ ID NO: 6963 - DNA, 371 bp, Homo sapiens
aaaaacagatgcagacacaagggagaaagccatgtgcaggcaaatgtggagactgaagaatgcagccatgagccaaaaacaccaaagagtcaccagaaactaggagagaaatgtggcgtgggttctccagacacagagaaaggatcttacagagaagaaaagattatgacagggaaacttatctgccaaataatattagtagctaagatttctgagctcttatataccaggcaatattctaagcagattacatgtactgcatctttattttattttatttttttaattttgagctcttgctacattatccaggctggtctcaaactcttggggctcaagggatccacccacctcagcctcctgagtagctg

SEQ ID NO: 6964 - DNA, 453 bp, Homo sapiens; identical to SEQ ID NO: 636

SEQ ID NO: 6965 - DNA, 324 bp, Homo sapiens
aaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatctttt

SEQ ID NO: 6966 - DNA, 364 bp, Homo sapiens
cagagtctcgctcggtcacccaggctggagtgcagtggcgtgatctcggctcactgcaagctccacctcctgggttcaggccattctcctgcctcagcctcccaaatagctgggattacaggtgcccaccaccacactggctaatttttgtatttttagtagagacagggtttcacaatgttggtcaggctggtctcgaactcctgacctcaagtgatctgcccacctcagcctcccaaagtgctgggattacaggcatgagccaccaaatctggcccaaattgagtttaataaagagcttgagtgatgctcagattagggagggagtgaccgggaatgctggggtctggaactgggggcccgg

SEQ ID NO: 6967 - DNA, 299 bp, Homo sapiens
cctttctccatggggcctggaggagatgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacgttgcccagtgactcctggggtcaaggacagaggctgctggggtgggcctgggagctgctgagtctcatagtctaggggagcagccccaa

SEQ ID NO: 6968 - DNA, 474 bp, Homo sapiens; identical to SEQ ID NO: 123
  misc_feature (1)...(474): n = g, a, c or t

SEQ ID NO: 6969 - DNA, 215 bp, Homo sapiens; identical to SEQ ID NO: 637

SEQ ID NO: 6970 - DNA, 318 bp, Homo sapiens
ctttggaagaagggaaggtaaaacttacactcagtactgattgctacccttttctcatggatatggaagcagacaagtagagtttgatttgatttgcctctatgctaaatgtttttcttcttaaattcagaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacag

SEQ ID NO: 6971 - DNA, 160 bp, Homo sapiens; identical to SEQ ID NO: 126
  misc_feature (1)...(160): n = g, a, c or t

SEQ ID NO: 6972 - DNA, 125 bp, Homo sapiens
  misc_feature (1)...(125): n = g, a, c or t
ccgagggggaagaggtttgttaatacgttcgccatgtgctacgatcttgggacgaactgagccacgagcgtggctttgagggccgtccgaacgctgcangccggccaggtccctgggcgtccagg

SEQ ID NO: 6973 - DNA, 286 bp, Homo sapiens
  misc_feature (1)...(286): n = g, a, c or t
aaaaagcatttagatnnagagattgaaaagagcgaggcatctaaggctggggggtggggaaggaaaagctgtggagcactacccctcccccaggccacaaaagtcaagggatgtctcttccactggtagcctcaccacacagcttactgaaatcaacaatgttaaatatttagcttcacaaactctgtaaaaatgagttgttgtgacctacaaaaaaggtatatacatattttacataatacaatatcttanaggtcatattttacaaaaaaatctattcacagaa

SEQ ID NO: 6974 - DNA, 562 bp, Homo sapiens; identical to SEQ ID NO: 471
  misc_feature (1)...(562): n = g, a, c or t

SEQ ID NO: 6975 - DNA, 445 bp, Homo sapiens
cctggggacatcgcagaatgccttcccctcattgtattgccctctgtcctagacatcctagcatgacacaagatactattaacatcctacagagaaaaagaaaaacacccaggtcacactctaagagtttatgatggcaaccatcctcaggtttttccaaatctgattttattccccaaggcaatttattcacattggaagatacccattgtgatggggccagcaactttcatcttagcagcagcttgtatttaatacatttgtatttaagacatgtgcagaggatttttgaaacagaatttaatataatagtaatataaattcaacacttgtttctcatataaagaaagcaaacatttagccttttattaagttactgaagaaaattttcttaactcagtgaagaatatctccccaaatttacagcaaccttcatatttacctc

SEQ ID NO: 6976 - DNA, 388 bp, Homo sapiens
ccaaatctggatttaagttcaactcagccagaatccaaagcagcttcttttagattcactatgccacatcccaccaaacccaacccagcacattgtattaggaaaaatcctaaaacttttgattaaatggtaaaaggaagtaactacctggagaaaataaggcttccgctaccttccgtcctccctcccagggcttggcaaaaagagatcttgagcatgaggaaggaacagcttcttcagaaacaggaattagctgtatgttggcttctgcataccctcttaagattcaatatggggcaggacacagtggctcacccctgtaatcccagcacttcgggaggccgaggcatgtggatcacttgaggccaggagttcgagaccagcctgg

SEQ ID NO: 6977 - DNA, 434 bp, Homo sapiens
  misc_feature (1)...(434): n = g, a, c or t
cctggaaaacattctccaaaaagaagctgcaacatgtgtggacaatgggcttttcatgcctctcttactgtctcttactgtctattgacctggtgcaagaaacatgctctggtgatggctgtgagggaggaatcaccaccattccccccgactcatattacagatggggaaaccgagacacacattcaacaaagcgcgcatcacatggggagttcagggttagcctggagtacgaacacacgttctccccatggcccantcagcggcccacctggcctcttcccctccctttagtaaccccatcagcagcagcataaaaatctaacccttcattttgctgaaagcccctgcagatgacagtttccttcctatcatgtctgcagagctccaaggctgggggcgatgttgaggccgaanccagccacagtgcctca

SEQ ID NO: 6978 - DNA, 200 bp, Homo sapiens; identical to SEQ ID NO: 124
  misc_feature (1)...(200): n = g, a, c or t

SEQ ID NO: 6979 - DNA, 552 bp, Homo sapiens
aaaccaaagcatttttttatagtttctagctaggtttatagaaactagtggagctatgggcagtcagttaaaaacaggccatagatagcataatgaattataacacccctgtccaagtcctatagagaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgtaaggaatgggtctgggaccttaacagggagccatggtgagtgtgatatagctgggggaacaggggagtggctaagactg

SEQ ID NO: 6980 - DNA, 155 bp, Homo sapiens; identical to SEQ ID NO: 125
  misc_feature (1)...(155): n = g, a, c or t

SEQ ID NO: 6981 - DNA, 201 bp, Homo sapiens; identical to SEQ ID NO: 127
  misc_feature (1)...(201): n = g, a, c or t

SEQ ID NO: 6982 - DNA, 198 bp, Homo sapiens; identical to SEQ ID NO: 128
  misc_feature (1)...(198): n = g, a, c or t

SEQ ID NO: 6983 - DNA, 177 bp, Homo sapiens
  misc_feature (1)...(177): n = g, a, c or t
aaaaaatgatgttngaagtgaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttt

SEQ ID NO: 6984 - DNA, 259 bp, Homo sapiens
ccacctttttgataaagaccagcaccaagaggatggcaaacaggatcccgaagatgatggggatcaccaccagggctctcagccgatcctggggacctggagaaatcaggacttcagcatgcacccctcacctgcagtttctccctaccctcaacctgccgtgacttgtcagactccagaatcttccaatgtcagagctcatctacatcagaaggttcaaaccgcggtccttggggaaatgcggctggcagatgtcttt

SEQ ID NO: 6985 - DNA, 485 bp, Homo sapiens; identical to SEQ ID NO: 129
  misc_feature (1)...(485): n = g, a, c or t

SEQ ID NO: 6986 - DNA, 77 bp, Homo sapiens; identical to SEQ ID NO: 130
  misc_feature (1)...(77): n = g, a, c or t

SEQ ID NO: 6987 - DNA, 161 bp, Homo sapiens; identical to SEQ ID NO: 131
  misc_feature (1)...(161): n = g, a, c or t

SEQ ID NO: 6988 - DNA, 285 bp, Homo sapiens
ctgctccctcctcccccaggggcctggcctcttacaagggattgcgtgacagcgtacacagccttctccatggagatgacatgcaaccctctgcaacatacagggacccagaagtctcggcccccagcccccttcctctctaagactcaagaatctgggctctcagccagatgtggtagctcacgcctgtaatcccagcactttgggaggctgagatgggtggatcacgtgatgtcaggagttcgagaccagcctgggcagcacagtgagatcctgtctctattt

SEQ ID NO: 6989 - DNA, 470 bp, Homo sapiens
ccttggagactcacgagttttgagagcaaaatgacaacacccagaaattcagtaaatgggactttcccggcagagccaatgaaaggccctattgctatgcaatctggtccaaaaccactcttcaggagggtgtcttcactggtgggccccacgcaaagcttcttcatgagggaatctaagactttgggggctgttcagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccatttttt

SEQ ID NO: 6990 - DNA, 577 bp, Homo sapiens
  misc_feature (1)...(577): n = g, a, c or t
ccacaagaaagacctacaaagaccacatgggaggaaaaagaaacatctgtaaagactgaatgcgtggcaggagtaacatctaataaaattgaagttttggaagaaggaacagctaagatgatcacatgtcctacaaagacagctacaaaagcaagtacaaatggtaagatgcttgagtgaactttgtagagtttattggcactttgggttccctagtggaaatagtgtggtacaggagtagtcaggaatggcttgaatgtctagataaggcaagcttaggcaacacattttaatagtgtagaaacgagtagatgttattctgtaggccctggaaaaattcccagaatacttctggctgtaaatattagatgaaaataactaacaattgctaaaaccatanaaaccaaagttgttttggtggtacagggatattataagttctcactccccctcccccattattagttatgctatcagcaagtgtttttgttcatgtctcctttcttggttggctaaattagcaacagctccaatcatcatgctnactcaagacaatatctgaangctgggagtgctg

SEQ ID NO: 6991 - DNA, 482 bp, Homo sapiens
ctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaaggccatatcgagggatgaaaggaagtgaagtcaccgctatgttagaga

SEQ ID NO: 6992 - DNA, 314 bp, Homo sapiens
ctgttgttagttatatagcagtacaggacatatgtaatcttgttgagatgtgtcttctaaagacacatttctgagtagctcaaacatatcaggaaagttggttctgtgtacttttgttaatcattgttttgattcaaacttaagtaatcttagatgttgatttggtttttattgtatttcctttcctaattaggacttaaccaccaccatgtcgagcaaaagaacaaagaccaagaccaagaagcgccctcagcgtgcaacatccaatgtgtttgctatgtttgaccagtcacagattcaggagttcaaagagg

SEQ ID NO: 6993 - DNA, 294 bp, Homo sapiens; identical to SEQ ID NO: 132
  misc_feature (1)...(294): n = g, a, c or t

SEQ ID NO: 6994 - DNA, 483 bp, Homo sapiens
  misc_feature (1)...(483): n = g, a, c or t
aaaataggtgtcctgataacttccaggatattattcggaacacccgtttccccaactacgataagtccattgccggatgctgaataaacttcgcccattaccacttggatttcttgatagtcttatgtttccatcatccatcgtaatgtgttcagctcancttcctagaaacattgaacaacggtttagaaattttgcccaataacccggcaccctctaggtttttaacagtgaatgttacttgtgcaagtcaggaatctgataccaattaaatggtgacagctttgccaataaacaaggatatgctcttccatggctaggaagggagactgccacggctgacaggtcccaaagatacatggagattcacaatccagaattaaccancaaccaaactgctacaggttattactcaccatctggctcaaactgacagttctcggggtgctagggcacaagagcganagagtagactcaagatgg

SEQ ID NO: 6995 - DNA, 270 bp, Homo sapiens
cggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaagg

SEQ ID NO: 6996 - DNA, 433 bp, Homo sapiens
aaaacaacataaatagaatacacttcttttaacaaagcctggccttggtggctttctagcttgcagtctaagtaacgtttggtttgcagaagggattccctgggagacggctgtgtggggcaacctcacttactggttgtgtgttctccatgggaaaagcaccagatggggaagcccaggatcagatgtaagctgcaagcttctttctctcttcaaactgcttgtccactgccagagacagggcctggaggaacccctctatggtgacggtgggggcctggacatacagcgcatgagccagaaaggggagttttctcaggacccggccgctgaggccctcgctcttccttgaaatgtcattcaaaagaaggctcaattttgacacgttgttttcaatgaagccaatcatctctagctctcggagggtcagcag

SEQ ID NO: 6997 - DNA, 419 bp, Homo sapiens
cctcaggccccttgcttgggtcatgctgccccctgtcggctgctgcccctgcctcttcctctgagttctaacaacacagacactggtgcctgaaagccctgctgctgccagggagtcagaattctggctgcctctacttgggaatctcctcccatgtggggatctgcagaacatccagatggggccatcccacctcatgatccattcactcccagtgggatacactggaattcaacccggagactggagcccaacagattaaggcagaattctccttgctctggaggcaggtctgcgggaagggggtgaagtctagctgcccctcatgtcccatgccggtgagggtacttggcttcccacagctaagcccaggagcttcctatatcccatctgctgagacagcaaggggtgcggcctgg

SEQ ID NO: 6998 - DNA, 449 bp, Homo sapiens
ccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatgg

SEQ ID NO: 6999 - DNA, 362 bp, Homo sapiens
ggaaggaaggaagaagaaagacaggaaggaaggaaaaaggaggaaagaaacaaaagggcaagcaggccgagcaggtctaggattggctagtttgaataattttggcaggctgcaggtgtagggactgtcttaagttgcctggaagcttggaagctataatagagaatggggagggtgggaatatgagccttggatgggctggctactatgaaaggcccactcctggatgagttatttcctctctctaggaattagctaaccctgatgggtccctccccagtcagcaaggccccggatgccacaacttaaagtacagaaaatgtagttaacacagccaccacgaattgactagttgagtgttt

SEQ ID NO: 7000 - DNA, 381 bp, Homo sapiens
  misc_feature (1)...(381): n = g, a, c or t
aaagttttattatnnanacacatggaattaacggtgttatccatgtatttgcaacagcagagaaagagtgagagtggaccatccccataggggacacttatcctttggctaaactaatataaataatggaaataacacctaatacaataatacagcacataaaagagattacattaagagaagagacaggaactgcggagaggagtcctgagtatggaggagatgcggctcatggagaagcatccaggctcaggtgaccttccctgaagacttcctgtctctgagcagctcagttcagttccaggtcatacacgtactcctggacccaggactcactggggtcagcgcagacttgcttgcctcttttggtttggaatacca

SEQ ID NO: 7001 - DNA, 551 bp, Homo sapiens
  misc_feature (1)...(551): n = g, a, c or t
ccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattattnccggatcactcctggcagcaacggagaaaaactccaggaagtgtttnggtcaaaaggaaaaatgataatgaattcattgagcctct

SEQ ID NO: 7002 - DNA, 298 bp, Homo sapiens; identical to SEQ ID NO: 133
  misc_feature (1)...(298): n = g, a, c or t

SEQ ID NO: 7003 - DNA, 228 bp, Homo sapiens; identical to SEQ ID NO: 329

SEQ ID NO: 7004 - DNA, 373 bp, Homo sapiens; identical to SEQ ID NO: 134
  misc_feature (1)...(373): n = g, a, c or t

SEQ ID NO: 7005 - DNA, 506 bp, Homo sapiens
  misc_feature (1)...(506): n = g, a, c or t
gttggtttttttagnttctctctctgatctttagtttttccctttgttttcggtttctgggactttctcacactctcccctttcctccctttccccttttcctcatactcctcatttcttctgttttccctctgaggtcctatttgaaatgttttatttttcttctccctaaccttccagccctctcctctccctccccctgtgggcaggacctgaggctctaaagggcactccagtgtctcccttcggtctttcctgtcccttcaccgtcttgcttatcttcccacgggtggagaaaggtgccctgcctctgggcttttgctatctggccctctgtcttccacctcggggtggagggagttggcgggagcagtttttgaatgactgcagtttggggttggtgaggagagggaggttttcttcanggcctgctatttcctgagccttcctctctgaagcttgggaaatgacaccttttttactacgttagtgtttcccagagattt

SEQ ID NO: 7006 - DNA, 540 bp, Homo sapiens
cctacccactttagccagcgtcccctccagcagccatcagcaagccaacccactccaagccagggccccctttggtccttgcacttgaggtgctttgttcagggctgggtcaggagtggcagagacgatgtccaccacctcagtactggggaaagtagcctggttcctcctcgtgggtccagctacttggactgctggctgggttctggaagctgcctcggccccagggcagtgctaagcagctcagtcagggcatccagcttccccgccagcgtgtcaatctgtttctccagggcccggtgtgagctgctcagattctgctgcaggtcatacaggatcatgtgcatcttggagatgtccaccatggagttcacttgttcccggagcttccggtgtttcagccgcacctggcggagcgcgttgatggcggccagcagcttgcgctgatgcctgcgggcagcatgagactccttcctgcgagtatgtttgtagaacatccaggcttcttgtagcactcgggcagcggactccttcatctct

SEQ ID NO: 7007 - DNA, 402 bp, Homo sapiens
ccaacatgatgaaaccccgcctccactaacaacacaaaaattagccaggtgtggtggcgggcgcctgtaatcccagctattcaagaggctgaggcaggagaatcgctggaaccggggaggtggaggctgcagtgagccaagattgcactccaacttgggcaacagggagagactcagtctcaagaaaaaaacaaacaaacaaaaaaaccaaccaaacaaaaaaactttcttgtggtacttatcttttttgatcatttcatcttggaaactcatatcatgttcaaataaacacaataaagaaggaatgttcccagaccatgctattcaatgtggactttcttttataagctatgagaagaatactttggagaagcaagaaacttgggttattttttgttattt

SEQ ID NO: 7008 - DNA, 406 bp, Homo sapiens
cgggcggagaagctggagtgactctagggcagccgcatctttcgcgtcaggatctcaccaccttggatgttaccaagttgacgccactttcacatgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaactagtcagacatgtttcctttgttgactgtcctgg

SEQ ID NO: 7009 - DNA, 487 bp, Homo sapiens; identical to SEQ ID NO: 135
  misc_feature (1)...(487): n = g, a, c or t

SEQ ID NO: 7010 - DNA, 194 bp, Homo sapiens
  misc_feature (1)...(194): n = g, a, c or t
cctacagacttatttcttcttggacacacccacggtgcggtcacggcggccagtggtcttggtgtgctggcctcggacacgaaggccccanaagtgacgcagccctctatgggcccgaatcttcttcagtcgctccaggtcttcacggagcttgttgtccagaccattggctaggacctggctgtattttccat

SEQ ID NO: 7011 - DNA, 310 bp, Homo sapiens
aaaggatggcccggcccccagtaaacgccgattcctgctcgcggccttctacgcccattactggagcagcagccatcagtgtagacgacgacgaagtctcccatgtaggaaaacgtgtctctgctaactggaggcgccggctccacgctcgacttcatgtgctttgcatacggctctgcgctttcatgtccatctccatccagtggctcacggagtcgcttgctggctttcgcctccgattcttgtccatgttgattttcatgcccttctgaaacttccgggcttgcagatttcctgacaaaggcccagg

SEQ ID NO: 7012 - DNA, 368 bp, Homo sapiens; identical to SEQ ID NO: 136

SEQ ID NO: 7013 - DNA, 202 bp, Homo sapiens
ccaatatggtgaaacctcatctctactaaaaatacaaaaattagccaggtgtggtgctacacgcctgtagtcgcagctacttgggaggctgaggcaggagaatcgcctgaacctgggaggcggaagttgcagtgagcaagatcatgaaaagcaaaatactcaaggacttttaatataaccaccaacacagtgtgccttctgg

SEQ ID NO: 7014 - DNA, 472 bp, Homo sapiens
  misc_feature (1)...(472): n = g, a, c or t
cctcggcctcccagagtgctgggattacagatgagagccaccgcacctggcctggcaaacttcttttacaaagagtcagagagtaaatatttcaactttgcaggctgtaccatccgtctcaattatgtagctctgctgttgtagcggatgccagaggtcacacgtgaaccaatgagcgtgcctgggttctaatatagctgtagtcccagctactcaggaggctgaggcaggagaatcgcttgaacctgggaggcggaggttgcagcgagcctagactgtgccattccactccagcttggtcgacaaagcaagactccgtctcctcaggggcagacaccgggcaggcagcttcctcggccactgcgttggagtagaggaagagatcctcgtaatccacgtttgcgggatccttctgcctgcanggctgtgtcagcagctccctgcgcggctcaattggcttctgctggtggaa

SEQ ID NO: 7015 - DNA, 153 bp, Homo sapiens
ccagctacaaagtggaatgcttctcgaagggcacggtcaggaggcgggcggccgcctcgtccaagaaccagcacagtttcccggtgtggggctggaccagggcggcgggcagcgggttttcctcctggtcctccaaaacgcgcttcagaacag

SEQ ID NO: 7016 - DNA, 389 bp, Homo sapiens
acgattcacagaggagctaccagatgaacgggaatctggactgcttggataccaggtacaggcttctccagtcagaatgagattgaaggtgcaggatcgaagccagcaagttcctcaggcaaagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttgg

SEQ ID NO: 7017 - DNA, 275 bp, Homo sapiens
ctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcag

SEQ ID NO: 7018 - DNA, 130 bp, Homo sapiens
aaactggtgggtttgggcacgtggttttaggtggctagagcctcagctctcgaggtcatcctgatatgacgaatgttcgtaaagcacttagcacagcacttggcacatcatgagtgttcgatccatgtgg

SEQ ID NO: 7019 - DNA, 419 bp, Homo sapiens
  misc_feature (1)...(419): n = g, a, c or t
aaaaaataacctagnctatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttaggaatgtttagtgtaattggatttcgctatcagttcccatccttaagttttgatattcaatatctgatagatacactgcatctttggtcatntaagntttgtttacaaatgtgcaaattatttagagcatagactttataagcattaaaaaaaactaatggaggtaaaacctaaatgcgatgtgaaataattttagtgttgataccgtatgtgtatttttattctaataaacttttgtgttccagattgaaaaa

SEQ ID NO: 7020 - DNA, 282 bp, Homo sapiens
ctaatacgactcactatagggctcgacggccgcccgggcaggtctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtgg

SEQ ID NO: 7021 - DNA, 59 bp, Homo sapiens; identical to SEQ ID NO: 137
  misc_feature (1)...(59): n = g, a, c or t

SEQ ID NO: 7022 - DNA, 334 bp, Homo sapiens
  misc_feature (1)...(334): n = g, a, c or t
ccatgtccatggccctgcacttcctcatcctgctcgnnccgccccnncctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatgg

SEQ ID NO: 7023 - DNA, 223 bp, Homo sapiens; identical to SEQ ID NO: 6848

SEQ ID NO: 7024 - DNA, 296 bp, Homo sapiens
ccacagaccgtgggcgcattcttgtccacacgtccagtcttgcccaggggcagcaccaggaaggcccctcccccgctggcctcacagatcagggccacaaacttagggttgacagcacagaagccactgtcccaggtggtctgtgagacgcgcacatcttcatagcactggtcggccttggccggctgtccaaacacgtggcggaacttgctggagcggaccacctgccggctcattctgctgccgagagaggacagtgatcccccaaaagccggaggaggaggaggaggaggaag

SEQ ID NO: 7025 - DNA, 508 bp, Homo sapiens
  misc_feature (1)...(508): n = g, a, c or t
aaaagacaaaaacaaaacaaaaataccacagctcaagataaagagtcctatacagaaatcacaaaaaggacagaccatctaaggaaaaattaaaaagacgacacaaggacaggctgggcagcctgggtcagggctcctggctggtgacctgctttgagtaggtttcttgcaggtacttcttaaaagctgtggggtttttccagagctcggcagcatgtgtgttcaagggactatcaatgttgggttctcctagaaggctctggatggagagcagaatggtcctgacatcatacagggcagaccacttttccttcangatgtccaggcatatgttaccctgggtgtccacgttggggtgatagcagggcgtgaggaacttcactgtgggcgcattgtaagggtagccactggggaactctagcgagagcttatacctcaggtcttcatatactgttccagccttattcttaacaactttaacaaaccccatcctgcggaacagagaccg

SEQ ID NO: 7026 - DNA, 151 bp, Homo sapiens
  misc_feature (1)...(151): n = g, a, c or t
cctgggatgcangnagaaaggctgaccacaagttgagacaagatacanaaacaaacaaaaacagcagaaagtccgatcgatggtgtaagtgttgnnttcactgcttanggtgcaggtgagcttgatcgaggctcccagtaaggcanatgta

SEQ ID NO: 7027 - DNA, 537 bp, Homo sapiens
  misc_feature (1)...(537): n = g, a, c or t
ccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaangcgtttctaggcaatttgattcgttcagagatggatttgaatcagtcttcccactcagtcatcttcagtacttctacccggaggaactgggtcagctcctttgtggcagtaaagcagacacttgggatgcaaagacactgatggaatgctgta

SEQ ID NO: 7028 - DNA, 357 bp, Homo sapiens; identical to SEQ ID NO: 138
  misc_feature (1)...(357): n = g, a, c or t

SEQ ID NO: 7029 - DNA, 176 bp, Homo sapiens
ccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcag

SEQ ID NO: 7030 - DNA, 419 bp, Homo sapiens
  misc_feature (1)...(419): n = g, a, c or t
tgggagccctcagnnccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgct

SEQ ID NO: 7031 - DNA, 338 bp, Homo sapiens
ccattaggagcctcgcctggaacggggcccccacaaagctcctgagcctgggccacatcactcaggctcctgttccccatctccaggctcgcagcggacagaactccactttctgaagaaacaagaaggtaactgtatcacgtgctaacaacttaaggttctaaaatactttgcttctcacttgaagaagtcctagaacaaaagcctaaggtgaggccctcagaaatccaactggcaatgtcccggaagtacagatcccgccaaggtggggatctaagcccagggccatcaaccgcagcttggtccaaatgctctgagcagtggttttggctctgtgg

SEQ ID NO: 7032 - DNA, 374 bp, Homo sapiens
ctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgctttcgctttttacagtcttctctcctacctccatgaagacgcggccatcagggaagagg

SEQ ID NO: 7033 - DNA, 191 bp, Homo sapiens
cctgccggaggcgcaagcccctcgggcggcctttggtcatgctgagctcccacacacacaccacagtgctggtcccagaggtgacaatcgttgttggggatgggcacacggcgcacagacagcggccccaggcagccaggttctcgaatgtcatcaggaccttgtcggagccgtagctccccaagcagcag

SEQ ID NO: 7034 - DNA, 430 bp, Homo sapiens
  misc_feature (1)...(430): n = g, a, c or t
gcaaatactgggtgcccaatatatgtcagacacagttctagatgctagggagacagtagtgaacaagtccttccctaacctaaggtagatactgttccagcttttctagaaactagtcgaattaaagttgagctacatacaaacttagcatctctgggaaagagaaaatatttgacaaaggtgaattggggccttttttaacgctcatctcttcctgtaacatctctgtttagggaaggtgggaaccctggaaaagttacataaaatgtatttattgttaaatgtgtttagtctcataagaaaagcagtctttcacttggtaatcctaatactgtccttgaactangttagtctattttaagcatggcaggctacttttggtcttgagttattttagcttaaattaactcaagctaatttaagtttacag

SEQ ID NO: 7035 - DNA, 374 bp, Homo sapiens
  misc_feature (1)...(374): n = g, a, c or t
ctgatgcctcactactagatgcagtgctgggaccttcctcttttggagctgtcccatgtacagtggacccaagctcannaccttcgtggagctgcttctccaacctgagaaactcaagacccatcctcccgctgtcactttggacaacggaaatctacattttcttttcccttttttttttttgagacagagtctcgccctgtcacccaggctggagtccagtggcacaatcttggctcactgcaacctctgcttcccgagttcaagcaattctcctgcctcagcctcctgagntagctgggattataggcatgcaccaccacacccagctattttttgtattttttactggagacagggtttcaccatgttgg

SEQ ID NO: 7036 - DNA, 264 bp, Homo sapiens
ctgagaaaaatgcaattgagggacttttctgaattgagaaaaggatgacattctttggagagcagactttctaccctctccatctatcattgaatgttatattcattgctgccactagttaaatattaggtagacattgactggtagttacaatcaatgacacagtcactggcctaattactttggtgatttttataccatggtgtctgacattcccaggtgttttgtataaggcacacgtatttcaagagctcttcagccagg

SEQ ID NO: 7037 - DNA, 418 bp, Homo sapiens
  misc_feature (1)...(418): n = g, a, c or t
ctgctgttccgccaaggacagcatccttccggttgcgatggcgattgcagactccagggccccagtggtggagaaagtccagcaactgccgcanncaccctggaaaggccaggggagagcagaggacatcagtgatggggacgccgtgagacagccctgccttctgccttcctctgctgaccctgccagagctcccgagtccccaggtgccttggcagtttaccaagccctgttccagatccattcattctgagcctcgcaggccctgttccagatccattcattctgaggctcgcaagccctgttccagatccattcattctgagcctcgcaagtcctgagaggcttgcaaaggagcaggagcagcaggtggcctctgaccagtgcctgtggactcccaatcaccacctcttggtgg

SEQ ID NO: 7038 - DNA, 244 bp, Homo sapiens
  misc_feature (1)...(244): n = g, a, c or t
ctgccaccaggcatccacccaactgggcgctaaaggagcctggagccgggcctgtgtctgtcagcagagcaagatgtggttcattccgcagccgggcaggggccaaccctgaaccagcatgggccgggtgccaggatgctgaggctcatgggatacagcctggagaagagctgtgtccacgagtacccagttcaaggtccagcgtggttagtgtcctcanagaacatgcctgtccagagcacag

SEQ ID NO: 7039 - DNA, 290 bp, Homo sapiens
  misc_feature (1)...(290): n = g, a, c or t
acctaanncatggccctggctaggcgggaacggntcacagtagcgatacattcacaggacacagttggtgtccagaanagggggcnnanaacacantttctacacaagcacttggcacccacacgacagagacgtcactcaagcagcacagccacaaatagtttacagcagctcatgcccggcatncgcccatgctgggagactccctgaaaggtgggcacctgccgtctatgaggaggtgtctccctccatcattaaccccaaaccacacaatgtgtgaggagagcagg

SEQ ID NO: 7040 - DNA, 391 bp, Homo sapiens
  misc_feature (1)...(391): n = g, a, c or t
ctgtctcatatgtccagcaccgggcaacgttacgaatggtgtaaccaccgcctcccagcatcagcataggcaggttaaagctcttgacaaattccacacacttggcgtgtcctttgatagttagattgaagcaacctaaccgatccccagatagggagtctgagccacactgtaagaccaccgcactaggctggaacatctccattactttggacatgaccggcttgaaaatggcctcataggactcgtcatcaatcccgtctcggagcgggtagttaacagcataatacttgcctttgccagccccaatatcccgtangtccccagttcctgggaagtactctccatacttatgaaaggacacagtcatgacccggtccgtggtgtagaa

SEQ ID NO: 7041 - DNA, 340 bp, Homo sapiens; identical to SEQ ID NO: 325

SEQ ID NO: 7042 - DNA, 250 bp, Homo sapiens
  misc_feature (1)...(250): n = g, a, c or t
aaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccangtgtaaatgtggtaactcaagaaattaaaccagac

SEQ ID NO: 7043 - DNA, 445 bp, Homo sapiens
  misc_feature (1)...(445): n = g, a, c or t
cctattttgaccaaagtatacagtaaagataacgatggagatctagcatgcttactacctaaacttatggagattgatggactgcatgcaaaagatacatgaatgggatttgtggtagcagtatgcctattttgggaagcataggggctgccaagatgagaggctaccaggtaacaggccacaatgaccctgaggtttcccattctcttactgagatggggaagaaagatagtaaagaaacatttggaatggtattatatttgaaatgagaaggtacaaatgatgattttcatatccagcactcccagcaaccaaacccaaatcacctcaaactgtagaggagtgttgcagcgactagcagtagtaagagatgtgactggtgaaaacatgaggctgtntccatttcgacactcctcttntnctgggtgagangagccaggtgtgg

SEQ ID NO: 7044 - DNA, 228 bp, Homo sapiens
cctggtactgaggaataacagcatttcgtggctcagttaatatttgtacaagtgttttctcatctaggctatgcaatggaaccaccacaggcaaccgtcccacaaactcaggaatcatgccaaactcaatcagatctctggcttccacatgacgcaataaccgatctttttcttcaatgtcttggtgagtattcgattccccacttcgattagcaaggtctgcagcag

SEQ ID NO: 7045 - DNA, 188 bp, Homo sapiens
aaaggaatgtggatcatagtgatttttccttttaattttattgctcagaaatgaggcatatcctaaaaatcctggagagctgtatttaatgcatttttgcactaagtggtccttagtttaattctattgtatctgtttatttaacaaaaaattcatcataccaaaaagtgtaagtgaaaacccccttt

SEQ ID NO: 7046 - DNA, 156 bp, Homo sapiens
ctgtggcagccagcataacctccctccgtgcttccatctacctttagaatgaggggttagtaaggctgggcgcggtggttcacgcctgtagtcctagcactttgggaggctgaggtgggtggatcacttgaggtcaggagattgagatcatcctgg

SEQ ID NO: 7047 - DNA, 447 bp, Homo sapiens
ctgcaagtcatgccttgggcacctgcacttttcagagcattcagaggagaagcaatatcagggtggtccagaggtgaatccgggtgcctcagggggggaccggctcatctgtgaccgatcgaacagccaggagggtgtttccatggcaacaggacacggaagtcaccgtgtaagggtgtgtctcatccaactgcactggccgagggagtccggcatcctcatccctccttcccaatcgacctcgcgcccctttgccccaagagtacacttcgctctctgccccaatagctacagtgaaggcatccccacaggctaccattgccatcttgatgccctcaaggccttggaccttacagggtgcccgactgcctcggcgagtattggtgcccaactgtccgtgctgattgctgccaaaagtgtagcaatcacccgaggcagtcacagcag

SEQ ID NO: 7048 - DNA, 529 bp, Homo sapiens
  misc_feature (1)...(529): n = g, a, c or t
ccaagaacaaggcgtgtgccacagtcacgtagtgacacaggtcacatttgctttctgccagcagaagagactggactccagtgcaggggagtgtgcaaggacaggttctggggggtggaggcatctgtggacatcccagggcaggggtgagggccagaacatccctaggtcctgagactacagtttctccacatttagatcagacattctcttccaaggaaggaaaccaagagaggctggtgaaccgtctggtaatgacaagccctcacttttgcagccctcttggctggtccctcagcaggtcttccctatgagcctgcaaaggagacaggcagggaatgagttccatgttcgagatangggaaactgagggccangggagaggcagtgactcgcccgagggcacacggcagaatgcaggcagaggcagagtggccctgggcatcctgagtccagttctgggcactctgcacctcacaggcctggactcagtccttgccaccaccactctcagagtccttctcatgga

SEQ ID NO: 7049 - DNA, 188 bp, Homo sapiens
aaagggggttttcacttacactttttggtatgatgaattttttgttaaataaacagatacaatagaattaaactaaggaccaattagtgcaaaaatgcattaaatacagctctccaggatttttaggatatgcctcatttctgagcaataaaattaaaaggaaaaatcactatgatccacattccttt

SEQ ID NO: 7050 - DNA, 310 bp, Homo sapiens; identical to SEQ ID NO: 6954

SEQ ID NO: 7051 - DNA, 301 bp, Homo sapiens
cctgtgcagagagcgccctgggctcaaaaaggccctggggcctgtgggcattctccctggtcccacacccaggatccctgggcctgtgggcactctccctggctctgtgcccccactatggaggcagagcccgaatcagcaagtcagtcttcggcagcaggagtgacgggctgtctggatgtgggggtgcaggcacttcctcccacactcagaacttaactttcttctaaggagtccagcccagctctacattcttttgactcccaaagtggcttacagatgccctggtgttttttttttt

SEQ ID NO: 7052 - DNA, 79 bp, Homo sapiens; identical to SEQ ID NO: 139

SEQ ID NO: 7053 - DNA, 289 bp, Homo sapiens
ctgtgttaccctgggcaagccctcacctttctgtgcctgtcccctctttgctgtaaaatgggggtactaatacttaagtcttcccttcccccacagttgctactaacaaacagaaaaacggtacccatgtgctccagggtcacctctgacctttttttcctccagatgtccagctcgccgctgtccaagaaacgtcgcgtgtccgggcctgatccaaagccgggttctaactgctcccctgcccagtccgtgttgtccgaagtgccctcggtgccaaccaacggaatgg

SEQ ID NO: 7054 - DNA, 326 bp, Homo sapiens
ccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccag

SEQ ID NO: 7055 - DNA, 177 bp, Homo sapiens
ctggcttcttgatgtcctggaagagagcgcggccgccacgctggttttgcatcttcaggagacgctcgtagccctcgcgcttctcctcggccagttcgcggaagaagtggctcacgccttccagagccacatcatcgcggtcgaaatagaagcccagagagaggtaggtgtaggagg

SEQ ID NO: 7056 - DNA, 227 bp, Homo sapiens
cacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtgg

SEQ ID NO: 7057 - DNA, 539 bp, Homo sapiens
  misc_feature (1)...(539): n = g, a, c or t
ctgccaacctgagtgagttgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagangtctcangctgaggacgtggctacctacaaggtcaattacaccagatggctctgttactgccacgtgccccagagctgtgatagcctcccccgctacgaaaccactcatgtctttgggcga

SEQ ID NO: 7058 - DNA, 235 bp, Homo sapiens
ccacacggtcacacaaggcttccgcctcagccaggttatgggtggtcaggaggacacctctctctgtgtttttaacgactgcctggattgcctgccacatttgctgctgccctgtggggtctatgcccgtagatggttcatccaggagcaagacaggtgagtttcccaggaggctcagcacaaaacacaactttctcgtgattcctgctgttaatttctgcacaggaacattcag

SEQ ID NO: 7059 - DNA, 518 bp, Homo sapiens
  misc_feature (1)...(518): n = g, a, c or t
ccagaacgtgaaccactggacaggatatagctgttccagcttagggagcccactcgggcagagtgactggtcatatttcgaagccgtttctgctgctgcacatcccatagctgcacctcagcactgctggtgcccacagccaagtagttgccctctttgatccaggccacagaggatatatattccccaggctgctccatttgcaaaagctgcaggatgtcaccagagcttgcactccacaggtacacactgttgtccagtgccacggccagtacattcccagaactccaatccacaaggttcaggtaatagtcatttcggatttcaggcgcatccaggatacggtctggcagggaaggaatgtaacggcaggtcttccggctggagccaggagtggccttttggctgtagagtactttcagtctgttctgataaccctctggcgcattttgtggttttccactgagccgaangatcttggcttcctctacatcaaaaccgttcangttcaaagccca

SEQ ID NO: 7060 - DNA, 367 bp, Homo sapiens
ccattatctacatgtgttttcagcacctggttggttctaaatgggatctggagacccagcttcttggagatttttaagaggaagtattaactggacaaatggaatgggcaccagaaagaaatacagggtcacccagaatggcagaaacctaggtttcccagagtggaaagagagaggagacattcaacaaacaagtatttattgagcgcctactatgtgccaggcactgttctagacccccccccagaagaaaaaacaaaaaacaagatagaggcagcaaacacaaattctgagggagaggaaaggggcagttgagtaagacggctaagggaactgagaagcctgaggtgatgggggctctgcctta

SEQ ID NO: 7061 - DNA, 196 bp, Homo sapiens
ctggggctcaaactgctgccagtgctggtgagtgatccccacatcggtgcgtagccccagggccaaaacttcctccagcagctccagcctgcccagggggacacgcttccgggtgccatgtccatcaagggcttctggaccccgaaggccgtgatgaagatgttgactaccacgatgatgaacaccaggcccgtgg

SEQ ID NO: 7062 - DNA, 373 bp, Homo sapiens; identical to SEQ ID NO: 141

SEQ ID NO: 7063 - DNA, 373 bp, Homo sapiens; identical to SEQ ID NO: 142

SEQ ID NO: 7064 - DNA, 185 bp, Homo sapiens
cctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctgg

SEQ ID NO: 7065 - DNA, 246 bp, Homo sapiens
ccttaccacaatcactttgccaccatcaccttacctttgcaaacaagccaggccaaaaaggctcaacatttacaccggctgctttaatgagggcattgatcttatcctccgtgactgtcacctcatcgtcgtgcagaatgagggccgagtagatgcaggcgagctcggagacagaggccatggcgcgggcgagtgtagggctggcgctgccggacgcggtgctagtcgccggatgaagtgagggcc

SEQ ID NO: 7066 - DNA, 210 bp, Homo sapiens
cgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaagg

SEQ ID NO: 7067 - DNA, 240 bp, Homo sapiens; identical to SEQ ID NO: 326

SEQ ID NO: 7068 - DNA, 132 bp, Homo sapiens
ctgcagagatatcaatgggaacagaggtttcagaagaagatatttgcaatattctgcatctttgcacccaggtgattgaaatctctgaatatcgaacccagctctatgaatatctacaaaatcgaatgatgg

SEQ ID NO: 7069 - DNA, 239 bp, Homo sapiens; identical to SEQ ID NO: 140
  misc_feature (1)...(239): n = g, a, c or t

SEQ ID NO: 7070 - DNA, 321 bp, Homo sapiens
ctgggtaaggcatgctttgagggaagactccaccagcccggccaggaaagggcagcaggcgcagtgcccctatggggcccacatgactggtaacagcagcaggacacctcttccaaagctgtccaccagccccactaggggctcctactcatggcaaaaaagactacatgagcccacaactgtcaactaacacagtgccacctcctcccaaagcaaacacatatacatacaatgttaagaacctattatcagaacagcagtgcagcagaccctggccttggtctctgaaagtcctgtgtcactggctgtaaggacgcttgg

SEQ ID NO: 7071 - DNA, 237 bp, Homo sapiens
aaagttgagaggcagttcacatcctaagtgatacctagaaacctgccttcttgttcgcaaatgatcaacatgaacatacagaatggctgacatttggacctttggataagcttaaaacatggattgtggaatgtctaatagagggcttttctctcttttttttaataatgactgtcccacactttaattcctcaatgatatgtggatgctaactaaatcagatgaaatgttttcttt

SEQ ID NO: 7072 - DNA, 368 bp, Homo sapiens
ctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaagg

SEQ ID NO: 7073 - DNA, 378 bp, Homo sapiens
ctgaggtctcttgagggagcttagccaatgtgggagcagcggtttggggagcagagacactaacgacctcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttgg

SEQ ID NO: 7074 - DNA, 353 bp, Homo sapiens; identical to SEQ ID NO: 327

SEQ ID NO: 7075 - DNA, 267 bp, Homo sapiens; identical to SEQ ID NO: 143

SEQ ID NO: 7076 - DNA, 264 bp, Homo sapiens
cagagatctattaatgagatgaagcggttggaagaaatgtcaaatatgtttcagagctctggagtccagcaccaccctccagaaccaaaagcccaaacagaagggaatgaagattcagagggcaaagagcaaccttgggaaatggtgatggataagaaacactttaagctgtggcggcgcccaattacaggcacccacctttaccagtaccgagtttttggaacctacacagatgtgacacctcggcagttcttcaatgttcag

SEQ ID NO: 7077 - DNA, 353 bp, Homo sapiens; identical to SEQ ID NO: 327

SEQ ID NO: 7078 - DNA, 181 bp, Homo sapiens
  misc_feature (1)...(181): n = g, a, c or t
gttgactcatacaccctcantgtcagnngccccaggaaagacngccaagattacctgtgggggaaacaatattgggagtaacaatgtacactggtattaccagaggccaggccaggcccctgtcctaatcatctcttttgataacgaccggtcctcagggatatctgaggcgattctctgg

SEQ ID NO: 7079 - DNA, 473 bp, Homo sapiens
gttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttaga

SEQ ID NO: 7080 - DNA, 497 bp, Homo sapiens; identical to SEQ ID NO: 638
  misc_feature (1)...(497): n = g, a, c or t

SEQ ID NO: 7081 - DNA, 566 bp, Homo sapiens
  misc_feature (1)...(566): n = g, a, c or t
aaatgattctttatttcaataaactttaacaaacaatatataatatttcttccttaaaaagctcattcaaagatcataggcagacttcttccccattgtattttagttggggagataaaggcaaaaagaggaaatgtaagctatcttacagtcattctgagaacctctggtttcatgctatactttcccagctaaaagttactaatttacgaagttcagatactgaaacttaaaaatcaagatccatatattaggatgtcctgctgtcacactggtggtggcccattgtgtcggagtctggtaaatggacctgcccgggcggccgctcgggcaggtctgagaatatcatatggtactaacaaaggaaaaaactatactgaagaagaagatcgttttctgatttgnatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagaga

SEQ ID NO: 7082 - DNA, 283 bp, Homo sapiens
atggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcag

SEQ ID NO: 7083 - DNA, 259 bp, Homo sapiens
  misc_feature (1)...(259): n = g, a, c or t
ctgccacctgtgaccaagggctcccagcccccacggttctgcttccagtccaagagctggaagaggtgtgtgccagtgaccctggagctgaccaaggtgtggaggcaggcnnaccagaccttcatctctctactgcaggccgtgaggctaggcaggtgggctctgccctgacagtccagccccaacaggtgttcagatgaggtgacccgccagctccaggccacagcttcccacaaggtggggcgagatgggattgtgg

SEQ ID NO: 7084 - DNA, 158 bp, Homo sapiens
aaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaagg

SEQ ID NO: 7085 - DNA, 143 bp, Homo sapiens
gggatatgaggtcagaagggtagcaggagggcaggtcttgttcagccatggtaaagggtttggcttgactcctggtgaaatgaaaagtcttgggtgtgggggcggtttaagcagagaaatgataggatctgatgtatattttt

SEQ ID NO: 7086 - DNA, 428 bp, Homo sapiens
cttctctattaccctccttaccaccacagctccagccaagcttggagtgatctgcaaacccaatatgtgagtttagtgtatagaaaacacatgaatgaaaggcaaaaggggccaacattggtatttgggttttttttttttttgagctgtcactaggctcctgaccttccctctgaactccaccctgcagggcaggccaacagacaagctttctttctttctttttcttttttttatatgagatggagactcgctctctcgcccaggctgcaatgcagtagcacgatctccgctcactgtaacctccccctcctgggttcaagcgattcttctgcctcagcctcccgagtagctgggattacaggtgcacaccaccacatccggttaatttttgtatttttagtagagacggggttttgccatgttgg

SEQ ID NO: 7087 - DNA, 287 bp, Homo sapiens
ctgtatgcccatggacaaataaccattctgacctcagcttcatcctctgtaaatgagtctaattcaagaagcataagtctactgatgactagcgatggcatctccaccagcctcagccctcaaaaatgcaaccaggaaataagattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtgg

SEQ ID NO: 7088 - DNA, 228 bp, Homo sapiens
ctgccactgaagcccagcctgttgcaatctggggaattagcaggctgggggttgcccatcagtgtcttctgagtgcccggtgtgccctgtcaaggtgtctggtcggagagcagggtggagaagtactttctctgtggcccggtgcagtggctcacgcttgtaatcccagcactttgggaggctgaggtgggtggatcacctgaggtcaagagtttgagaccagcctgg

SEQ ID NO: 7089 - DNA, 166 bp, Homo sapiens
  misc_feature (1)...(166): n = g, a, c or t
ccttaaaaattanngcacgaccaaaaagaatgatttggtgagagatgtgtagctgattgacaattttagtgtgaattcatattcatttaacccagcagcaatctacataagctatgctttttcccgcctgtatttatgttncttagcttataaagtcccaatatat

SEQ ID NO: 7090 - DNA, 331 bp, Homo sapiens
  misc_feature (1)...(331): n = g, a, c or t
aaatagaaaacantatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagttttactgtagtagtcaattaatggatatttccttgttaataaaattttgtgccataatttacaaattagttcttt

SEQ ID NO: 7091 - DNA, 516 bp, Homo sapiens
  misc_feature (1)...(516): n = g, a, c or t
aaatgtatagggtattaaatacaagcttctaaaattttcagtatctatattggctttctctaacagctctacagcaaagtttgacatgttttttgtgtgtgtcatgtattgtaagttgtaatatctgtaggagtgagttggacattctaaattagcagtaaaaaattcacaattacagctcagcttgtttattcattatagtttccacatttccaacttccaagtgaactttatatatactacagtgaattatagataaatacagccatggtggacctttccctcaatagtgattttttgtacaaacagtataattaaaaggaaaagcttttatattttatgcaaggtaaatgtttcctaaatgtcacaaaagtgatagaaaacatagctttttgggatctggtccagcattagagtttctaattctgagacccaccagcttgtgtttcatcttctttatatcctgtcagaatacatacttaaatcatgtgggtatgngaaagatgttgtttaact

SEQ ID NO: 7092 - DNA, 402 bp, Homo sapiens
  misc_feature (1)...(402): n = g, a, c or t
aaaaatgttttcccncgggtaattntctattatatattttcatatgggcaaagggaaaaaatgataaatcctctgtaatcacaaaccccaatttcgttttgtttattcagcttctaaannattgaacacccagacttttaattcaacctttaagaaccttatcatttatgtttcagtagatatcaaagtaatccatgtttgtgtcaaatgatcatagaaaataaatagaanagacagtgaagcaagtaaaaagaaaagcattgttttaatttgtttgcattaatttttttcatttgtcaaaatgcttcttttgtttgccacagtaaagaacagtttttattgtttngtaagtaaaattacgtancttgattttgtatgtaaagattnatttccataataaaa

SEQ ID NO: 7093 - DNA, 418 bp, Homo sapiens
  misc_feature (1)...(418): n = g, a, c or t
ccattacatcctctnnttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggtttttgaaaataaatattt

SEQ ID NO: 7094 - DNA, 357 bp, Homo sapiens; identical to SEQ ID NO: 6074

SEQ ID NO: 7095 - DNA, 226 bp, Homo sapiens
  misc_feature (1)...(226): n = g, a, c or t
aaataacaaactatncncataaaaaggagcanaaataatatggaatgtttttgacgaaaacaaacttatggattcaataaataatataaaatgcctttgtgctaaaatagaactcttgtttcttatatatatatagttcagtgatctttatgctatccagaaaaagccagatctattataattaaacatagaaaaataccatttaacaataaaactaaaaaaatgg

SEQ ID NO: 7096 - DNA, 254 bp, Homo sapiens
  misc_feature (1)...(254): n = g, a, c or t
aaaatatcttttannggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagttt

SEQ ID NO: 7097 - DNA, 378 bp, Homo sapiens
aaagtatttacccacagaactcataaaaaggtcaatttggtaaaaggacgttttgacccaagagcatctaatatttaagcttattttattggataagcatatctcttgtccatcacaagttatagaaaagttatatacgactaaaagaaaaagttatctactgtaattataggaagttgtcacaacaggaattcagctcaagaacttcttgcaattactgctacaacgtctataaatgggaaaagcaagcattaaaatagattaataaaatataaaattaagactggaaaattccagagacaagctgtatccttagaagaataaatagttaaaattattcagtaagctgacgtatttaaccattactgggcctgtaaa

SEQ ID NO: 7098 - DNA, 120 bp, Homo sapiens
  misc_feature (1)...(120): n = g, a, c or t
aaaatgtgtccctccnttgggagagaatcattttgttctttactaacaataatttgaaaattggtaatttaatatcttgnnaatatgaanntattatggtatagattngcttctaggaga

SEQ ID NO: 7099 - DNA, 397 bp, Homo sapiens
aaatctataatctggttcaagtgcaaatcaggtgctttctgttagtccttccaaaaaaggcatttttaatatttttggcacaaatgaaatgtcatcatgccaacaattctaattacaatacatatatccaaacctttagagtagcaatcatatacatacagtataaaactgagtatttacaaatgtattcagcataaatgtaaccttcgtgggtgaatcagaactcattagccatacccacactaataataattataaaaggtaaatacaattcctttctttcatttgcttatgctggttgttgtgggttgacattcatgtgaggaggatgtcctagaagaccaattctttgtttctgcttcctttgttctgtcatctgatcctttaattccgacag

SEQ ID NO: 7100 - DNA, 421 bp, Homo sapiens
ccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagtttaaatcatgatgtaaaattttag

SEQ ID NO: 7101 - DNA, 556 bp, Homo sapiens
  misc_feature (1)...(556): n = g, a, c or t
ccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcactttcccatctccaactcggaagtaagcccaagagaacaacataaagcaaacaacataaagcacaataaaaatgcaaataaatatttcatttttatttgtaaacgaatacaccaaaaggaggcgctcttaataactcccaatgtaaaaagttttgttttaataaaaaaatttaattattatttcttgccaacaaaatggctagaaaggactgaatagattatatattgccagatgttaatactgnaaacatacttttt

SEQ ID NO: 7102 - DNA, 388 bp, Homo sapiens
  misc_feature (1)...(388): n = g, a, c or t
ctgaagtgtggctnncataaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgttt

SEQ ID NO: 7103 - DNA, 239 bp, Homo sapiens
  misc_feature (1)...(239): n = g, a, c or t
ctttttttttttntnnttttttttttttngagtattgttttattaaccaaaacacaaaaccaaaatgaaaactggcttanaatataaaattctcatttttcaaagtgaaagtttgaanatactanctaaagttgataacttaaatagtggtaaaagtaaataacttanaattatggcagcantcacaagaagaaacagaaaacagggggactagggattcggnggtagacttttacttt

SEQ ID NO: 7104 - DNA, 394 bp, Homo sapiens
aaataactttcttaaccccgcccattaagatcacagtaaacatacaataatttttattatggaaattaatctttacatacaaaatcagctacgtaattttacttacaaaacaataaaaactgttctttactgtggcaacaaaagaagcattttgacaaatgaaaaaaattaatgcaaacaaattaaaacaatgcttttctttttacttgcttcactgtctcttctatttattttccatgatcatttgacacaaacatggattactttgatatctactgaaacataaatgataaggttcttaaaggtttgaattaaaaagtctgggtgttcaatattttagaagctgaataaacaaaacgaaattggggtttgtgattacagaggatttatcatt

SEQ ID NO: 7105 - DNA, 332 bp, Homo sapiens
  misc_feature (1)...(332): n = g, a, c or t
aaatagaaaacagnntattgaaagtggtgggtttgatctttttatttagaaacccacaaaatcagaaacacagtacaaataaaacagaaatcaaactataagttgacctttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttcttt

SEQ ID NO: 7106 - DNA, 408 bp, Homo sapiens
ctgtgcaagaaaaattaaatgaaatagtagatcagataaaaactagaagagaagaagaaaagaaacaaaaagaaaaagaagcagaagaagctgaaaagcaattattccatggtactccagttacaattgagaatttcttaaattggaaagccaagtttgatgcagaactcttggaaattaaaaagaaaaggatgaaagaagaagaacaagcaggaaaaaataaattaagtgggaaacaactatttgaaacagatcataatcttgacacatctgatatccagttcttggaggatgctggaaacaacgtggaggtagatgagtctttgttccaagaaatggatgacttggagctggaggatgatgaagatgatccagactataatcctgctgacccagagagtgactcag

SEQ ID NO: 7107 - DNA, 519 bp, Homo sapiens
aaaaaaagaaaaataaaataaagtgttttgattatttagggctgacttacatttcagtatgtgacaaaaattcaaacccaaatgcatctagctcactcagtttcagacaggtcctatgttcagcccctaaacgaatggcacaatgccaccaattttgggattcctgagtttggttcccttaagttctcagagttttcccaactctcaaaaccaaagcatcatgggagtgacagggccactggcaagactttttgccagtcagcctagttcttcttttaagatgcagtagtctcaaagcttaaagtcagaaaatcttgcaatacaagagtaactgcaagaacatataaagaaggaaaagaaaggacggggtttctagttgctaagatttgccaaacatggctacaaaactggtaaacaaacctttcttgagtgcaaagtccattagcccaacttgccatgaagagatttgaaataaaaatgaacaaatcaatttctgttgtagatacaaagcgaaaaaat

SEQ ID NO: 7108 - DNA, 485 bp, Homo sapiens
aaatgcattcttcacaagtaattcagcatatatttttatatcatgtttacttatgcttaagaattaaagcaagtatatttattactctgatggaaatatgggaaatctctcattcatgcaatatacagggataatattcaagcgaagggaaaattcccgctttttatttttgtaaatgtatccatatataatcatcgacatgacagatgaggaaacccatgaagtttcccactagtcagatatacattttcacttcatcagaagcacctgatatctacagctaatttataattagatactgtttcaatgaaaccaaaatgagccctacaagttcctataaacaaaagcttccaatgtactaggacagtcagtaattaatgcatcattcagaggattatggctgttccttaagaagtgcaagttcaaacctgtcaacaccagaggtaatcattttatattaatttatacgtaataccatttacctg

SEQ ID NO: 7109 - DNA, 452 bp, Homo sapiens
  misc_feature (1)...(452): n = g, a, c or t
aaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgtagctgattttgtatgtaaagattaatttccataataaaaattattgtatgttttactgngatcttaatgggcagggttaagaaagttattt

SEQ ID NO: 7110 - DNA, 500 bp, Homo sapiens
  misc_feature (1)...(500): n = g, a, c or t
cccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtanaaagaaacttgtaactctgtaggcctcttacatcacctttattatacagcatgaaaaaccataacttttttttaaggacaaaagttgttgccttcctaaagaaccttctttaataaantcatttt

SEQ ID NO: 7111 - DNA, 509 bp, Homo sapiens
aaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattatttttattatgaaacttgtgtaaatacaatttttgtttctgtacttt

SEQ ID NO: 7112 - DNA, 328 bp, Homo sapiens
aatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtacaaaagttactattgctcataatgacttacaggctaaaattagtttt

SEQ ID NO: 7113 - DNA, 280 bp, Homo sapiens
gtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggttttggacttgggaacaggactttataccttcttttactgtaacaagt

SEQ ID NO: 7114 - DNA, 244 bp, Homo sapiens
  misc_feature (1)...(244): n = g, a, c or t
tgcactcaaagcttnntaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaact

SEQ ID NO: 7115 - DNA, 484 bp, Homo sapiens
  misc_feature (1)...(484): n = g, a, c or t
aaattgttctcaaaattagggaaataaaagagaatgaaattgtggcaacttttttccctcctagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaattatttcagcgtttgcattacttcatggttccatggatttccagggtggcattccgagtgttgctttgaaagcagtttttttttctatttattgtanagtgtatgaaggatatagaacaatcttacagaaatttcttgtcgcttgttgctaacaaaattagtatatggtaaaggtcaggtattcataatttgaagttaaagaagttttcattttgtgatctgtatataaattctttttt

SEQ ID NO: 7116 - DNA, 292 bp, Homo sapiens
caggtaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaatttttt

SEQ ID NO: 7117 - DNA, 352 bp, Homo sapiens
ctgtaaggaggcggcagacggctaccagtgctgtatgatggcgcagtacaaccggcacgacagccccgaagatgtgaagcgacgagccatggccgaccctgaggtgcagcagatcatgagtgacccagtcatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaagg

SEQ ID NO: 7118 - DNA, 237 bp, Homo sapiens
  misc_feature (1)...(237): n = g, a, c or t
aaaaaattaactacnaaaagcttttatatttaagaactgnnagtgtttcaaaactatgctgttttgtgttgttatagttgtaacatatttctcaattttcctgtttttcttttagtttattgacaagactacctggtcggcctaaattcacattttcattcacgctttttgggcatttgagatcaaagagtaagtatggtttctacaagntacttcattnttctacttattcttttt

SEQ ID NO: 7119 - DNA, 396 bp, Homo sapiens; identical to SEQ ID NO: 6096

SEQ ID NO: 7120 - DNA, 436 bp, Homo sapiens
  misc_feature (1)...(436): n = g, a, c or t
tttttttttttnnttnttttttttttttatggaaggttctcaggtctttatttgctctctcaaattccaggaattgacttatttaattaatccatcaacctctcatagcaaatatttganaaaacaaatttatattcanattcttattttcagtagggaagtaanaagttgcagctcagtgcacataaagttganacagagatggagacatccagccccacctntntggaacaagaaagatgactggggaggaaacacaggtcagcatgggaacaggggtcacagnggacacaagggtgggctgnctntccacctcctcacattatgctaacagggacgcanacacattcaggtgcctttgcanaaagagatgccagaggctcttgaagtcacaaaggggaggcgtgaanaaatcctgcatntnagtccctcacaa

SEQ ID NO: 7121 - DNA, 497 bp, Homo sapiens
  misc_feature (1)...(497): n = g, a, c or t
tataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgctaaaagaatattctttantattttctctcatactaaggggttaatatggaatgtgtttgaaattgcaaattgaataattgtccaggntttttttttataccttgctaaattangttcctcttttaatctagngatangatacnngtgatgccagtgatgacagcttttnannagccaaggatannctganttggaaataangctgaaatgaatacatgactgggaataatggggactg

SEQ ID NO: 7122 - DNA, 131 bp, Homo sapiens
  misc_feature (1)...(131): n = g, a, c or t
ttactaaatatttaggagatnncagtgcattnngggttgttttttttttatataatnnatacatatcnnccctttgcagtgatagcatanaagagtaagtatggccttaggtacaacacgttttttacctg

SEQ ID NO: 7123 - DNA, 388 bp, Homo sapiens
ctgaagtgtggcttgcataaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgttt

SEQ ID NO: 7124 - DNA, 308 bp, Homo sapiens
  misc_feature (1)...(308): n = g, a, c or t
ccatttaccagactccnacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcattt

SEQ ID NO: 7125 - DNA, 146 bp, Homo sapiens
  misc_feature (1)...(146): n = g, a, c or t
aaaaaaattaaatacncttaatttactaaatatttaggagataacagtgcattaagggtttttttttttatataatacatacatatcacccctttgcagtgatagcatagaagagtaagtatggccttaggtacaacacgtttttt

SEQ ID NO: 7126 - DNA, 318 bp, Homo sapiens
aaagaaaccaccaccaacaacaaaacaaccaaaaaccatgttttatgtcaaagctctgtagcacagagaatgtggtgtcacagatacatcgccgagagaggtttctttctttcttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttgg

SEQ ID NO: 7127 - DNA, 382 bp, Homo sapiens
aaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagcaaaaaaaaaaaaaaaa

SEQ ID NO: 7128 - DNA, 559 bp, Homo sapiens
ggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagatttt

SEQ ID NO: 7129 - DNA, 374 bp, Homo sapiens
  misc_feature (1)...(374): n = g, a, c or t
aaaggttattcactatatgaaaacagaaagggaacaattacaacaatgaaattgttttaacttttttaaatctgattctaatgtgtattgacatatatttaattatataaaagactgtgggaaaggggcattaacagtactctagaagagtaaaggataaaaatccctctttttcccctagcttccagtttgacaagagggaatacttaatcgaatcctgtccacaaaaacagctaacagtactgtgctttgaaaaaaaaaaaaaaaancaaacctgacttcatataattcttaatacatcctgtgctgctgttggtttttttaanacttctagcagtagctataggttccggtctggcactttaggtattttt

SEQ ID NO: 7130 - DNA, 53 bp, Homo sapiens
aaaaaaaaaaaaaaaaaaaaaaaaaaaaaaaaaaaaaaaaaaaaaaaaaaaaa

SEQ ID NO: 7131 - DNA, 317 bp, Homo sapiens; identical to SEQ ID NO: 6103

SEQ ID NO: 7132 - DNA, 115 bp, Homo sapiens
  misc_feature (1)...(115): n = g, a, c or t
ccacttgtgtgngtcctnacaagcaaagagagcactaaacttgacattgggggtccaccactccaactttgctttctganngttntggtgtacattganccccanaaggaaagga

SEQ ID NO: 7133 - DNA, 212 bp, Homo sapiens
  misc_feature (1)...(212): n = g, a, c or t
ccaggctgcactgnngctagctcaatgtttgttgcattcagcttctcctccattacttgtttgaggatgatgagtgaagacttgatggcttctttcaaagtcatanncttgtggtaaacttcttgcaaggagctctgggcaccctctgaagcanagccaattgctcgagcatnncactgtacaaaggtcccanatgggtccatatgaaacag

SEQ ID NO: 7134 - DNA, 388 bp, Homo sapiens
ctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgttt

SEQ ID NO: 7135 - DNA, 383 bp, Homo sapiens
ccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaattt

SEQ ID NO: 7136 - DNA, 263 bp, Homo sapiens
ccactgtctgcagcatgggcagaaagtgctcaaagtccagcaccttcacattcatctcatcactcttggggttccccaggaccttgagcacctcggcgttggtagggttctggcccagggccctcatcacatccccacactggctgtacaggatcttgccatcacctgttcggtcaaacagctggaaggcctccttgaactctgcggtctggtcttcggtgaagtcacacatcttgactgctcagctctccgggaccttttcc

SEQ ID NO: 7137 - DNA, 242 bp, Homo sapiens
ccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcagg

SEQ ID NO: 7138 - DNA, 551 bp, Homo sapiens
aaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaaagagttaatttgttccttttcttcagtgggccattg

SEQ ID NO: 7139 - DNA, 527 bp, Homo sapiens
aaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgct

SEQ ID NO: 7140 - DNA, 363 bp, Homo sapiens
  misc_feature (1)...(363): n = g, a, c or t
ctgttctcatacagancgnaaatcannacgaaatatggaaaacatttatttcctttccttcaaaatttaacttacattccactttaatagctgttgaaggttaattaaaatgcagcaaagtataactacgttacgcangtgacttcagttattttaatgtnannaaaatcagactatggtatcttacgagtcattatagaaatgtncatcattaaaaagcatttattatggcactgaactgcatgatgttaccttaagtcatnnacaaaanaattcctggtccatgtgatgtgaatgggcttggcactttctccataaattttgtagatgactattngtaagattatacacttaataggtttt

SEQ ID NO: 7141 - DNA, 526 bp, Homo sapiens
taacagtaaaaaaattaaagagcgttcaagaataaattcttctggtgaaagtggtgatgaatcagatgaatttttgcaatctagaaaaggacagaaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagacctgcccgggcggccgcccgggcaggtccaagaagcatgctggcgagcgcgataagaagctggcggccaagaaaaagacggacaagaagcgggcgctgcggcggctgtagtgggctctct

SEQ ID NO: 7142 - DNA, 437 bp, Homo sapiens; identical to SEQ ID NO: 345
  misc_feature (1)...(437): n = g, a, c or t

SEQ ID NO: 7143 - DNA, 327 bp, Homo sapiens
aaaaaaagaaaacaactgcgaaaaaaaagtaggctatgtatcttaagcatataaacatttgaccctttcttaaaaggtgccacaggtaatactaatctattttctatgtggaaagtgtttatgaatacagaaccaatttaggcaaaatgagatgcaaattattctagatgtaaagagttgaattttttttttaaagtacacagttttaacatactatccactctatcaagcagacttagagggattccggaaggcagagctttcagtaaccttctaaaaaattattcaatattattacacagaatcagagattgctgtgatttttat

SEQ ID NO: 7144 - DNA, 547 bp, Homo sapiens
ctgctgacagttctttggtggaaaagtaagttgcgtacttacccaagctgcccaaatgattatcaagccaagtttgtttttcaaaaataggttttaagatacaccaaagaaactatacaatacaaaaatttaacaatgaagttaaagtatatagcaaaagccaaatatgacaacacacatgtataatgtagaaaagaatcctttcagtcctagaaaactaaaatggggagaacttactgaagggtaacatacataaaatgagtactaatagcaaggaataatcctaaacattttcccaataaactgactaagcctcaaaaggacagcttaggaaaatgattaacatgcagtttttcttttttcctagccaattcagttctacttagataaatctggttgccaatcaatacatatataaattaatttttttctgctcaattactaccattttttctttttcaccttttccccaattttctctagcaacactttttcctttggtttgatcagttgaactcaaaaggtttggtacctaaaatgagtatca

SEQ ID NO: 7145 - DNA, 228 bp, Homo sapiens
ctgcttgcctgcaaagatgagcctctgctggtcgggggggatgccttctttatcttggatcttggccttcacattttcgatggtgtcactgggctccacctccagagtgatggtcttgccggtcagggtcttcacgaagatctgcataccacctctcagacgcaggaccaggtgcagggtcgactccttctggatgttgtagtcagaaagagtgcggccatcttccag

SEQ ID NO: 7146 - DNA, 404 bp, Homo sapiens
  misc_feature (1)...(404): n = g, a, c or t
aaattttctcacttangacttttcaaagccatctcaaaggagcttcctcaaaacatttaatgttggcatcaccccacaagtactcagaaataagtgttaaaatagaaatccaatccagtaatgggaaactgacttagattatcttatttgtttgtatatttatttgtcatctatctctcttattcactgccctattttcaacatctacaatagtgcttagtaatgaatacacatgcagtacacaaaggtgctaacacaatacatgactaatgatgagggctatgcacatttatacagaatgagaattatttagtccaaaaaatatctggaaagcataaatgctgtaattggataaagctaaaattctattactctattgaaatcagatatcaagtgatactttt

SEQ ID NO: 7147 - DNA, 267 bp, Homo sapiens
aaattacaaagtaataaaaagctttgctatttaattaaaaaaaaaaaaggaaaaaggggaaacagaggtaaataaattaggaaaacacacacacggagaaaacaaacaaaaataaaataaaataaaaacaaaaaggtgttaactaggaaggatgggttaatccaaaacccagccctgactccaggctcctcctcagaaaggtggaaccagggagaggggggaccccaggtgactgtcaggaccagggaagtaatttataactcagag

SEQ ID NO: 7148 - DNA, 492 bp, Homo sapiens
  misc_feature (1)...(492): n = g, a, c or t
aaatggtattacnnataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttt

SEQ ID NO: 7149 - DNA, 342 bp, Homo sapiens
aaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagttt

SEQ ID NO: 7150 - DNA, 363 bp, Homo sapiens
  misc_feature (1)...(363): n = g, a, c or t
aaagttacagagtgtttcctagatagaagattagttcatttggttcattttgtctttgaagcaagccaagctcatgagccagttggttatttgtcataaatgaacacccatcactatatgctatgttgaggggaggcaagtctgatcttcgaataattgataaagtttaatatctttgtagccaaaatacaatttgcaaaccctaactccagatgtgtcgtatgaatcttgacaaccaggtcttgagatttgttttactgattgccaatcaggtatattatttgtgatgttcgtgggagcatgcaaattagaagacagtgttgtgggagttcctcantattgaattacatgtgtgcactcagg

SEQ ID NO: 7151 - DNA, 297 bp, Homo sapiens
ctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatgacattggggcatgtgattgtgttgcttcagcaagagtgg

SEQ ID NO: 7152 - DNA, 334 bp, Homo sapiens
  misc_feature (1)...(334): n = g, a, c or t
aaaagatttacatgttcntatacaatttataaagttaaaaattctctgtacaaaatcttacatgtacagagtttatataagccccattcttatggctgtatcaccacacagatttgcttaaaactataatactacaaacactcgggttcttcatattcaatcttggcacccatatagcaatacactattctgaaatgtaaattacaaaggaaataaaatgtaatcatgcagacattttttaatataagaaaatgcnataaaatatactacaccagancaacatttatcaattccatagatactgagttttnaacttactgcactgttttcatat

SEQ ID NO: 7153 - DNA, 304 bp, Homo sapiens
  misc_feature (1)...(304): n = g, a, c or t
aaaaatacaaattnnancaaaatattaagaatttttaggatgggaattataaaagtcaacgctgaacaaaattctacttttagatagtatgtatcttaaaatattatgaaaaatattctttattctgaaaacaatgtcaggaaagaatacctgagttctctaaaaccactagttctaatttcaaattgctgttttggtaacataaagaaaacacatttacaatttaacactgcagttacctgtcaaataattagaatagaataaatgttgcatatacattaggttgaacattatatatattttt

SEQ ID NO: 7154 - DNA, 402 bp, Homo sapiens
aaaaagccaacactttgccaagcttgttatatcttattatttcttgattctctttgagtaaaaagcccaaatgactgtatggaagagagatgaatggtagaggagagaggaaacacaggttctctaatgtactaaatcaggactttggcaaggaagttataaaaatataatatattcaaatcagtaacttcataatttattagacatcccatttattagaactctaagttcttttgcttttatataaatgaaacatttattctataaatagaaatgtatttttcagaattttctttgggttggtttcttggtagcatctcccagtaatacatgaataacatactgaaaccatgatacaatgtttaggtagatatacatatacatatgtggtcatgtgttttt

SEQ ID NO: 7155 - DNA, 346 bp, Homo sapiens
  misc_feature (1)...(346): n = g, a, c or t
cctgagcgtcaatcatatgttgcagttagtatacaactgactaaaacaagcaagcagagaaaagcatcagccttccanagttactgtctgcttaaggcagaaacagcagtaaataatgaggaaaatgaattanctccagtgctggaacaactaactaacttggtgttacctgnaagtgaaaactcaagtgtcanatgaagggaggnggagttatnctnttatagtacagtggcctgntatctttttaatgaatatatacaagccaacatccaatttctattattacaattagggngtcttgngagctgtgttatgnnaatatggaggaagaaaactatattggctg

SEQ ID NO: 7156 - DNA, 201 bp, Homo sapiens
  misc_feature (1)...(201): n = g, a, c or t
ggagaagacagannataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatct

SEQ ID NO: 7157 - DNA, 559 bp, Homo sapiens
aaatggacttttctgtaagaatgtaaaactcaaaaatttgtcaagtatgtatctgatccacacaagtccctagaaaggttttctgtgtagtcttcattaacgcaaatctttgtgaatgtttcactcttactgtaggatcttgaatatgttttacaataatgaagctacaaagtttttatgcagtgcattcattgtaaactataaataacatttgtattaaaaggaaagctgggtaatacaaaaataggagagactctgaggagcaggcaatctgttgaggctcagtatatcttatttgctttgtagtctgctgtcattcctttcaaagagcacacagcacatgaggcatagtaatcatctgtcttgttaacctctctaatttagaaatctgttgttcgtaaaactggaccaattatcacaaactatcatttgcataattaaccgcaagtctgttacaaagcattttgttagtggtatcaacaaatgcaggaggatggacatttataaaaaatgggttttgttaagcttgccaactccttagatatcatggactatactg

SEQ ID NO: 7158 - DNA, 286 bp, Homo sapiens
  misc_feature (1)...(286): n = g, a, c or t
gtacaagcttttttttttttttttttttttttttcaggccanaccanaacatttttattggtttagtcacttaggcatgctaaggtccccctgggttaggganatttcanccgtgagtgtgcaggtgtgcatgcacatagggggatatntattgggatgcaaanaggtganagcagntcttnaaaancgctggcaaaanaanaatgngtnttgaaaccatgacgggttanaagctcctaactccacttccagggctgccttcanaaatcctttntnttgaccatgg

SEQ ID NO: 7159 - DNA, 485 bp, Homo sapiens
  misc_feature (1)...(485): n = g, a, c or t
aaatatagcattcanattgtaattggtatgtttttgccatctggtccactcaattgtatatttttattttgcaaaacaacccaaaacttactttacgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcactttttgaagcatgttaataaatgtcactgattaaaaacagacctgc

SEQ ID NO: 7160 - DNA, 291 bp, Homo sapiens
  misc_feature (1)...(291): n = g, a, c or t
aaaattgtttnngtcttttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataattttttt

SEQ ID NO: 7161 - DNA, 315 bp, Homo sapiens
  misc_feature (1)...(315): n = g, a, c or t
aaaactgtggattnttttttaagttacagaaaatccagttctgcaccacaatacaactgtaaaaaaatctgcatcatcttaaaactgtgcagtaatgccatttttataactgcataaattttattagcgttctaaacagttttgcaattnttttttgtattatatgcttgcaggttatatcttagtgcaattcagtcccaaatactttaattttgaaaagaaaaaaaaacatacatttttgagtgtaaaatacccctacaagatataaacaggggcgttttcccctcttaatactttggttttcaatacagtcag

SEQ ID NO: 7162 - DNA, 423 bp, Homo sapiens
  misc_feature (1)...(423): n = g, a, c or t
ctggcaacttanacgnngggagcanagaattcnnttatccaacatcaacatcttggtcagatttgaactcttcaatctcttgcactcaaagcttgttaagatagttaagcgtgcataagttaacttccaatttacatactctgcttagagtgcaagagattgaagaattctcttatccaacatcaacatcttggtcagatttgaactcttcaatctcttgcactcaaagcttgttaagatagttaagcgtgcataagttaacttccaatttacatactctgcttanaatttgggggaaaatttagaaatatnntggacaggattattggnaatttgtctatanngaatgaaacattttgtcatataagattcatatttacttcttatacatttcgataaagnaaggcatggttgtggntaatc

SEQ ID NO: 7163 - DNA, 321 bp, Homo sapiens
  misc_feature (1)...(321): n = g, a, c or t
tcttaatatccttccctataatttcaattatttggattaatnntagaaatnnaataggtttattctaaaattaatccaaataattgaaattatagggaaggatattaagaagagaaaagattacaagacagaggaaagcataaaagaaaataaggtaattaaaacttcaaatcaggaaaaaggttctcaaaaatctgactttgcctacccaggtacagttggtggctatcaaattaggactcagtaattacttgtgtcactgagtgaaagctgctcattgctgccnagaacctacagagaaggccaaggggctgacgtaca

SEQ ID NO: 7164 - DNA, 417 bp, Homo sapiens
aaatatttattttcaaaacccctaaaacactggagtatgcttcacctagaaacagattacaggacgaatagctataatgaataagcaatacaatttgtatttgggatgcaattgtgttgtaaagtttcaaataatcaatttataaatttgttgcttttacttttacaaaaatattcatttaacccataacatgagttgcaaaattatctccagacttctacagatgattataaactgtaattgtgtttcagttacacagcaggtgaaaaatttaactgaaccgttacttcaaaatacaatgcattaaaaataattgttacaatataggcaccaataaaaagaattttcttggcatacaacaccacaacaactttctcaagtatctgtattatgtaaattaaaaagaggatgtaatgg

SEQ ID NO: 7165 - DNA, 545 bp, Homo sapiens
ctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggattttttttaagtaactttatatcagaaatgatactgcatctttatattttt

SEQ ID NO: 7166 - DNA, 379 bp, Homo sapiens; identical to SEQ ID NO: 4720

SEQ ID NO: 7167 - DNA, 498 bp, Homo sapiens
  misc_feature (1)...(498): n = g, a, c or t
cccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtggcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaangacaaaagttgttgccttcctaagaaccttctttaataaactcatttt

SEQ ID NO: 7168 - DNA, 384 bp, Homo sapiens
  misc_feature (1)...(384): n = g, a, c or t
aaaacattgntttctaaacactaacaaaaaaaattaagggcaaactgaaaatacaaatgagatttacaggcactgtgtgtagaatgtgcaaaaattcacttagcttttcttttgtttttttggtgttgctttaagaaactttatcaaatatatttcttacaaatataaagctttctctcccaattgaaggcaattaaaaaaattcaaagtttatcaatactcagtacacaggtgaaccagtcaaattcattttctttctggaaaagaataacaaaccaatatttaggatgttcagagactcaacaaaaaccattctagaaatcacccagaacaattgttttctgttgccaaagccttttgttcttcaaaagtcaccatccacca

SEQ ID NO: 7169 - DNA, 509 bp, Homo sapiens
cacaatttttaacgcttatgtagtccgccatcaaaacatcaatgtactgaagattttaagcagcatgaggcaccatcacgtttttgtttcttccccctcatttccccgcccctaccagatctgtttttgatgtttagcctagaagtagcaagaaggatgaactgaagcagattagagatcgagctggtaatccagatgagaaataatgaaagtcttctctagggtaatagtggtgaggtaaaggcaaaaggatagctgacagacgttaggaggtgaaatggcacaggacttggtgaaaaactggttaggagaagaggaaagagaaaagcccaggttatcctcagatttatggtttggacaacaggaagaatagcaatttctccaagtcgagtcctattataaatattttcatttttgtattttcacttttgagtctcaatttaccaagataacttcctttcaatcagcaaaacacctgtttactacttactaacaatattaaagatgca

SEQ ID NO: 7170 - DNA, 515 bp, Homo sapiens
  misc_feature (1)...(515): n = g, a, c or t
cagaggcaactgtnccncgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttntggatgggagaatggcgtgtggaaaatggaatctatattcagaaaagttgaaacagactggcacatggtatatttggcccgaaaggaaggatcatcttttgcttatatttcctggaagtttgantgtgggtcagntttggcctaaaagtagatagcatttntattagaacaantagntcanacttttcagacttggaacagtngaatggaaattgcgatctgataca

SEQ ID NO: 7171 - DNA, 205 bp, Homo sapiens
gaaggaaagaacttgcatgttggtgaaggaagaagtggggtggaagaagtggggtgggacgacagtgaaatctagagtaaaatcaagctggcccaaggtgtcctgcaggctgtaatgcagtttaatcagagtgccattttttttttgttcaaatgattttaattattggaatgcacaatttttttaatatgcaaataaaaagttt

SEQ ID NO: 7172 - DNA, 460 bp, Homo sapiens
  misc_feature (1)...(460): n = g, a, c or t
ggcagtggtaccatgttttgttctcccatataaacatcacacatccaaaacatggtaccactgccgtaaatggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaaganggtaatttttaggatgtgtattatttcagttttgtatgtttaactttttattaaataaagtgttttt

SEQ ID NO: 7173 - DNA, 361 bp, Homo sapiens
aaacagatcaactcaatagttaacgttatataataaagaatatggtaattttaatgacaaaaatcgtattgtgaaatagcgcactctatactgagatgaatgaggggaaaaaagtcaaaactcctttcaaaactatattcaaagcatcagaaaaaatttttttttctttttacaaagttatgtataagtcatagggaccaccaaatactgaaatatgaagactctatgaccaaagttcaaaactgattttaaggaactgtgtgaagcaagacaggaaaatttgtatttaacactctatagaacttcacagtaaagctggaatttagagactaatggcttaacaggagtactgccaacaagg

SEQ ID NO: 7174 - DNA, 417 bp, Homo sapiens; identical to SEQ ID NO: 4827

SEQ ID NO: 7175 - DNA, 365 bp, Homo sapiens
  misc_feature (1)...(365): n = g, a, c or t
cgtttatctcgnnctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattca

SEQ ID NO: 7176 - DNA, 577 bp, Homo sapiens
tttggattttatttgagccaaaatatatatacttaattttagttatgccagaagtaagtataatttctcagtccaaggatgttaggaagcaacttacagagcatgcttcaaatagaattctcttggcctttgaaggtaactattttcaaacttaatagtagagtcaagcaagaatggacaattagagttttcaaaattgaaaaatattatgtattttatataatcattacctatggtttacagattttatttttatgatacatatctctaagtagtggtacactgaggacatagcaaatatgcaataaatacttattaagctgaagtgaactaacaaaaaccattaattacaccatttctaacaaccaaaccagctattgcttttcagtgttttggtgatacgttggagtaggaagtcatattcaaattggttagatccttggaagaaatagtagtatttgtttttagagtagaagactgcatcaattttaggcccgattccttggaagttcttggtaatcagtttgggataaccagggtccatcatctgtctcctttcatcatacctccaatactg

SEQ ID NO: 7177 - DNA, 571 bp, Homo sapiens
  misc_feature (1)...(571): n = g, a, c or t
aaagaacttttgcnctgtgctgaaaatgaaatatctcttgcagtaagtaatacaatgtgccaattcataaaatgtaagttaacaggtttctcaatttaacattttcaaagacgatattaaggtcaaaaatgtcacatctatggtagcacatatagaagggcattatagatatgatgtccatccctatgaagcttacaaatttgacaatgctcaataaaagcttttagaatcacatccaatagtgtcacagtcaaagaatcacaaatctgtgtcctgtaagttctctccttctaaaatcttcatgttaacttttctactcattgccatttgttaatactaacccttaaaaaaaagaaataggaaaagaaaggctgcaataaacttgatcaggtacagaaattattgctactatacttcactacaaagcttgtctatacagtatcatatgacctttgattatgaaaaaatcagaataaaaatctttagtgacataagccttacaatcntatacaacattcacatggcantattagacagttnagcacccaatacccatagttgacaaaatgtc

SEQ ID NO: 7178 - DNA, 399 bp, Homo sapiens
  misc_feature (1)...(399): n = g, a, c or t
aaagcactaatnnattgcagtctttattttagaaaaatgtgaagcatttttttctcccctaaaatgaatatatttagatgacaagtctttagtgctggtagaggaactaattgattttgtactatagtannaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaattt

SEQ ID NO: 7179 - DNA, 198 bp, Homo sapiens
  misc_feature (1)...(198): n = g, a, c or t
aaattattancnncttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttca

SEQ ID NO: 7180 - DNA, 357 bp, Homo sapiens
ccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacattt

SEQ ID NO: 7181 - DNA, 342 bp, Homo sapiens
  misc_feature (1)...(342): n = g, a, c or t
ccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaannggacacacttcttgacctnctaccaggaactttggtaaaagctagctttggggaaggggttgggtgtaaatatgagagggtggagggagacca

SEQ ID NO: 7182 - DNA, 451 bp, Homo sapiens; identical to SEQ ID NO: 2871

SEQ ID NO: 7183 - DNA, 298 bp, Homo sapiens
aaaggcttaatggcaataatcaggggaggaagaagagtatgtttattttacataactgacggaaaaataaattcaacaaatagtaaatagaatttaatatggtctcatgcgccctgaaggaggtggtgcccgatttggaggggtaattgctatgtccaagtaatctcctatctggaacttctgcgactgcagggtcatggaatcatcagtcccctttctgccagacatggtgctgccaatctccttaactcgatagccaggtcttttaacatctgtaaaaacgattgcaaaattgaag

SEQ ID NO: 7184 - DNA, 540 bp, Homo sapiens
ccaacatggtgaaactctgtctccaaaaatacaaaaattagctgggtgtggtggtgtgcacttgtggtcccaggtacttgggaggctgaggcaggagaattgcttgaacctgggaggtggaggttgcggtgagccgagatcgcaccactgcactccagcctggtgatagtgcaaaactccgtctaaaaaaaaaaaaaataataataataataaaaacaagtcctaagaaaaatgcccaggtgctttctggcatggtgatttgcaccacatagaactaaagacgatgtcagaccaagcttcttcctttctctctccccgcataggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagccaaaaggagtggtgtggcgtacattgcggctccctccggttctgctgctgacaaagttgtgattgagg

SEQ ID NO: 7185 - DNA, 335 bp, Homo sapiens
gagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctca

SEQ ID NO: 7186 - DNA, 345 bp, Homo sapiens
  misc_feature (1)...(345): n = g, a, c or t
aaatattttggncntattttataataaaatattttggcaaaaataaaatataaggtttagtttattttctattaatggtagatctggagagtattttacatttctaaatagtatctacttaatttgactgctttcacatttgtttctgaaaacactgctattcgcttttcagaattttgagattaaaagcacctaaaaataagataaaataaaatttaagtaaaatatttgtttgatgctcgaaagttgacaaattcacaaacttactttaagtgtcttacatgatatatgccaccacagaaactttattgcctgctaagacttatttgactaaatctaatcttt

SEQ ID NO: 7187 - DNA, 226 bp, Homo sapiens; identical to SEQ ID NO: 6075

SEQ ID NO: 7188 - DNA, 405 bp, Homo sapiens
  misc_feature (1)...(405): n = g, a, c or t
aaaaatctggntataaaaaaagtaataacctaattttttattaaaaaagaaaaaagaatttttaccaaaacttcaatatagaagtgaatgtgcttagaatggtaatagaggatctaacttttaaccaggctatcaacttctggaatatttactttcaatttggaaaaatattgttattcagaacctgaaatacattataaaactggaaatggaatcttttaggtgaattctttctttcaaaccctcataaatcagaaaaaataagccaaatttgaaggcaaaagatctttacatttagggatagtttctaatgaaagaaatcaagataagaaaaatcaattaaaacaatgtggtttaagaaattatcctcctaatgtagggggtgggaaacagatattacatttt

SEQ ID NO: 7189 - DNA, 581 bp, Homo sapiens
  misc_feature (1)...(581): n = g, a, c or t
cctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccaaccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcangctaaaaaaaaaaaaaaaaaacagtttctaaaaatttttttt

SEQ ID NO: 7190 - DNA, 410 bp, Homo sapiens
  misc_feature (1)...(410): n = g, a, c or t
aaaaactatttgnaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttnnctataacttgtgatggacaagagatatgcttatccaataaaataagcttaaatattagatgctcttgggtcaaaatgtccttttaccaaattgacctttttatgagttctttgggtaaatacttt

SEQ ID NO: 7191 - DNA, 181 bp, Homo sapiens
  misc_feature (1)...(181): n = g, a, c or t
aaaaatgtccccnaaaattgcaattcctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtg

SEQ ID NO: 7192 - DNA, 562 bp, Homo sapiens
  misc_feature (1)...(562): n = g, a, c or t
aaaagattgtagatgacattggaatctaatttccgtatttgggtgctttcctagtattgtaagaatatgcttaattaatgagtcgcaatgaataatctgtttgtcttgatttgctttctgaaaggtgatgagggttttgggaaatggactttgttcaggcttttgccctttgtggctgtgacatattaagatgttggcagtaaaattgagagccaccagaagatgttaactgtgtatatgggcgctgccagataggaaatccaaatgagtagactatagtgttattgttagctactatggggtgagacgtagacagataaccatatgtaaggcagctccctaaatgctgaaacaaagaaccgtctcttgacttactcctgatgttctcatggtacatggtagctgccccaaaagcttgcaattaattgaaacttctcatttgttaggtggcaggtangtaggttttgaacttggtagtgatattcagacgangagcaagattccactggcagttctgtgatgctaagtnaatgatgtgatcatatccgtgctttagaaagat

SEQ ID NO: 7193 - DNA, 501 bp, Homo sapiens
aaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgcgaatatttgtaaaaataatgaatggactcatcttagttctgtatataaatatattttctttctagtttgtttagttaaggtgtgcagtgtttttcctgtgtattaaacctttccattttacgttttagaaaattttatgtatttt

SEQ ID NO: 7194 - DNA, 422 bp, Homo sapiens
cgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaacaaaa

SEQ ID NO: 7195 - DNA, 460 bp, Homo sapiens
  misc_feature (1)...(460): n = g, a, c or t
atgagttcttatctancgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatncagtcaccaagaatgttttgagttttttgaaagacccccaatttaagccttgccttattttt

SEQ ID NO: 7196 - DNA, 423 bp, Homo sapiens
aaatcatatttcattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgtttt

SEQ ID NO: 7197 - DNA, 585 bp, Homo sapiens
aaaaataaagaaaaaaataccacgactctttgctaatggcttttaagatttgcagacacagctaaatactcatctaacaaagtatccaggctatccaactatattgccatgaattcataagacagtaacacacatttataatataaaagtagtcaaaaaaataaaaagaaacagccacaggtaatttagggctaaaatgagtcctaataagggttacatgagaaataacatataagaccccaaataaattttagatacaaaattaaatgatgtggctttgttcaaacatacctaaaattcaaaatcaagttaaatacctaggctggcttttttatatcaccagctttcattagggctttaatcgctcttgccctcatctcaagttctagcagctccagttgctgtgcagaaggttgaacatcttctggtggaggaacagccagggtggctgctttgggttcgtttgggctagactctgccagtcctagaatctcattcacacttttctcaatgtctttctccaggtcatctatctgaccagcttcactttggactgtattttctggtgcctcgggagcagacctc

SEQ ID NO: 7198 - DNA, 146 bp, Homo sapiens
  misc_feature (1)...(146): n = g, a, c or t
aaaaaaattaannccctattaatttactaaatatttaggagataacagtgcattaagggttttttttttatataatacatacatatcacccctttgcagtgatagcatagaagagtaagtatggccttaggtacaacacgtttttt

SEQ ID NO: 7199 - DNA, 603 bp, Homo sapiens
  misc_feature (1)...(603): n = g, a, c or t
aatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcangaatagttgcagtatttacacagcagcatttcttctcaggcttttattgggtgctgttgcttgctatgtatgaagagaaatgtgtcagacaagttttagtgtgttctgaagaagggtgtgaacaacagtgttcatgggcttttaga

SEQ ID NO: 7200 - DNA, 399 bp, Homo sapiens
cctgtccctgcagacatgagagacagcaggtctcatgggggtgacaagctttttttttttttcttaaagaattttcaaaatcaaattccagaatgattttacggagatatcccaggaaaattaaggcttctcttaaacgctaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgttttt

SEQ ID NO: 7201 - DNA, 402 bp, Homo sapiens
cctgtccctgcagacatgagagacagcaggtctcatgggggtgacaagcttttttttttttttttcttaaagaattttcaaaatcaaattccagaatgattttacggagatatcctaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacactgagtggcccttcatgtacatccatggtgtgctggcttaaaatgtaattaatcttgtaaatatactcctagtaatttaagattttgttttt

SEQ ID NO: 7202 - DNA, 417 bp, Homo sapiens
  misc_feature (1)...(417): n = g, a, c or t
ccattacatcctctttttaatttacataatacagatacttgagaaagttgttgtggtgttgtatgccaagaaaattctttttattggtgcctatattgtaacaattatttttaatgcattgtattttgaagtaacggttcagnnaaatttttcacctgctgagtaactganacacaattacagtttataancatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatattt

SEQ ID NO: 7203 - DNA, 361 bp, Homo sapiens
ccacattgatgataatttctagaactagtttctgagattgtcagccctttgtctaaaataatggcagtattaatgattgacttctgtcactgccatagttacctggattgtcagccttggtagcctttgtctaaagtcctaaagagttccaaaaaaaatgtgttgaaatttaattgctaaatagtggttggtgattctttacagtaggaattgtaataattttcttgcaaataagttatttactgctattgatattgaataatttgtcttttattcagatatatttcaaaaagcatgaatatatgattattcataaattgtatactttaccagtaagttttcagaggaaataaagactttt

SEQ ID NO: 7204 - DNA, 582 bp, Homo sapiens
aaataaactagttacttgcactttacctgctggcttttccatttggtagataacattctgaactccagcagagttttataatccccacgtgcttaaatatactaaatgttctttttccattaaggttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggttaagtaaatgtatggtttatgttccagtgtctgtatgatcaagttgtagatgaatttgcatgattacttagttaatagagaattggtgatctggttcaagtagggaattattgaggacagttagcagtattaacagtgggttattattgagctga

SEQ ID NO: 7205 - DNA, 385 bp, Homo sapiens
ccattttaattttgcttttgtaataataccaagcccagtttctttcaacttgagagatgagctatttattcttttacttaatgaagatgtaagaaatgatcttctgttctaaaaaaaaaaaatttctctaatgtctcttgaccctgtagaaacacattcagtttctacactgcaaaacagagggatatctgtatggcttccctctttccatctttcctttcctcagggaaagccaggaaaaagaaatcttttctatcacagcagacacaccaaatctccctaagttgtaccgccttaattcctcagaatgcaattgtgtatgataccaagctacaacttgataagaaattgtgattttcttcttttattttcattctccaatttt

SEQ ID NO: 7206 - DNA, 537 bp, Homo sapiens
  misc_feature (1)...(537): n = g, a, c or t
caagctttttttttttttttttttttttttttttttgntcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttganattaaaaaatatgcattgcaagaagcatatgacaaacattctgagagtacaaaattagttgtaaaaaataacataatttaccagtaaacccactcatatanaaatgtgcaaagccttttgatataaaaagttttgtacaccaagcacctatttttataacttancttcccatgganagataatggcttgcgtgcattttatgtatccataacatacatacaaggctcggtcttttcaatgggataacagttcacaactcttcgatttgaattgtaatgaatctggngacaaggatttttctctaatggattccaaagttagccagaacttttaatgtcaa

SEQ ID NO: 7207 - DNA, 251 bp, Homo sapiens; identical to SEQ ID NO: 4543

SEQ ID NO: 7208 - DNA, 564 bp, Homo sapiens
ctgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatg

SEQ ID NO: 7209 - DNA, 556 bp, Homo sapiens
  misc_feature (1)...(556): n = g, a, c or t
ctgaccatagtgctcatgccaagtcctgagcagggcatcttgaatggtggttccctcatgactacacacaccgttagggaatgtttcgttaagaggaaatcaagatgttctaacctgtgaaggtagaatagattccaggctacacaaacacatgaagtgtgccttatattgattactaaagaggttgctgccaagactgcttccaaagggcagaagatagccctaaaaaatgtttgcagtgtggaaatgcatttttaataagtcatattctagtaacaagttgcatttggtaagacacaaagaaacaatgttggtatgcagagtagaaatctctggaagatgatattgtcatatcagagatattgtcagtatcagagatactgaaatctctggaagatgatttttgtctcacatatggcattcacaagtaaaatgccaaactgcaaaattcatattatgtagtacacataggaagatatctaaatatccctgtaggctctgggatgttatttcttattcttaacctccntactagattcacttgtacaatgaaata

SEQ ID NO: 7210 - DNA, 525 bp, Homo sapiens
  misc_feature (1)...(525): n = g, a, c or t
gtcacattccccagngcagataatgggctgctgctggctctgtggtgtctgtctgcagaagatttgctcagtcaaggaaattcaagtggtgagacctttccgccatgggtggtaagagaaacctgccttcaccaaaatctctgaaggggaaggaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaattt

SEQ ID NO: 7211 - DNA, 321 bp, Homo sapiens
ctgtacgtcagccccttggccttctctgtaggttcttggcagcaatgagcagctttcactcagtgacacaagtaattactgagtcctaatttgatagccaccaactgtacctgggtaggcaaagtcagatttttgagaacctttttcctgatttgaagttttaattaccttattttcttttatgctttcctctgtcttgtaatcttttctcttcttaatatccttccctataatttcaattatttggattaattttagaataaacctatttatttctaaaattaatccaaataattgaaattatagggaaggatattaaga

SEQ ID NO: 7212 - DNA, 553 bp, Homo sapiens
aaaaacactttatttaataaaagttaaacatacaaaactgaaataatacacatcctaaaaattaccttcttccattaataggaagacccttttctatgcatgtatttggcttaaactcaactcaggataactgtgatgatgttcacttacaccaacaaatgcagacaacctgatctaattaacaaaaattacaaacagctaaatgaacataatatacagggaaattatcgtcagattaatgcacaagaaatacaagaaatttttaatgatgaaatattcagtattcttgttcattaatttagccttgtgtttttacaaaaatagtatctacactgtatacagggctatacatcagctttttgttctcccatataaacatcacacatccaaaacatggtaccactgccgtaaatggaaaaaacaaaaaacaggaaaaaagcaaacatacaaaaaacaaaaacaccttagaaaagggagctcatcctaaggtttcttacataaaactaagagtacataaaaataaaacagctagatcaattttagagatggccta

SEQ ID NO: 7213 - DNA, 451 bp, Homo sapiens; identical to SEQ ID NO: 3176

SEQ ID NO: 7214 - DNA, 422 bp, Homo sapiens
cgcgagcgtctgggcgggtggtaggaacaatggcgctgtcttaagtggcacagtggaacagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaacaaaa

SEQ ID NO: 7215 - DNA, 443 bp, Homo sapiens
  misc_feature (1)...(443): n = g, a, c or t
ccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatnnggaattcacttttttcatgacctagaaaaaaacattccagtgttcaactgttttatattattaaagggcttttaatttgtgaacttctgaaggcatgagtgttttctctttctacttttgtatatgcgcatgttttgtttcctctgacttggtatatgctcatctgagtgacggatatgtgaaatttgtagaactggttagtcaaatgg

SEQ ID NO: 7216 - DNA, 429 bp, Homo sapiens
aaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagacgattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatatttt

SEQ ID NO: 7217 - DNA, 590 bp, Homo sapiens
  misc_feature (1)...(590): n = g, a, c or t
aaagtgaaggcatgactgaaactaaaatatttcataaggcttagctagaggcagagtaacgtgttttngttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgangtctatgtaccttaatctcgtttctccttaccacaatcttaaatagatttcag

SEQ ID NO: 7218 - DNA, 508 bp, Homo sapiens
ctgtatacagacagcaaaagaagcaacattttgttacagcttagcacaaggcatccaacacaaacaggcatgagacaatgcatatttatgtagcattaaaaccagatgaataatatattgtggggcaggaggaggaaaggaggggaaaaaaaaatagaaatgaaagaccaatgtttctcaatgcttccaatatataatgctaaatttcccacctgattgatagcacatccaggtgcttcaaatgtcgtgcattacagtgagaatgttaagaatggaaaatcttatctgtgtacctgcctaatactaagtttggtcaaaacacattttcatagatcttctttcagtgataaatcgatttgaacatcttgtgaagttattgtttaataacttacttaacttaggctttatgctctctagatataaacaatgaattcttttccttttataaaaaaatatgctgcatgttttattaaaagaatatgcaatagttaccaatattaaaggtttt

SEQ ID NO: 7219 - DNA, 317 bp, Homo sapiens
  misc_feature (1)...(317): n = g, a, c or t
aaagaaattcaacnntatcctaaaacttgacctggtcaaacttattccatattatattcagttgctctaatatacagcaggttgatactaaaataatgacagaatttggctggtctaaacatacaaatatattttcccccttttctttctttgggaaaataagaaaaaaaacattactctgtttactcagaaagcaaggagagcagcaccttctcctggactccgtgactgtcagccatcttgtcatcacaaaaaggtgaggggtgccaggatttcactatgctgctccttcactggaaagggaaggaaatgctcca

SEQ ID NO: 7220 - DNA, 634 bp, Homo sapiens
  misc_feature (1)...(634): n = g, a, c or t
aaaatgatgcctnnnatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattggggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatt

SEQ ID NO: 7221 - DNA, 495 bp, Homo sapiens
  misc_feature (1)...(495): n = g, a, c or t
ctgctcccgaggcactagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgatnntgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgttgtttactgtcttatgaattcatggcaatatagttggatagcct

SEQ ID NO: 7222 - DNA, 410 bp, Homo sapiens; identical to SEQ ID NO: 4733

SEQ ID NO: 7223 - DNA, 195 bp, Homo sapiens
  misc_feature (1)...(195): n = g, a, c or t
attccccaaaaggtgtgtcaggactgagttaatcagtaagctaatagaaacaactgcaatagactagggatgagatttctcaaagcagtctgatataatatgcggcaactccttatgtactggagcgtatccaatacattctcaaaactcctaaattagctaaaatgcaaggtaaagagcagtngaaaaatgcag

SEQ ID NO: 7224 - DNA, 301 bp, Homo sapiens
  misc_feature (1)...(301): n = g, a, c or t
gtaacccaattatgataattagagagataattctatagtaaattaattcataaatattttctgaaaatagatgatttttcatcacagtaacatttttgaaagtataacaaaattccttcacagtctcctactagtgacaattaactcgttatgtaatgagcccatctaaaacaacaacaacagagaatatctgccatgaatcaaatctcagaaatttanaacctatccaaaaactgggaattgntgcatttctacttttataatcttaaactaccataaaaacgtancattcggtcacagg

SEQ ID NO: 7225 - DNA, 621 bp, Homo sapiens
  misc_feature (1)...(621): n = g, a, c or t
ctggcattccttccacttctctccagccgagcttcccagaacatcacatatcactgcaaaaatagcattgcatacatggatcaggccagtggaaatgtaaagaaggccctgaagctgatggggtcaaatgaaggtgaattcaannctgaaggaaatagcaaattcacctacacagttctggaggatggttgcacgaaacacactggggaatggagcaaaacagtctttgaatatcgaacacgcanggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtntaatttgacaaagaaaaatgatacttctctttttttgctgttncaccaaatacaattcaaatgctttttgttttatttttttaccaattccaattttcaaantgtctcaatggtgctataataaatnaacttcaacactctttatga

SEQ ID NO: 7226 - DNA, 643 bp, Homo sapiens
  misc_feature (1)...(643): n = g, a, c or t
aaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttacctgcccgggcggccgcccgggcaggtctgttctcatacagaaagtaaatcaagacgaaatatggaaaacatttatttcctttccttcaaaatttaacttacattccactttaatagctgttgaaggttaattaaaatgcagcaaagtataactacgttacacaagtgacttcagttattttaatgtgagaaaaatcagactatggtatcttacgagtcattatagaaatgttcatcattaaaaagcatttattangcactgaactgcatg

SEQ ID NO: 7227 - DNA, 332 bp, Homo sapiens; identical to SEQ ID NO: 4110

SEQ ID NO: 7228 - DNA, 506 bp, Homo sapiens
ttttttttttttttttttggccagaaaaagttattttaattttctattaaacattcttctcaaagcattattttatcctatatctcactgaattttaagaaataacattagtattagaaaaactaggaaaaaagataaatgcagataattaaacttacatgaaaaaggaaaattataacaaaggactgagaacgttataaattgaaatgagattataatttgaaaactgcatctgaaagcaaactttattgttcaattattcttaatgatggtgttttatgactaatacactgatttttcaataaggaaacccatgttaaaaatatttttattttaaaaataagcctgtgttcaagctctgatcatatttcttttattttgatttgggaagaaaatactgtttctgatagcatgaaatgcaaaatttttagatttttaatctcactaattttaagaactattgagaaattgattaatgacatgaagtgcacaacactaattactgg

SEQ ID NO: 7229 - DNA, 386 bp, Homo sapiens
  misc_feature (1)...(386): n = g, a, c or t
aaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagcanaaaaaaaaaaaaaaaaaa

SEQ ID NO: 7230 - DNA, 654 bp, Homo sapiens
cctgcagcctgcaccaggaggtacaatgtgagactgaggaatgggaagaaggcattccatggagctctgagggcactgggtgcaagggccttgcacatgcaaagaccctgttgtgggttcaagccactgtgtgggagggacaggagagcctggcgtggctgcggccttgaaggaggggactgtgcacacagaattgcaagtgggggtctccgcggaagctcctggcagttttaagcaggattattagatgattcagtcaactttacaactcactttgctgaatggagggtggattaacgagggggtagttggaggctaccccttggagggcattctggacttatctaccaaaatttcaaatgcacataccctctgacccagcagttccacttaagtatttggtcctgaaatcttggtaaaagtgcccaaagatacagaacaaggatgttcactatagcatctcttagaatatggccccaaacaggaagcaaccccaacctctttcatgagggaggtcataaaattcctgcacatgcaacagtgccatcctctgcagcctgtcaaagaggcaggcagcactaactgctggactggatgttctccaagatataataaatgcatttgtttgaaagcagcttgcagcacagtgcgtca

SEQ ID NO: 7231 - DNA, 552 bp, Homo sapiens
ctgaatatactaaacattgctctattatctgttgaattgctgtatttcactttttcagcatttggggatcattatttaattgaatttgtagagatcgattttccagacaggtctctgttcttcaatgaacaaatgataagaaacaatttgactccttatatgacaatggaattaaataaattgacactcatctaggaataattctacaatcatctccatctctaagattacctactgcaaacaaagaattgatctttctttctcaaaaaccacatgggtaagatgatcattgtgactctgaatgcaagaataagtgagtggaagctacaaggggagattatctgccaacatagaaagaatctagaagaaaagattttattacaggtaacatgacatagcttggagccatctttttggtctcttgcatacattttctctgcatgtctaaggaagaattcacaaggtagcaagcaccaatactttctgctttggagtttcacaaattgaaaatttgtccctctcttgttaagtcaatcaaacatctaccaatgg

SEQ ID NO: 7232 - DNA, 481 bp, Homo sapiens
ctggtttcgtgctgacccttagggtgcgtctgttgggttttgttgggctagaaaaatgaaaattttcagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacgacacctcagcag

SEQ ID NO: 7233 - DNA, 294 bp, Homo sapiens; identical to SEQ ID NO: 349

SEQ ID NO: 7234 - DNA, 365 bp, Homo sapiens
  misc_feature (1)...(365): n = g, a, c or t
tggcctcttacagtatttaagatatagcaaggacatggctgatttttttttataaaaattggcactaataagtgggtttattggtcttttctaattgtataatttaatttnntacaaagtttgtaaaatatcagaggatatatatatattgtttctacgacatggtattgcatttatatctttttactacagtgatctgtgacagcagcnncttcatgttgtattttttntactgaaattgtaaaatatccatcttaaagacatcaactattctaaaaattgtgtacaggatattcctttagtggtggaatnaaaatgtacgaatacttgctttttcaaaaaaatgtattttctgttaaaagttt

SEQ ID NO: 7235 - DNA, 417 bp, Homo sapiens
cctaagatggcattaaagttaaaggattcagggctctctccaagcatagttcagttaatagagttgaaaaataaaagtataggcccttggttggggagatcctggtttccccttctcagcccatgaaggagctgttgcttacagtagaaccaagcttctggaaggaagagagcagtgtggcagagggtgtgtctgtgtgtataggcagtatgctaacaggagacttgagggtaagaaatctagaggctgactttggttctgtttttaggtctttttcatttaactttgacctaagttccttaatttaggaaatgatagctttccacttgacagtctttgaagtctcttccaattttaatatccagatttagagtatgaacatagcttttcttcctgattccagagtttcctgcagac

SEQ ID NO: 7236 - DNA, 495 bp, Homo sapiens
aaaattttttcaaaatctggcttttctatttgagaaaagccctacggtgctctctcggaacccccttttgaaggatgaaacctcaaacttgcttctttaatcagtgggaggctactagaaaaaaaatcttatgttgaggttgctgttcaattccatttttacccaataaaaagtacagaaactatttgatggtgtgcataaatattacactccatgaatagcaaaaatattttttatttataatttacagttgcacagtgaaaaatcgtacatttttacacatacaatttcatttcgttaaatttgcacacatctacagaactttcacacaacaagcacctgaaactctgcaggcagtaggaaatgcaaatactaaaatgtatttattaaccaaatgatagctgaaggccctgcctcagccagacaatttatatagatatgtctatatatacataaaaaaattcttcaccttctagatccaacagcagctttttt

SEQ ID NO: 7237 - DNA, 200 bp, Homo sapiens
aaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgttttt

SEQ ID NO: 7238 - DNA, 641 bp, Homo sapiens
  misc_feature (1)...(641): n = g, a, c or t
aaagtcaattgnnnaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaattgcctttgttttgaaattatatcacctgtgttctgaactaaaatgatgggagttcattttgtatttactttgcagtaagtatcatgtaaatatgcaaatgttgaatgtaatatagattgtgttcctcattgagtttttgggtgatacagtttataaaatataacaattatacaccctcatacatttcgttctgattttgagcttgtaagatgagaactgctttttacacatttaataaaaaaaggtctctgaattatccgaaaaaaaaaaa

SEQ ID NO: 7239 - DNA, 396 bp, Homo sapiens
aaaatagcctttgccatcactgccattaagggtgtgggccgaagatatgctcatgtggtgttgaggaaagcagacattgacctcaccaagagggcgggagaactcactgaggatgaggtggaacatgtgatcaccattatgcagaatccacactagtacaagatgccagcctggttcttgaacagacagaaggatgtaaaggatggaaaatatagccaggtcctagccaatggtctggacaacaagctctgtgaagacctggagcgactgaaaaagattcgggcccgtagagggctgcgtcacttctggggccttcgtgtccgaggccagcacaccaagaccacaggctgccgtggccgcatcgtgggcgtgtctaagaagaagtaagtctgtagg

SEQ ID NO: 7240 - DNA, 108 bp, Homo sapiens
ccttaaccaataggttggaagacaagaccaattgaagagttaggaaatgtgagtttttgttacttctgttattccagtcttggtttcattgtctcattctttattttt

SEQ ID NO: 7241 - DNA, 427 bp, Homo sapiens
  misc_feature (1)...(427): n = g, a, c or t
aaagaattcgnntgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgggagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttcttt

SEQ ID NO: 7242 - DNA, 626 bp, Homo sapiens
ggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtattcattggggggaaaatgtagccacattttttat

SEQ ID NO: 7243 - DNA, 143 bp, Homo sapiens
  misc_feature (1)...(143): n = g, a, c or t
cagnggcaggaagnnataactccagctaagtactacagaaaaaagncncctanatcattactgcnctcagggagccctatgagnacntacacannataatgatacatggggagcagggcnccggggnncgttaaccnagaccg

SEQ ID NO: 7244 - DNA, 142 bp, Homo sapiens
  misc_feature (1)...(142): n = g, a, c or t
aacgcactgctgccggcagntccgtccctgngtggtggtggtggctaccnattncngacaacttttncancacaacttnanccgtntctnaacttcatancaccnggtnnatcacncatanttttccctangccggacacat

SEQ ID NO: 7245 - DNA, 150 bp, Homo sapiens
  misc_feature (1)...(150): n = g, a, c or t
accgctatnnaggtgacgcgatannccactcaagctatgcatcaagcttggtaccgagctcggaaccattannttcggccgccagggggctggggggnntggaaaaancaggagaaantggcaccgntcctcgngcanggcggcaagctt

SEQ ID NO: 7246 - DNA, 201 bp, Homo sapiens
  misc_feature (1)...(201): n = g, a, c or t
accccccacagtttgcgcnacnccgccacgtgangganatctgcagaacncangcaagctcgccgtttnatncgaggagcaggggacaatgggagactgagaaanccctgaatgccagcacactggcggccggtactagnggganccgagctcggnaccaagctngaagcatagctngagnattctaacgcgccacctaaa

SEQ ID NO: 7247 - DNA, 185 bp, Homo sapiens
  misc_feature (1)...(185): n = g, a, c or t
ggggaaccccccacagtttgngcaancncccgccagcgngaaggacancngcagaaccacgaancccgccgttnctttaggctgcaacaagagacaggggaatttgaanccactnacagaggcacagcaggaagcacactggngagaaaccataccagcgcgactccaaggactgcgaacgaagg

SEQ ID NO: 7248 - DNA, 216 bp, Homo sapiens
  misc_feature (1)...(216): n = g, a, c or t
tccatccctccgtggngggggtggttgcgcactgccggttagcggngcagcacnttttggctccggttctggacttcgcaccgccggntgtatccngataccaggtccctgggggggcccggnancccccncngganccgccgccgccgccgccgcgncgnactnctttataaaacangaaccganntgggggggggcaaaacccnacnaaaaanc

SEQ ID NO: 7249 - DNA, 126 bp, Homo sapiens
  misc_feature (1)...(126): n = g, a, c or t
cgtggncgcngttcgacgtctgtnnagtgggcttatantctggggnacncgcangacaggnacagatncttttccttgaggcccaaggccacanccctnctcntnttactttcttctccttgnaca

SEQ ID NO: 7250 - DNA, 124 bp, Homo sapiens
  misc_feature (1)...(124): n = g, a, c or t
gggccgaattggggccctctgggatgccatgcctacggaccggctcgcncagtgtgcatgcgcatatacttgccagnaattcggggtctngagangcgggccnacgttnccacccatnaccatt

SEQ ID NO: 7251 - DNA, 165 bp, Homo sapiens
  misc_feature (1)...(165): n = g, a, c or t
naatgggccaattgggcccttcccgtnaggaccggggccnccggccccaagggatgggttggnaaatgggggnaaataaattcccttggcccaaggnaaaaatttncgccncgccccnnctaaacntcggggtcnggngncgcggnttttaatctttaagcttgg

SEQ ID NO: 7252 - DNA, 246 bp, Homo sapiens
  misc_feature (1)...(246): n = g, a, c or t
ttggncccattgggcccttcntttaggnccggggccnccggcccccaggttgggttgggaaatgggggnaaatnaatacatngnccaagnaaaattttncgcangccccntctaacgtcgggncggggncnccgtttttntctttaagctggggnaatnccccgnagccgtgcggggntaacccaanagggcgtgtgggggcggttgatatncatgggggtncataangccttggtttcctggtgg

SEQ ID NO: 7253 - DNA, 108 bp, Homo sapiens
  misc_feature (1)...(108): n = g, a, c or t
aatcgccatctngatgcatgctcgagcggccgccagngtgatgganatctgcagaattcgcccttagcggggtctgttgccgaggtcaaagccntcttccaggaacaa

SEQ ID NO: 7254 - DNA, 216 bp, Homo sapiens
  misc_feature (1)...(216): n = g, a, c or t
tnaaataaaccggaactttcaccttatttagggggnccggaaaaatttgggggggcgcccnttctttaganaatggaccaattgncnttccggaagaccgggacncgncnccaagatggntggnaatngggtattatttccttgnccaagnaaaaattttcccaaagnccaacnaactttgggncngggggggngggngttactttaacaaanaga

SEQ ID NO: 7255 - DNA, 182 bp, Homo sapiens
  misc_feature (1)...(182): n = g, a, c or t
tagcgtggntngntacaagggcngctgatnnagacanaacggttgntggganangcntcatngaattngaccanggnaagagggtgctgcaggaggtcatgggagcctgantanacctgtacagacanaanggaccctgcancccccgganttcccacctnagacanacccaccccngccca

SEQ ID NO: 7256 - DNA, 207 bp, Homo sapiens
  misc_feature (1)...(207): n = g, a, c or t
tgnaaatacgaactcactttttagggggacgaaaattggggggcccctcttaagaatgncaatggccttccgaagccggggcccggcccaagtggtggaattntttatnatccttggccaagaaaaatttccgcccccttttaaaccgggggggggnttntttttnttttcaaaaaacnnaaccnttcncatcgccccccanccatg

SEQ ID NO: 7257 - DNA, 117 bp, Homo sapiens
  misc_feature (1)...(117): n = g, a, c or t
aaaaccacccacaatagggaaaacccggncngctagaancaagcccgagcggcccgccagngngatntattatccgcagaaacccccccncaaccggggggntnggtnaaaaggccc

SEQ ID NO: 7258 - DNA, 148 bp, Homo sapiens
  misc_feature (1)...(148): n = g, a, c or t
aaagttttnttntgaaaacncncanaatcaaangngttatccatgtnttngcancancaaaaaaacagngacagnggaccntccccntagggnacnnttatcntttggntaaactaattaaataagnggaagtnacccctnatcaatc

SEQ ID NO: 7259 - DNA, 718 bp, Homo sapiens
  misc_feature (1)...(718): n = g, a, c or t
ggccatcgtttttatgtccgnttaagccacactgggcacttagtagaaatgggttgatgtcagttcaattaaagagtgagtaacctctgctgggcccttgctgctcatctgtccacaggatggccggctcctgccagagttcaacatggcggagcctcccttgatcttcgaatgcaaccacgcgtgctcctgctggaggaactgccnaaatcgcgtcntnccaaaatgggcctnagggcaangggtgcagctntaccggacccgggacatgggctggggcgtgcggtccctgcaggacatcccaccangcacctttgtctgcgagtatgtttgggggagcttgatttcagactcagaanccgacgttccagaggaagattcttacctctttgatctcgacaataaggacggggaggnttacttgcatcgaccncgcggttctacgggaacgtcagccggttcatcaaccaccactgngagcccaacctggtgcccgtgcgcgtgttcatggcccaccaggacctgcggnttccccccggatcgccttcttnancaccccccttgatccaaggccggcgaacancttcggggtttgactattngaaaaacgcttcttgggacatcaaaangcaaagcttttnagaactttgcccggggcggcgcttcnaaagggncnaattcccancncactcctggngcgntanctaatnggatcccg

SEQ ID NO: 7260 - DNA, 502 bp, Homo sapiens
  misc_feature (1)...(502): n = g, a, c or t
tgagcgaaggaacgagtgagccgagccagtcagcagcattagtgtgatacgtgttgcttttcaattaaagctctctgcctctcggttgagcaactctgagagccggggtccccacccttctgtccccctcatggtgggtcttgtacccaacagcttgccagagcagagagccatgaatagggtttggtttcaggaaagatgaccangagacttannccagagtaagnctgagttcaaatcctggcccacgcttctgcttgtcaccctggcatgtgattcagttcttggttcttgtacatttgggtggaaactgacaactgcctgccatggggagaaccagcttgctgccttctgcaccacggctggcactgatcattagcaggttaaaaaaaaagctttgcaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcg

SEQ ID NO: 7261 - DNA, 142 bp, Homo sapiens
  misc_feature (1)...(142): n = g, a, c or t
ccagggcgtgtaatgacttcagtattggcctcgtgttgttggtactcactatccgatccaggcagggaaatggtcagtgcgtgtgtgtcgggtggggtggggggatgagggtggagaggtnccatttcaagaggtntacaga

SEQ ID NO: 7262 - DNA, 116 bp, Homo sapiens
  misc_feature (1)...(116): n = g, a, c or t
aaataaaccgcaacctgcaaccttatttnnggggaccggaaaaatttggngggccgcccnttgcgttaganaatngacaaatggncctnccgnaagaccggggctccgacncnaag

SEQ ID NO: 7263 - DNA, 137 bp, Homo sapiens
  misc_feature (1)...(137): n = g, a, c or t
gacaaggaaaaacgaaggtgaaanncagcanctatncaccatgacctaagagtanacagaggaaacagttanaaanggccagnanacggcagggcgtcnnacccacaantcancanaccctgngncccacnanaacc

SEQ ID NO: 7264 - DNA, 183 bp, Homo sapiens
  misc_feature (1)...(183): n = g, a, c or t
tagccgtggggggtgcctaggnctggaagancaggctnacaanacaaataagcagcaagaaaccggccccaatgacnactgcaaataaaaatcttnttggttttganncccaaccttttnccttggccttccccaaanaactttngggtacctggggggtntangcanggtcctnancttgga

SEQ ID NO: 7265 - DNA, 215 bp, Homo sapiens
  misc_feature (1)...(215): n = g, a, c or t
cgtgntgnttgnatcgctnncggcgggcnngaaatggagctnttntnacgtacccctttnaccatcactggacnagtatcttggaaactccattccnatctgtcagatcaacttgnttgggatttgcagtgtgtacttgcttttcagacttgaaantggatcgtgaaatnatgnaaaaacggttcaacccaatctacatagtgtctgtagagaaa

SEQ ID NO: 7266 - DNA, 491 bp, Homo sapiens
  misc_feature (1)...(491): n = g, a, c or t
gcgcaggntnnttgaaatcncttcagggcggcgcggnaagagaagctaggatctacagatgctgtagttattctagaaactcanctgctctttactgggacttggcaagtgctaaattttggctcaatattggctaaatattcttggaataagaaatcccctactccagnatgtggaggataaagtttttcatgttctgatgacagggccagaagnattgtgtaggccatcaaggttttattggtnccccaaccccntgaaanaccagggnttagtcctgctaaccagnagagacaacaaccctacccagcttaaaggagcgggntgaggaaaagnattttaaactgatttggactaagnatnttgnactatagtatcacggctgntgctggaccgnngaccatcacgganactcgcggaccntangnaattcacacattgggcgtctagngatcgantcgnccacttgcgatatggataatnttttcttg

SEQ ID NO: 7267 - DNA, 451 bp, Homo sapiens
  misc_feature (1)...(451): n = g, a, c or t
atcgctnnggcgggcntgaaattgaacagtngaactttatttgtttgaccaaacaggatcaatcctgattgacatntgggttttnctatatacattgcttctaaggtgtctnattgttctanaagggccaagntggggcatggtatgctgnatccancttnaaggcaggagcgntattaggcagagtaaaacagctgntactggaacccanttctaaaancaaaatanctggtgggtgggcctgtatcccgtctcggaggtgngaggaaatacttgacctggaggagaggtgagtgactgaattgtgcctgtctcagctgagaacagagtgagattctntcacacaaccaaaaagataataggttattactgcccggnggcgtcangggaattcagncncttgggcgtctangatccactcggccacttgngatatggcatantgttcccg

SEQ ID NO: 7268 - DNA, 295 bp, Homo sapiens
  misc_feature (1)...(295): n = g, a, c or t
aatggcttntatgcncgcgagggtggtttnnaatcncttcggcgggcaggctgactctggactncctgtaggataggtaaactgtgcggacttgtgtgttgttgaggggtggggctcatccncttacgggtgtttgcttcagcntgccggtccggaaagactataacaacaangggcttgtggttgactctaagacggggaaagataccnggggancttggntactnatctggctganctggtctggtccactctgtatnccaacatcatccccagccctgggcccctngcncgc

SEQ ID NO: 7269 - DNA, 149 bp, Homo sapiens
  misc_feature (1)...(149): n = g, a, c or t
nnaaaattnacccccaacctttcaacctttatttaaggggggnccggaaaaatttggnccgcncgcccnttccttaagagattgnccaatggnccttccgnaagtccgggtctccgtcaccaagnttgnttggtaatagtgtttttatt

SEQ ID NO: 7270 - DNA, 119 bp, Homo sapiens
  misc_feature (1)...(119): n = g, a, c or t
ngnnaaaaatnccncaactttcaacttttttaggggganannaaaaatttngcncgccgcccttgctttagaaatggncnaattgncctnccgnagnccgggacnccgtctccagattg

SEQ ID NO: 7271 - DNA, 143 bp, Homo sapiens
  misc_feature (1)...(143): n = g, a, c or t
ttcaagctgggcctgaacttcngnacntaaggnnatccacccncnttggcntcccaaaagngntggnattatagngaatagccaccatgcccggtgagactcngagattcaanaacanagatgtgattnaaagaaaggggaca

SEQ ID NO: 7272 - DNA, 132 bp, Homo sapiens
  misc_feature (1)...(132): n = g, a, c or t
taaattgaatgcccatcaatangtgtctnaaataccactcgnatccttganctantactatatatttggctnntatnattaaantaaacaaagtaaattaccnaggntgacncaganggggctgtnaaacgg

SEQ ID NO: 7273 - DNA, 151 bp, Homo sapiens
  misc_feature (1)...(151): n = g, a, c or t
ttaaaaatttaaccggcaacnttccaaaccttnattnaagggggggnccggaaaaaatntggggggggnccgccctttctttaaganaaatggnccattggncctncggnaagaccgggacnccgncnccaagntggntcgagantggngc

SEQ ID NO: 7274 - DNA, 775 bp, Homo sapiens
  misc_feature (1)...(775): n = g, a, c or t
agataaccttcctttggcatgttgctctaaggaacatgaatccaacaggataaagatttcctaaacaaaatgcatgttaagttaatagtgcacaggccctgtgctctgctaacttggaactaacgcataatcagcaaataatcaacaactgctacaatgaaatcaaggtagagaaagggtggaagaatgaaaagaagataataaccaattgcttttttgaaaaatatttttttctttctaaaggcatctcagtggagacttgtgagaaggtaaacaggtgaagcttagtctcacctgtatatagtaaaaagtgcattctgcagcctcagtcaattcatcatctgctgaacaaagacagcaggtcataccatttctcacgcattgctcttagtgcaatcaaaatacctatttttaatggcagcagaaaacattaaggtgatagcatgaagacaaatccaatactactgcagttggcacaattagaaatggcagangaattctgngggggntttatctgaattgttaaaattcatgaataatgctagcaaaagggngtcatcaccaaaactcanggaagtgaagttgtntctcactaccaangaaaaaattgccnttccaaatcctggtggcctttgggctggattttgggacaagttntaacagctttctgcctttttaaactnttgggggncttttccacaggccnttacaaaaataatctggganaaggggngaagaaaaagcctttataaanaggggttaaccttgagggtgg

SEQ ID NO: 7275 - DNA, 665 bp, Homo sapiens
  misc_feature (1)...(665): n = g, a, c or t
ctgagcttccccaaaatcaagggagaatactaaatatctatttaatagaatcttggctttctctcggaggctgcccatccctggtgtgtcccttatcctccctgcagacatttctcatggataggagttccattgaccttgtcttttatgtctcccgggcaattaaacagtctcagtaccctgtacctggattgttcaatgactttcttcccttctcattgacttcactggagtagaaggctaaatataggcattcactctcatatctctcaggtctttccatgcagacagagttgttatcactagtagacggtgcttataagagagacatggaaaagtggaagaatggaaatagggatttggagtggtgctaaaaacaaagaaagaggcttctgaaagctttccatttaatatgatcaaacatagaagacaaaagatgtaacttaatgaccaaggatagggacatagccttgagaaaattacagaagtggaataaacgtcttggactccaaaaaanaaggaatggaaatgtantctgangcactaaagtcaataaaaccctctgatatatttactgtanaaanaaaggacatcttttaattcaaggtttgcaacttangtgactacaggggcnaagcatggaanggnaaagggtaaaaaantaa

SEQ ID NO: 7276 - DNA, 655 bp, Homo sapiens
  misc_feature (1)...(655): n = g, a, c or t
gtgacttgaagcancttgttgatcanaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatggggatggaaggtgccttgccaaacangggaagaccgcgcagtacgcgacagcctgcaccttttgaaatctctcaacgacacgatgcacaggaagtttcaanaaaccgaacaaaccatccagaaacttcaacaggattttagttttctttattctcaattaaaccacacagaaaatgatgtgacttcatcttcaaaaggaaatgagcaattgtanagcaggtgaaaacgcttggcatgggtanggttcacttaaggtgggtgaaccaanaaaggacagtggacaccctgccgtccccccacaccccgtggntcattgctgcagtcanacctcggccgcgaccacgctaaccgaattcnncacactggcggccgtactatggatccnacttcggaccaacttggcggaatatggcgtaaa

SEQ ID NO: 7277 - DNA, 602 bp, Homo sapiens
  misc_feature (1)...(602): n = g, a, c or t
gtatatttggagaaggattaaagggaagaaaataataaaattgcaagaacgtcattaaatgcttaagaggaacatggcttgttcctcagtcttcaaagattgaacaataactgggcagaattttccaaactttgatactagtaacaattaacagcaacccttatggttgccaatataaaatcgagcaataaatcaatcaaatgcttgactcaatcaacttcttgttctttcttgtccataatatagtctagactagctttaatactgctttgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttctaattagctgggtatggnggtgcacaccagttcttaagaggccgaggaggctgggcacagtggctcacgcctgtaatcccaatactttgggaggctgaacacctgcccgggcggccgntcgaaagccgaattccacccacntngngccgttctagtggatnccagctcggancaanctggcgnaatcatggcatag

SEQ ID NO: 7278 - DNA, 613 bp, Homo sapiens
  misc_feature (1)...(613): n = g, a, c or t
ccttttctcattagtctctgggtcaggcttgggaagatatatgtgttggtgatgatatacttgtctttaatcatgatttatgaagatttaggattgtgtgtgatttgtcaaaggttctgggaaaaggctggtgcatatttcattacttaatctgagattgattttatgatgctaagagatatcacactattgttcaaatgtgtgggaagtacaggtagacacaacatcccagctttttactgcttatctttgcaactgtcaaacaatgctgtaaactttaactgcttgtagttaacaattcctgttttaattataggcagattttttattctgtccaaaggggagaagtntcaatggttatttagctaaaatgcatagcaagacattataactatgacctggtatgaaatcatggacaaagnttggtaaatttcatgggttgggtcatggngaaaatataaaatttcatgggcttgccaanaataatataaaattcccattaaaatggngcaaataccttcggccgcgancaccctaagccgaattccacacactgncgggccgtactaagtggatccanctcgggaccaagctggcgtaatcatgggcatac

SEQ ID NO: 7279 - DNA, 583 bp, Homo sapiens
  misc_feature (1)...(583): n = g, a, c or t
ctgatgagtagtagagattggattcacacccaggttttctctctctgaagccctggtcacctgtttggccctggggtgatggggagaaggttctggctgtgtcttggctatctcctgcctctccctctgtggggaatgtgttcgaggatcacagctacagcttttcggataccctttcctttgtgaagcatgtgagaaccaacattgcatctcggcaagaattaaaaaggaattgttgatgacctgctgaaggtattttcattttgttcctggaaatgattaatcttgaggctttgtgatggcctttgtcacaaatagccttccttaatccataattttctcactttcctttaaggtaatattttgcatttaagaaataaaaacaagcaaaataatcctgcttgtgaaggatatgaaatgcagtgtttgtgtgtgggggtgtgtgtgttgtgatgctgaccaangnctaaattccctgaaatgaataanaaaacccctttttaaaataagntcagtttgcctttttttgtnctctattggcaatctaacccctcctttataatatttttccttcttcctctta

SEQ ID NO: 7280 - DNA, 704 bp, Homo sapiens
  misc_feature (1)...(704): n = g, a, c or t
acaaattatctttgaagtttaaacatgataatatatagaaaaagtggtctgaaagtatgaagcccgaagtgtgagtttgatgatgacttagttttgcacatacatgtgagactctgacataccattatatattatcttgatgacacataggcatcaataagattgaaacaatatttgtttaatgtgttttattcagcaccatgcatagtgctattcaaaggtaaatggttaaatggtgtatcattgtaatgagataaagatatagataatcagaccaatttttgaaacatttttacttttaagaacttaattctctcaggaatgagtaactgtttttgctttattttgaatggtctagatatcattctttttctagctgngttgtgaggtacatgttattttaaaaaccccacaggagatgaggaggtcccaagggagtgaggtctcgatgtcccctcaaacattaaccacacagctactcttttgctgtcaagatacaggggctctcaatacattttgtttgaagaaaggacctggatcttataataaccaatcagaaagtaattttctataataaaaagttctttaaaatctgtaagaacagaaatgtgngatttaaaaaatttntgagatatnttaaataacnttnctttaaaaantgatgntggctggcgcagggttncccttaatccaccnttggagcc

SEQ ID NO: 7281 - DNA, 450 bp, Homo sapiens
  misc_feature (1)...(450): n = g, a, c or t
ccacttttggagagtccgactatcacggnaggcacagaactctgccatgtnactagctgaatgacctcggatgtcacttcaactctganccttanaacttgtcaactgcaaagtggggcacttcaccgagctacatcattgagctacttcactgagctacttcattgaattgggaaaattaaaggagcaaatatgggagaaggatttgcccatagtaaacactatgactgtccgcttctgccatctttcagtanacccagtgggaattatatgaaggttgataggcacttaaaccaagaatatatgaacatctattctgtgcaaggatgtgtgcattgaactcagtcccanggacttganggggacaggaaggaagcaaacttggaaatcattgtctttagagatcaaggagcccannagatgaaacaagcctgggntccctaggtgata

SEQ ID NO: 7282 - DNA, 712 bp, Homo sapiens
  misc_feature (1)...(712): n = g, a, c or t
atttttgtcaaaatagtaggtgtaaaataatgtcttatggtttttatttgtatttacttgaatacaaataaatacaaggctgaggcttgagattgagattgagattgaggctgagcacctttctaatatttatggggcagttgtgtttccccttccatgaaatgtctgtacatgactttgcccattttaaaaaactgaggatttgnttttattaaaactttggtattatttatcctggatatttcctttataggttatatgtgtcccagtgtgtgacttatctttccctttttgtgatatgttgattaagcagtagttcttaatgaaattgaattagaatttttcttcattttatacttcttgggnctttctaaataaatctttcctaactcagggtataaagatatccctgctatgctttacctaaaagtttcctgaaatcttttgccttatcacccgttatgnaccttggacccatcttccagttgggtttttaatattatngggnatggggaaaangggaaataaatttgcccaatgnncctaacncctnnttttattgggaggaaaccatccctttnccccaggaaaccttnaccaaccgggcccttggggttnaaaataaattttncanaccanaaaantggttaacaaancttntccatttccngggggggnatttctgggtgcgggcccnnaaaaaanaataaan

SEQ ID NO: 7283 - DNA, 694 bp, Homo sapiens
  misc_feature (1)...(694): n = g, a, c or t
ctgtggctgnggggncgganaagcacatttttctgcngataattanaatggcttcccccatctctcacggactgtcccaagtctagaaaagaattgacntcctcttctattanncnaataaaanggaanagaatgtttgncttcctttcctttctgtagtgntaagaaaataaacgaacttaatggatnntaaattatcanngagcttaacnctgtactataaaccaaacattaccttttcaaaaagtcctttgaggngaaatattttgtatncgtaatacatagatgcacatataancccacncatatanaatctcaatattttaacncttctttgggtagttgcactaactcactaaccctgaggaaaaagttaacaaattgaaagtnttttcttcnaaagttgagatttancnataaaaggtnttactttgatanctaaaaggaactttattancctcttcctaaaataaacccnncctattctgaaaatggcncttgcnattaccaatttgccattntcaangctaccccttgaggtggacgccttttcttaaaccaaataccccttnttatttattggcagttccccccganagggnccccnaaccccatcttctancacaaccccctccatcaaattacccttccggtaaagctatngcctgctctanccccntttncaccncaatat

SEQ ID NO: 7284 - DNA, 481 bp, Homo sapiens
  misc_feature (1)...(481): n = g, a, c or t
tctgttggagggggccctncccaaagggtcctgnacccctcacaggggangaactgnacttgccgctcattcngacaaaggggggtgtggacgcanccctggaatatgccnacaccnggacccgctatgccaaggaactgcttgcctggnctgaaaacagagccacctatganctggagtttgctaanancaccatgaagatcnctgaagctggcaaggtntccattcaacagnagagccccatgcctcctgcagnacatctacnccctgtttctggagcaccatctcaccctgggaaccctgnncctccggcccacaccacccctaancccaattccancacactggcgcccntccctatccnatcccancctcgntnccccntctcgccncactcnncgccatngcctcgttncccnnccgacccccnccnctccccccntctnctacgcgcncctacccccaccgcccgccccccccc

SEQ ID NO: 7285 - DNA, 442 bp, Homo sapiens
  misc_feature (1)...(442): n = g, a, c or t
cctcctcnannggggcagggaacttnaatctgtataagtatctgcagttgctggaataatttgaagaccccatggagctaaggagattaagtggaggattttcattgtttcagaggggcaaggggcaaatccattgctaattctttaatgatgaaaaatggtaagaagttgttaaactcctttggggattttaaaaagtgatacctnaacanaacagagagagagagaganaaatcncactagtgangctaacnaaaataatgataaaaaggttagaacaacccangatacttactggatgcctacacaacntaaaaatatatttatanaanganccactgnaatttgaatataaaaggntatcngaannttaatgtgtngcatctgaaattcnaactntttccttttggctacnccancnaaacacttttnataaccccct

SEQ ID NO: 7286 - DNA, 125 bp, Homo sapiens
  misc_feature (1)...(125): n = g, a, c or t
ccttttgatangggnttttttaaaaaacaaaattatagaagtttaanaatttaattcaaatttggaggggttttnaggaaattttnacaaaatggctngttggtttnanctgtttcctacntttg

SEQ ID NO: 7287 - DNA, 518 bp, Homo sapiens
  misc_feature (1)...(518): n = g, a, c or t
tctaagancgggngtgttttncntntattttcctaactccatctcctaaaaaattccacctcattctgctcaacccaccacggcattcttgctgttcttgaacatgccaagcaggcccagggcctttgcattcactgtttattttgcttggaatgctctccccccanacaccttcntggcctcccttaccaacctcacatctctgctcccaagtcaccttctagataaagccaacactcatcacactaatgacaactacaacaatccctactgatactcactctanctttttacctgtcacatttgctgtcttctaacatactgcataatttacttatttattctctctccnttatnaanagttctaaaagagaagngacttctatctgttttgttcaaataccccaaggctcccttgttacnttgtcagncagtcaataattatttctcaaatgntaccngntttaagaaatgtgagctgcttttttacgaaaaccancaaatgttcctnccctata

SEQ ID NO: 7288 - DNA, 659 bp, Homo sapiens
  misc_feature (1)...(659): n = g, a, c or t
cctatgtcacgggggagagaagctcctgaaccaaccatttgtcaggtctggggacaagactggaagtattgactcatttgcaaggaaactaagtgggtcaacaatgaaagaaggtaataggacctcatctgcaatcctccaatttatctgcaggataaattaaatgcctaaaaaagaaacttattttttaaagtatctgctaccatcaggaaaccaaataaatagtcagtctattaatttcgttcttaaataattccgatcctttacctaatttcttgagccatttaatcatctcaactctaccttagaaccctcccaatgttttccaaatctgtcttactgggaaacaaagattaaaattcctaataaggattattttgtggatcttaatttctagattcccattttaaaattttaattccattaatttcttaataatagcattctattactgattgaatcatctctaataagccatcataatttccagaccatttctaagaacacgagctgatattgaaatgtttactaatgaccngccccgggcggcccgctcaaaacccaattccacncccttggcgccngttctaactgggatcccaacnncngaccccanncttgggnggaaaacnatgggccctaacccctggtnccccggg

SEQ ID NO: 7289 - DNA, 675 bp, Homo sapiens
  misc_feature (1)...(675): n = g, a, c or t
ccagagcagangngaatggttctgacttaaataggttgttgagcaaggagatctcacattttaaagaatattttcagagggagaatttgagaaggggggagaaaaaaacaaacaggaatgaacataaaagtataaaattctanacaacccactaaaccagttagcaaaaagaggagctcttaattgaaatagagaatttccccaaaaaaaggtctgaatttatttttaaaacattagatttggaaaatacctaatttgaaagtttaattttcatatatacgtcaaacctgcttttagggtagtttagtcaaagctgaaacaaaacaaataaaattctggcttatatatctgatacttgaataaggactctgaaaaaaaatgttcccgttttttttctcgtcngcctaagatatatttttgacattacataaatttcagtgatatgatctggctcctatttaacntttatgccctttctcttccaatgntaacttttaattttctcctcttcttctagctgggatcnttaaaaaaaacngaaaactcngtnctccccnagggtcatggggnaacnttttcancncntttccgggnccctttctattcctttaanaaccnctccccctccctttcctttttaccccccnattggncctttgnccnnaaaccgggggg

SEQ ID NO: 7290 - DNA, 474 bp, Homo sapiens
  misc_feature (1)...(474): n = g, a, c or t
ccacctggagacgttgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcanaaggatggctctgtcattgattatgaactgattgaccaagatgcttgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggntaaaggag

SEQ ID NO: 7291 - DNA, 208 bp, Homo sapiens
  misc_feature (1)...(208): n = g, a, c or t
ccgnnagataaccttcctttggcatgttgctctaaggaacatgaatccaacaggataaagatttcctaaacaaaatgcatgttaagttaatagtgcacaggccctgtgctctgctaacttggaactaacgcataatcagcaaataatcaacaactgctacaatgaaatcaaggtagagaaagggtggaagaatgaaaagaagataata

SEQ ID NO: 7292 - DNA, 261 bp, Homo sapiens
  misc_feature (1)...(261): n = g, a, c or t
ngatagactcttcctcagcagcctggcaggcaggaaacagacataggaccccagcccagatctgaatggcatgggaggngctgcccttaaccatgacaccattgtaagagctgtccacatttgtatgttgtgccctggaatcagcctggttgagctcaaatcccaacttanccacgtntggcctgtgtccttgggcagnncacactacctctctgattttggttccttatctgnaaaatggtgatcatcataatacaactn

SEQ ID NO: 7293 - DNA, 184 bp, Homo sapiens
ctgagcttccccaaaatcaagggagaatactaaatatctatttaatagaatcttggctttctctcggaggctgcccatccctggtgtgtcccttatcctccctgcagacatttctcatggataggagttccattgaccttgtcttttatgtctcccgggcaattaaacagtctcagtaccctgt

SEQ ID NO: 7294 - DNA, 204 bp, Homo sapiens
gtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttgga

SEQ ID NO: 7295 - DNA, 180 bp, Homo sapiens
ttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggc

SEQ ID NO: 7296 - DNA, 308 bp, Homo sapiens
ctgaggggacctgctaggctttgatgaactgagctgcatcttggatttcgcttcctcttctttctcagccgaggttacggtgattagcaagggcagttgctaccactgaaaggatagaaggaaaaaggcaagggaaaatgatacgtactaagatgcacataggagcactcgatagtagtctatggaccgggccctgggtactgccattatagagggaaggggaagaggagtggtaagggagagagaacactggactaagcctcagcattcagatgttcccagttacaacaccctgaacgatctctagg

SEQ ID NO: 7297 - DNA, 242 bp, Homo sapiens; identical to SEQ ID NO: 265

SEQ ID NO: 7298 - DNA, 209 bp, Homo sapiens
ctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggc

SEQ ID NO: 7299 - DNA, 200 bp, Homo sapiens
ctggttatccgagaagttccgaggattctccttggatttcttagggaaccagttgggatccccagagaagagcccatcatctcgggctactgccagcccacccagattcatcagcgtccgctgcacacaggccatgttctttccttcccagaggtccacagtttggaagatgtcagtggtgttaatgccatagcgctcag

SEQ ID NO: 7300 - DNA, 383 bp, Homo sapiens
tggttatcgaagtggtttactgtaaggctgagaaccatgcattaggcagcattcggcagctatgctgttgtctcttattttttctaacgtggaaatctgttttgtaacttgtagtaataaggtagaaattaaaaagaaaaagtattttcctgtacttgcttggctgcaaggtcaggaacacatagttccttagcggatccttggtaacgctatctgaaaaaccacatcgctgagaaatgagttctggagactctcttaacagtctgttgtccctaggaaggataagagcaagaaacagcaaatgcttttattaccttctcttttccctttaccatttctcactattcaagttttgttaagttcttgatttcccttcagtgcag

SEQ ID NO: 7301 - DNA, 427 bp, Homo sapiens
ccaagcgcttccagcccgacctctccctcccaaccaacgttcaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactccgaactctcctgcagaaatgctgcacaacgtcaccctggcgctggagctgctgaaggacgagggcctgctcag

SEQ ID NO: 7302 - DNA, 540 bp, Homo sapiens
  misc_feature (1)...(540): n = g, a, c or t
ccatggcgcttcacgttcccaaggctccgggctttgcccagatgctcaaggagggagcgaaacacttttcaggattagaagaggctgtgtatagaaacatacaagcttgcaaggagcttgcccaaaccattcgtacagcatatggaccaaatggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttggtctgcaaaaaaccttcgagatattgatgaagtctcatctctacttcgtacctncataatgagtaaacaatatggtaatgaagtatttctgg

SEQ ID NO: 7303 - DNA, 217 bp, Homo sapiens
  misc_feature (1)...(217): n = g, a, c or t
ctgtgngttttgccacatgccccacgatgacaatgaccttccctttgaagttctggagcatagcagtgtaagggccctgggtaagctccccttctgcagtgaaggcagcactgaatggaatgttgatgcttcctgaaatgtgaccacgaataaagtcttcactattccggatgtcaaccgccagganctttggtttactggactttgttttcttgct

SEQ ID NO: 7304 - DNA, 316 bp, Homo sapiens
  misc_feature (1)...(316): n = g, a, c or t
tctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaacccgcagcaatgcacagagacanggatattgccttcgcctaccagagaaggaccaaaaaggaacttgcatcagcactgaagtcagccttatctgg

SEQ ID NO: 7305 - DNA, 127 bp, Homo sapiens
ataaatttacttgtgtcagaacaaataaaagaaagttggaaatacaaatctatcacttcaaatttaatctgacatgcaattattctgtctattccagaattgtatggcaatttaactgattaagtca

SEQ ID NO: 7306 - DNA, 235 bp, Homo sapiens
ccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattg

SEQ ID NO: 7307 - DNA, 470 bp, Homo sapiens
  misc_feature (1)...(470): n = g, a, c or t
ctgcgttacatgtaacaaaagatgcaaacaaaatagattcaagttgttttgcagacagcacaatgatacaatattaggactacagaatctcagagtaaaccacaatgatttaaaggtaagatacacagaaataaaatgattttaacagaaaaatatgacattcctgaccttaggtctgggcacatgatgtctgacccctatagaggcaccttggctaaaatgggaatgacctantgccatggctgacctcacttgtgcgttgctgagcccatatgtgaacaaatccccttgatacagcaccatggtaggcatgagaggagaagtgttttaactattctcttatgaattgtaaccaacccttattatctactgatggatggacagggggtggggtgatcatacaggatgggcagacattccaagtactcttcccccagtggtggacggaacagaatctggctacacggtgg

SEQ ID NO: 7308 - DNA, 241 bp, Homo sapiens
ctgagcagcactgaacagtgtccgaacgaaccggtaaatctgcttctgctctgggttgtgtttgtcataatctggtggcacttcggatttcgaaagagggtgaagattttcatcaaaaatatctaagagcatccttccatctgggtccctgtttttgatgtgataatatattgcaagagcgacacatttaattgtatacttgaggtttggttgactgactgtgctatcatctaggaaaatg

SEQ ID NO: 7309 - DNA, 166 bp, Homo sapiens
ggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttccc

SEQ ID NO: 7310 - DNA, 483 bp, Homo sapiens
ctgagggctccatgccgaatccatacacaaggtttgtggttctcagaagagttttcagacaggaactgtttccaacttaaaatctttcaacagacaaatggaggtggaagggggatggtttacacaaagtattttcaaatgtaatcaggaaatggaagtgtaaattaaaaccgttttcaacatgtatctcctctttagaaatatcactgcttggagaatgttgtgacaagcaaccaaatactcaaaagaccttatccccagaatactggcaggactcacattactttgcatgtcataattaagaaaaatatccaaatttgatgccatttatagtgtgtcagtcaaaaatgtgtatgctgattttgatgagcaggagaaaggactgggtggtgaggaaacatgactatgcacacatgagacactgtgctgctcacgaaaccgacctccctatggagtgtccaactgaaacctctgatacacacc

SEQ ID NO: 7311 - DNA, 386 bp, Homo sapiens
ccatctgataataaacggaaataatttgatcacatgaaactttggtttgtggtatttatacacagttaaagagaagatataactttttccattactggaaattgttccagcaagcaaacttgacagaatctctcttatttccaatgtaaaatcgtcccatcatgaatttatactttatcactaccaaatttctctgaaatttctcttcagaatttttcccaaggtggaattggctgtgccaggtattaatctgtgccaattgctgtcagcctcatttacttgtactttttctcattataccattaccttgggagcaaggccctctttataatgagtgctatacaaacatgactttgaccagacctttctatctgtccatcttccag

SEQ ID NO: 7312 - DNA, 212 bp, Homo sapiens
cccccaacaaggggacaggacggtcactgtgccaatcctgtcatcaccctcctgtggatgtacaggcagtgctcaataaatgcttcgaggctgatgaggctgctggctcagggtgcgtgggttcctcaaggtggggatttctgagttctaagaccaagtctccatctgagactcccaaattgctccccacctcccatccctgtttttttttg

SEQ ID NO: 7313 - DNA, 230 bp, Homo sapiens
tggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcacttttg

SEQ ID NO: 7314 - DNA, 353 bp, Homo sapiens
  misc_feature (1)...(353): n = g, a, c or t
ccatcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaaccggtggtccaaaaatccaaacccactgataattacttctcgaggtgataggaaaggcacangaagttaggactttggctgaaatgatgaaaacacatgttcgccattttagggatcaagcgcctcgactcctgcc

SEQ ID NO: 7315 - DNA, 101 bp, Homo sapiens
gggaggaagccgactaggcgaattcacttactgaccggcctgggctgctctgagacatggaggaagccagtgaaggtggaggaaatgatcgtgtgcggaac

SEQ ID NO: 7316 - DNA, 199 bp, Homo sapiens
ctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatc

SEQ ID NO: 7317 - DNA, 101 bp, Homo sapiens
  misc_feature (1)...(101): n = g, a, c or t
ggagctttaatttattaatgcagacagtacctaacaaacccacaggtcctaaactaccaaacctgcattaaaaatttcggntggggcgacctcggagcnna

SEQ ID NO: 7318 - DNA, 130 bp, Homo sapiens
ctggcagaccccccaaccacatcagaggagttttcatttcttcctgggctgcttatctgggaagccttcaaagaattcgttacacatcatggcgatgcaggacaggaagacacagtactcttggaagtcc

SEQ ID NO: 7319 - DNA, 101 bp, Homo sapiens
ccttcaaagcctattatttctaacctaagtaaaggccccagtgaaaaacatactggggaaataaaacctctgagaaaaggttcaagcaccttttccaaatt

SEQ ID NO: 7320 - DNA, 101 bp, Homo sapiens
tgatactgtggggattcagtttaggcgctggcccgaggatatcccagcggtggtacttcggagacacctgtctgcatctgactgagcagaacaaatcgtca

SEQ ID NO: 7321 - DNA, 401 bp, Homo sapiens
  misc_feature (1)...(401): n = g, a, c or t
ttttttttcattataaaaggtacacttctgtttatatttaaacaacaaagaaaaaagcatctacacacttaaaaaattaattcaatattcctaaatctattttaactcattttaaaatactacatacagaagccagaatgcagagttaanaatggaataaggtggggagaagaaggggaccacgaagaaaaacacttagacaattacttgtctgttgtgggtaaaancaacaggaatcctgggagatacaagaaatcagnancaacctttgctcatanctgatatttttcccctcatgtttgttttttaataacgtccatatgggngctctctgtatgctcccttcctggcctancaggaggggctttcacgacggcctggncccattccagtcgtcctgg

SEQ ID NO: 7322 - DNA, 171 bp, Homo sapiens
  misc_feature (1)...(171): n = g, a, c or t
gtgacttgaagcancttgttgatcanaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaacc

SEQ ID NO: 7323 - DNA, 226 bp, Homo sapiens
ctgtgcgtgctcacgggctcctcctgctggaagagagagagatgtgcacgccactcctatggcatgtctagcaggtctgagcagtgttcatagaagaaaaatgttttaacagtctcagattttgggaggtagggggaaaaaaatcattgaaatctgggaaagacatttttaagctgctgacttcacctgcaaaatctaacaggttggattagtttttttttttttt

SEQ ID NO: 7324 - DNA, 228 bp, Homo sapiens
  misc_feature (1)...(228): n = g, a, c or t
gagagacgcaggagcctacctgagggaggacgtgtggaaggacagacagcttcaggacaaagcaaaacgagcagaacacaaaaactgcaggggactgcgctgagaatccgggtgaggaaatcatcggcacactgaaccccctactcagaagtttacctatgaaacaatcttgcacatgtatgcttcaaaaacaaataacagttagggaagaaagagagaganagaaan

SEQ ID NO: 7325 - DNA, 111 bp, Homo sapiens
ccaacatggtgaaaccctgtctctactaaaaatacaaaaaagtagccggacatggtggtgggcacctgtaatcccagctactcaggaggctaaggcaggggaatcgcttga

SEQ ID NO: 7326 - DNA, 156 bp, Homo sapiens
gtatatttggagaaggattaaagggaagaaaataataaaattgcaagaacgtcattaaatgcttaagaggaacatggcttgttcctcagtcttcaaagattgaacaataactgggcagaattttccaaactttgatactagtaacaattaacagca

SEQ ID NO: 7327 - DNA, 120 bp, Homo sapiens
tcgacattctttttgttactgatacgtttaattgttttgtttgtaaggttccagaatatcttaaccatgtaagtaaacgcttagaggaagagggagacagagtaatcacttacttggacc

SEQ ID NO: 7328 - DNA, 186 bp, Homo sapiens
ctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccag

SEQ ID NO: 7329 - DNA, 123 bp, Homo sapiens
ccagggccatgacgggcaatgccggggagtggtgcctcatggaaagcgaccccggggtcttcaccgagctcattaaaggattcggttgccgaggagcccaagtagaagaaatatggagtttag

SEQ ID NO: 7330 - DNA, 231 bp, Homo sapiens
ctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggccgaggtgggtggatcacaaggtcaggagatcgagaccatcctggctaacacggtgaaacccctg

SEQ ID NO: 7331 - DNA, 171 bp, Homo sapiens
cgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctg

SEQ ID NO: 7332 - DNA, 472 bp, Homo sapiens
  misc_feature (1)...(472): n = g, a, c or t
ggagagggtgttttctcgtgtgaatgagggttttatgttgttaatgtggtgggtgagtgagccccattgtgttgtggtaaatatgtagagggagtatagggctgtgactagtatgttgagtcctgtaagtaggagagtgatatttgatcaggagaacgtggttactagcacagagagttctcccagtaggttaatagtggggggtaaggcgaggttagcgaggctttgctanaatcatcaaaaagctattagtgggagtagagtttgaagtccttgagagaggattatgatgcgactgtgagtgcgttccgtagtttgagtttgctaggcagaatagtaatgaggatgtaagcccgtggcgattatgagaatgactgcgcccggtgaagcttcagggggtttggatganaatggctgttactacnagggctatgtggctgattgaaantatgcaatgagcgattttangtct

SEQ ID NO: 7333 - DNA, 364 bp, Homo sapiens
ctgtgtccaagggagcaaagcaccccatattcttctgaacctaaaggggtttcctcctcaaagaagcatgttttcaatccctaaactttggggccagatacagctccaagtggcatttattgctctttggagagtcaaagccaagccaccatgagcacgaaagctgtctgagaccctcctcccctcctccccagcatggagagaataattgccatttcaccctccaaaatccgaaagaagtctcccccttccgtgggtttaagcatggacacaagccaagcaagcctcagatacccaggcctgtttgattgtagctatgttggtgtatctcgtgtacaagatggaaaagtgcttttgttgttct

SEQ ID NO: 7334 - DNA, 101 bp, Homo sapiens
ctgtacttgagattttggcagctcttggaaccggatttgcttgttccagtaaaaatgaaatggctttagtgcaagagttgggtgtacctccagaaaacatt

SEQ ID NO: 7335 - DNA, 380 bp, Homo sapiens
ccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctc

SEQ ID NO: 7336 - DNA, 221 bp, Homo sapiens
cctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgaccaag

SEQ ID NO: 7337 - DNA, 132 bp, Homo sapiens; identical to SEQ ID NO: 266

SEQ ID NO: 7338 - DNA, 384 bp, Homo sapiens
  misc_feature (1)...(384): n = g, a, c or t
ctgtttacagaaatatagttgcgagtatacaaatgttccaatagaagcaaaatatctttttaatatttaacaagttatcacagatagctaaaaacatagatgcaaatgaaattcccccagagaacaaactgaaaatatctggtatcagtgctctgaaatcccaactatgaaagccatatacacaaaaatgtaacccttatatcattgcaggacaatggaagaaaggcagttcagtggttgatcagnggctcaagcaaataaaattaaataaaaattaaaaatggcagaatggtagctaaaccacttgagaacaggttaatgaaattattggactatacttaaaacattaagtaaaagaagtgaatgaaactcatttaaagttgc

SEQ ID NO: 7339 - DNA, 190 bp, Homo sapiens
ccaggggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatc

SEQ ID NO: 7340 - DNA, 215 bp, Homo sapiens
ctgactttcatatgagactcgggcttgatgtatgttagtgttctctttcttctaatagaatttctcattattggggtttaaatctttcctaaaatatttatagagtatggtttttagttttattatttttgtattcaaagacaaattaatcaaataggtttatattttacatgtgtacttcgtactcttatttgagatgggtaaaagtctgggtc

SEQ ID NO: 7341 - DNA, 130 bp, Homo sapiens
cttggaaagtggatctggaaaagtaacattccctaaaatgaagatccccaaatttaccttctctggccgtgagctggttggcagagaaatgggggtggatgttcacttccctaaagcagaggccagcatc

SEQ ID NO: 7342 - DNA, 268 bp, Homo sapiens
  misc_feature (1)...(268): n = g, a, c or t
ccanaattcttggagtttacagaattggttataagaactctcagaacaacactgagaagaagttnganctccttgtcatggaaaatcttttctacgggagaaagatggcncaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaac

SEQ ID NO: 7343 - DNA, 214 bp, Homo sapiens
gttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaa

SEQ ID NO: 7344 - DNA, 281 bp, Homo sapiens
ccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcag

SEQ ID NO: 7345 - DNA, 408 bp, Homo sapiens
cctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccggggggtgagtggaagggaccccaagtctcctctgctctcaacttggacacatctaagtttgctgggggcctttaacactcaaatgccc

SEQ ID NO: 7346 - DNA, 255 bp, Homo sapiens
acaaattcatgaaatttgcagacaacaacaacaacaaaacagctcctcaagtcaggtgacagtaatgcccctctcttgcaaagagaacaaactgtcattagtgtaacatgaagagctggctttccagtgaattttactaataaggaaacacaaaaggttacagacttgagtgaaactactcaaggaacataaaagctaaaagccaactgataagtatgtcttcacacatttctcaggtgaatggactctttgaca

SEQ ID NO: 7347 - DNA, 429 bp, Homo sapiens
  misc_feature (1)...(429): n = g, a, c or t
ccttttctcattagtctctgggtcaggcttgggaagatatatgtgttggtgatgatatacttgtctttaatcatgatttatgaagatttaggattgtgtgtgatttgtcaaaggttctgggaaaaggctggtgcatatttcattacttaatctgagattgattttatgatgctaagagatatcacactattgttcaaatgtgtgggaagtacaggtagacacaacatcccagctttttactgcttatctttgcaactgtcaaacaatgctgtaaactttaactgcttgtagttaacaattcctgttttaattataggcagattttttattctgtccaaaggggagaagtntcaatggttatttagctaaaatgcatagcaagacattataactatgacctggtatgaaatcatggacaaagnttggtaa

SEQ ID NO: 7348 - DNA, 209 bp, Homo sapiens
ctgatgagtagtagagattggattcacacccaggttttctctctctgaagccctggtcacctgtttggccctggggtgatggggagaaggttctggctgtgtcttggctatctcctgcctctccctctgtggggaatgtgttcgaggatcacagctacagcttttcggataccctttcctttgtgaagcatgtgagaaccaacattgca

SEQ ID NO: 7349 - DNA, 372 bp, Homo sapiens
  misc_feature (1)...(372): n = g, a, c or t
cctgatctncaggtgccctggagggtccgactgctttcctcaggtactgactgtggacagcacatgagtacaggatgtagagtgcgcaggccagggcatagcctccccagttagaaacaccagcaatgacggcaaagtcagcctccacgtcgcaggcgatgacatccccgtgccgtatgtgcctcctcacagcctccttgactttacccatcccaagctcgttgcctccatcaccgactccagttgatgagattccaggaatcttcttcgcagcaagaaaaagatcgtcaatggggtcaaccaagtgcttgatgttcatcttccttgcattgtagtaattgccatcagcagctcttccggcacgctctatgg

SEQ ID NO: 7350 - DNA, 108 bp, Homo sapiens; identical to SEQ ID NO: 267

SEQ ID NO: 7351 - DNA, 393 bp, Homo sapiens
ccttaacccttgccctgggagcccccaaggataataacatccctttctggggcaacaaaactgggaccgagtgggtaactgatatttgacaggggaacctaaacagtctacggaagtgtcctgagatgggcgtaaagtcaaacagaccaagcacacaggtaacactgaaataggaaagagtaagagcttctgttcaggctggaggtgctcgtatggtgggacaggaaagggggaaaagagaaaggggcaacatggcagacataccacggttcctacagagattaggggcagccctggcccgggaagtacacagggcagagagctgactctcaggccaggaaggagtttagctctgacccatcctcagggaccacggctctcccccagcctcag

SEQ ID NO: 7352 - DNA, 208 bp, Homo sapiens
aaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttc

SEQ ID NO: 7353 - DNA, 414 bp, Homo sapiens; identical to SEQ ID NO: 268

SEQ ID NO: 7354 - DNA, 461 bp, Homo sapiens; identical to SEQ ID NO: 269

SEQ ID NO: 7355 - DNA, 101 bp, Homo sapiens
ctcctcagcgcttcttctttcttggtttgatcctgactgctgtcatggcgtgccctctggagaaggccctggatgtgatggtgtccaccttccacaagtac

SEQ ID NO: 7356 - DNA, 125 bp, Homo sapiens
ccaagaacctcttccaccggaccatttctgagagtggcgtggccctcacttctgttctggtgaagaaaggtgatgtcaagcccttggctgagcaaattgctatcactgctgggtgcaaaaccacc

SEQ ID NO: 7357 - DNA, 238 bp, Homo sapiens
cctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatgggaagaaaaactgcacaggca

SEQ ID NO: 7358 - DNA, 153 bp, Homo sapiens
ctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcat

SEQ ID NO: 7359 - DNA, 339 bp, Homo sapiens
ctgaatgtcagcaattgtttcagaggtgctcacaacttcaatgaggccagagcgatctcctgttgctaaacagccataaggcaacatccgaagatccaaaccagcttctttccagagtaaatccatcaagcgcaacatttggagtgtcaacatatcctgtcgtaaatcatcaccatttttaaaaatcactccaactgaatcctcaccaaataccttgttattgtataccagccacaaaggcttcattttggaatccatgtatttgcacttttcaacatagagttctgagaggataacacatgggttcaggggtgactgcaggtcagagagggcttcccg

SEQ ID NO: 7360 - DNA, 154 bp, Homo sapiens
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaa

SEQ ID NO: 7361 - DNA, 125 bp, Homo sapiens
  misc_feature (1)...(125): n = g, a, c or t
nngcgacggcaccntcatccacctnaagtacccgntaaacctagccccaaacccactccaccttactaccagacaaccttagccaaaccatttacccanatnaagnataggcnatagaaattgaa

SEQ ID NO: 7362 - DNA, 101 bp, Homo sapiens
  misc_feature (1)...(101): n = g, a, c or t
gaggtctgagggnaattntttaactaaacatcagtacacaaaaaataccaggatagatggaatcaaaagactctgaagccaaaaggaggctagggagagca

SEQ ID NO: 7363 - DNA, 101 bp, Homo sapiens
  misc_feature (1)...(101): n = g, a, c or t
ctgggggnggctacatgactctgaaccccagggcacctactgacgatgataaaaacatctacctgactcttcctcccaacgaccatgtcaacagtaatnnc

SEQ ID NO: 7364 - DNA, 174 bp, Homo sapiens
ctgacagataataggcaggacatgttagttataaagtagttacagcctaattcacaaaagttaccaactgtttctctttctagaaagaagcaagaagttaagaaattccttgaattagcgcctggtgtgtcaggtgggagtgcagaggagggctgttagagcagtgtcaaaagg

SEQ ID NO: 7365 - DNA, 167 bp, Homo sapiens
ccataccatagatttgggatgatgtagtctgtgctaaatattttgctgaagaagcagtttctcagacacaacatctcagaattttaatttttagaaattcatgggaaattggattttgtaataatcttttgatgttttaaacattggttccctagtcaccatagtta

SEQ ID NO: 7366 - DNA, 118 bp, Homo sapiens
  misc_feature (1)...(118): n = g, a, c or t
ccatgctggncttgaactcctgacctnagatgatccgcctgcctcagcttcccaaagtgctgggatttgctaagtgtgagccactgtgcccggcctcttattcatttcttaacctatg

SEQ ID NO: 7367 - DNA, 376 bp, Homo sapiens
ccatcaactggaactatgtcattatttataaaacaggagcaatcacagggctgtggtgagaatcacatgaggtgacacatgtgaaatggtcctttcccctaagacatatataattgtgacaaggaacaaaatttacatagaaaataattacagaacaacgtaggaccatgtcttcatttctccctggagcggatgtaaaataaggtgattgatttgagcaacatgttatgaatatttagaaatgtcttctagggaagcaagctggcgctcaccgattttggtttgccaggcatatcagaaggcactttgtgacaggtgcagtagggacgcggagtgatctcttcacgtgtaggcaatgcccagcccgacacctagg

SEQ ID NO: 7368 - DNA, 128 bp, Homo sapiens
acaaattatctttgaagtttaaacatgataatatatagaaaaagtggtctgaaagtatgaagcccgaagtgtgagtttgatgatgacttagttttgcacatacatgtgagactctgacataccattat

SEQ ID NO: 7369 - DNA, 376 bp, Homo sapiens
  misc_feature (1)...(376): n = g, a, c or t
cctggacttcccctgccccatgcaataaagcaagttttatatacactccccatatttttttctaacattttcttatataaatttaaatattttacaaaaaaaggcttttttcctccaaacatataaatctgagtgaaacatagattccccacccgagaacttgtttcttcactaaaatataaatgttgtctgatattaagggtaaatgncttttgacccactggagatcactgaagtctgaattgcaccgtggagaagcacttgtgttttctgaggtctccagcaagtataagccgaattccagcacactggcggccgttactagtggatccgagctcggtaccaagcttgggcgtaatcatggtcatagctgntt

SEQ ID NO: 7370 - DNA, 127 bp, Homo sapiens
ctgatcttaaactcctgacctcaagcagtctacccccgttggcctcccaaagtgctgggattacaggtgtgagccactgcacccagccaagtttatgtatttttattctttttcatgaatgtgattt

SEQ ID NO: 7371 - DNA, 212 bp, Homo sapiens
ctgtcgtatttgggccacatgctgccgcacagcctcctgcaaatgcagtatgctgctgcgttgctcctctggattgctagagatctcaagctggaacctgacccgttgcttcttctcactatgttccttccgcttaggttctacatggagcagcaggttgttgacaatgtccaggatcatggcatactgagctgggttggtggaaaatttcc

SEQ ID NO: 7372 - DNA, 202 bp, Homo sapiens
ccttgttataaataagctgcataatcaataaatagaacaagggactttttgttgatattccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaac

SEQ ID NO: 7373 - DNA, 206 bp, Homo sapiens
  misc_feature (1)...(206): n = g, a, c or t
gttagngcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtggtg

SEQ ID NO: 7374 - DNA, 101 bp, Homo sapiens; identical to SEQ ID NO: 426
  misc_feature (1)...(101): n = g, a, c or t

SEQ ID NO: 7375 - DNA, 101 bp, Homo sapiens
  misc_feature (1)...(101): n = g, a, c or t
cctnctatgggngttaaattttttactctctctacaaggttttttcctagtgtccaaagagctgttcctctttggactaacagttaaatttacaaggggat

SEQ ID NO: 7376 - DNA, 181 bp, Homo sapiens
tttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaag

SEQ ID NO: 7377 - DNA, 101 bp, Homo sapiens
gaagagcggagcgtgtgagcagtactgcggcctcctctcctctcctaacctcgctctcgcggcctacctttacccgcccgcctgctcggcgaccagaacac

SEQ ID NO: 7378 - DNA, 193 bp, Homo sapiens
  misc_feature (1)...(193): n = g, a, c or t
ngtccaacattgcgaaaccctgtctctactaaaaaaaaaataaaaaatacaaaaattagctgggtatgatggcacatgcctctaatcccanctactgggaggctgaggcatgaaaatcgcttaaacctgggaggcgggtttgcagtgagccaanatagcaccactgcactccagcctgggtaacaaattgana

SEQ ID NO: 7379 - DNA, 116 bp, Homo sapiens
aaaagtcttgtgatttcctctcatcttttagagattcctgccaaaaattctaccaagcagagatggaggagcttgactttatcagcgccgtagagaagtccagaaaacacataaac

SEQ ID NO: 7380 - DNA, 351 bp, Homo sapiens
  misc_feature (1)...(351): n = g, a, c or t
ccacatcaatgtcatacagnttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagagcnctttccgnngatatttgggctgtctccggagtcgcagtgtcttcggccgccggaaggtgggtgacgtgcggatcttcttctttttgtggctgtggacacctttcaacactgccttcttggcctttaaagccttcgctttggcttcagctttaggaggggcaggagcttccttcttc

SEQ ID NO: 7381 - DNA, 327 bp, Homo sapiens
  misc_feature (1)...(327): n = g, a, c or t
ctgcanaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttngaangtagaatgttttcaaatgttctccagtcattatgntaatatttctgaaggagcctgcaacatgccagccactgtgatagaggctgcggatccaancaaatgg

SEQ ID NO: 7382 - DNA, 348 bp, Homo sapiens
  misc_feature (1)...(348): n = g, a, c or t
ccacttttggagagtccgactatcacggnaggcacagaactctgccatgtnactagctgaatgacctcggatgtcacttcaactctganccttanaacttgtcaactgcaaagtggggcacttcaccgagctacatcattgagctacttcactgagctacttcattgaattgggaaaattaaaggagcaaatatgggagaaggatttgcccatagtaaacactatgactgtccgcttctgccatctttcagtanacccagtgggaattatatgaaggttgataggcacttaaaccaagaatatatgaacatctattctgtgcaaggatgtgtgcattgaactcagtcc

SEQ ID NO: 7383 - DNA, 325 bp, Homo sapiens
ctgaggttgtcagtacaatgaaaccaaactggcgggatggaagcagattattctgccatttttccaggtctttgagttgcacgtcaaatctggggctgatcaccccacacttgtttagcctgcctgtgaggttcacaacaattttcccagctctgtggtcatcaatgatttcaaattcgccaatgtaaccatgcttcatcatcacagtgagaaacccggacgatgactttggagcacggcctaataagcacctggcgtttgcctctcttttcggcattgttgatactcttgagagcatctgccaggacattcatgcgcaccattg

SEQ ID NO: 7384 - DNA, 393 bp, Homo sapiens
ccttggatgcagatcaatgctccaataaagttcattatcagctcctcctgccttgtgacaggatgatttgattttacaaaagtccctttgaaaacaagagtaaacgcagacagcttctagagaaaagtctggtgaagcagcagttgataatagattttcttttagtgatgaaattaatcttgttttggtaatctacagcctgttagggataggtggagggatgaagtccttaaaactaaattgttcctctacgaatcttcgacctgagcctgtggagagagtagccccaaatccatctctctgctgaaaggtcgcctgttttggtaggtgtgaggacattccgaaacacggccatccacattcttgatacatcgcttcttctgcatctgccag

SEQ ID NO: 7385 - DNA, 231 bp, Homo sapiens
  misc_feature (1)...(231): n = g, a, c or t
nggtcctttatcaacatttagntctttcaattaggaaatggagaatgaatgtttgagttnttaaggggaattaattgaatgatattttatcatttaagatgaaatcataacactanacacatagttgtatgttttangaggaaatttagcttttctatctgtgcttctcatgaatangagcacttcttgagactctggggtgatttaagccctttcccccactgagaccgc

SEQ ID NO: 7386 - DNA, 350 bp, Homo sapiens
  misc_feature (1)...(350): n = g, a, c or t
tgtgatttttgctacaggccacagtcaggagcacatgatagtagcattggcacaggccacggtggaccgtttttcagtgtacagntccancaaaacctggtattctccctgangaatagtaaattcaggattattgacaggcccagcatantaaatctgctctcctttccttcttcccagaaagaaaacttgggcagagccgcctcacagatgggatangagaaattcaaaacagatgagccttgagacatgagagctaggncaagaaaaagctctttgatgncctctctcacaataattccaaatctaatggtgatatttgantttaattgcttggacacttttcaaca

SEQ ID NO: 7387 - DNA, 396 bp, Homo sapiens
  misc_feature (1)...(396): n = g, a, c or t
natttttgtcaaaatagtaggtgtaaaataatgtcttatggtttttatttgtatttacttgaatacaaataaatacaaggctgaggcttgagattgagattgagattgaggctgagcacctttctaatatttatggggcagttgtgtttccccttccatgaaatgtctgtacatgactttgcccattttaaaaaactgaggatttgnttttattaaaactttggtattatttatcctggatatttcctttataggttatatgtgtcccagtgtgtgacttatctttccctttttgtgatatgttgattaagcagtagttcttaatgaaattgaattagaatttttcttcattttatacttcttgggnctttctaaataaatctttcctaactcagg

SEQ ID NO: 7388 - DNA, 238 bp, Homo sapiens
ctggagagaagagagactgagtgccacccatgagaactggtggctcctctgggagggaacctggatacagtgaggagaaaagagcactgtgaattagagccagacgcttaagtccaggtgagacaggttatgccatcttccaaagtgtctaattgcctcaggcgtgaaaccaattcctatttacttacccagctccatggggtactgagatacatggggccgaaaaggggtaatatgg

SEQ ID NO: 7389 - DNA, 128 bp, Homo sapiens
  misc_feature (1)...(128): n = g, a, c or t
ttgaaaaaaaaggaccaangttcnanctacttccaggggaatccancaanatcccccgtntgaggactgacctttttccaaanacaaaaatccaggacttgaatcgtatnttcccctttntgaggact

SEQ ID NO: 7390 - DNA, 183 bp, Homo sapiens
ctgtgagggctccataaccactgttttcttatcttgttaagaggacatggcatgtggcagccaacaccttgacttcaaggtgaatgctaaaggaagagccttgtatttaaaatgaaatgaaagacaagcaacaagtcctgggcagtccagagattgtattctctacagatggcctgtttgcaa

SEQ ID NO: 7391 - DNA, 189 bp, Homo sapiens
ccatggacaagctgaggaagatgctggttccctgcccacagaccttccaggagaatgacctgagcaccttctttcccttcatctttgaagaagaacctatcttctttgacacatgggataacgaggcttatgtgcacgatgcacctgtacgatcactgaactgcacgctccgggactcacagcaaaaaa

SEQ ID NO: 7392 - DNA, 101 bp, Homo sapiens
  misc_feature (1)...(101): n = g, a, c or t
gacntgctgtanaccctggttnccanngcacagggtgaccgtgtgatggtggtgctgggcccacagactggaagggtgggacatttgctnagccgggacag

SEQ ID NO: 7393 - DNA, 206 bp, Homo sapiens; identical to SEQ ID NO: 270

SEQ ID NO: 7394 - DNA, 182 bp, Homo sapiens
  misc_feature (1)...(182): n = g, a, c or t
nctgacatcccagagatcagtttcctttctgggagggactcctcattgaggggggtgcagaagacctgcagacctgcatcaaccctggtctttgaggcttcaactccagcacactggcggccgttactantggatccgagctcggtaccaagcttggcgtnatcatggtcatagctgtttcc

SEQ ID NO: 7395 - DNA, 284 bp, Homo sapiens
  misc_feature (1)...(284): n = g, a, c or t
nctaaaacactctttacgccggcttctattgacttgggttaatcgtgtgaccgcggnggctggcacgaaattgaccaaccctggggttagnatagcttacttaaactttcgtttattgctaaaggttaatcactgctgtttcccgngggggtgtggctaggctaancgttttgagctgcattgctgcgtgcttgatgcttgtccttttgatcgtggtgatttaganggtgaactcactggaacggggatgcttgcatgtgtaaacttactaagactaatagaaa

SEQ ID NO: 7396 - DNA, 101 bp, Homo sapiens; identical to SEQ ID NO: 662
  misc_feature (1)...(101): n = g, a, c or t

SEQ ID NO: 7397 - DNA, 373 bp, Homo sapiens
  misc_feature (1)...(373): n = g, a, c or t
ncctacaggtgtgcactgaattattcccaaaaccattcacccttccccacaccgtctctgcaccaagcaccaaaaatttgataaaaactattacttattgaaaaccacttaaaattgcaatgaaaaaaattttaaatccttaccaaaacagagaaagaaaaaacaaaatgcttaccaagcccccaatatagctttcaagatatttagattaaactctaacctattgtatcttaagcacataataaggcacataataagaaattaagtaaatacacagtaattctgagtaagtattagagattataggtggtcaaaaaacccttgagattaatttttttctaaaagnaagaccttaccaaaaataactttttaa

SEQ ID NO: 7398 - DNA, 339 bp, Homo sapiens
ctgatataatacaatccagctttattcgaaagataagtattctaactcttgttcggtgtttattcaaacttgtgtttgcatgtatttgtttggactataaattttgagactatagtgagtatgtttttgactataatattttaaatggaagatgaaatttaaattaagtatttgcttgtttctttttacaataaaataggtagctttgcagtttggggagggctgttttccatgattgactgtagtatggttcaagtcagaggaaaggaagatccctggaactccatcacaagtgggccttaacgggagccatactggcagcaagaaatggaccagtgg

SEQ ID NO: 7399 - DNA, 467 bp, Homo sapiens
  misc_feature (1)...(467): n = g, a, c or t
nttttgaataaatccctccgngtgccagctatcacattcaaatttgaatnctaggatgngaaggccataataaaagcagaaaacactttttnccaaaaaccacaataaataattttcaaaccagacattgtacaattttaaattatttttcaagtaaaatntacctacatggtaaatttcatttattcangtgaaattaagtctttgtttggtgagcctttagccacaataaagagaaacaagtaatacccaagtgtagtagggaatagagtaactttgtntcccctaatgccatgctcattagctggggtaagcctgacaatgtcttgccccttaccatggncaagcccccactcaggagccccccgccctgctccatcaagccatgggtcatgcccacaaggcatgtccaatgnctggaccccatactgggctgaaaaactgctatcctgtgaagaggaaggggt

SEQ ID NO: 7400 - DNA, 421 bp, Homo sapiens
  misc_feature (1)...(421): n = g, a, c or t
nggttcgactttgccaatgtccaggagcaggcttcctgggtgtgccagtgtgatgacaacatggntcanagactanaaacagacttcaagatgactcttcancagcagagcaccctggagcagtgggctgcgtggcttgacaatgtgatgatgcaagcactganaccctatgaaggaagacccagttttcctaaaccgncaggcagtttctgctaaaatggtctttctacaggtatcatctaggtttttcctaggctttcttcttcatattctgcaaatatgtgtgtgnatgtgntngtatatgcttctgtgacaaaagaaaaganagnaataaanactttagtttgtggaaactccctgttacaactaccttcaacccaactnaggngattacccaccatggaaatgtaccangaaactt

SEQ ID NO: 7401 - DNA, 112 bp, Homo sapiens
ccaacatggtgaaaccccgtctctactaaaaatacaaaaaaattagctgggtgtagtggcaggcacctgtaatcccagctactcgggaggctaaggcaagagaatcacttga

SEQ ID NO: 7402 - DNA, 379 bp, Homo sapiens
  misc_feature (1)...(379): n = g, a, c or t
cgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgnttttgcagaatgatgaagttgcatttaaaaaattcaacctgattactgaagatgttcagggtaaaaactgctgactaacttccatggcatgggatcttacccgtgacaaaatgtgttccattggtcaaaaaatggcagacaatgattgaagctcacgntgatgtcaagactacccgatggttcttgctt

SEQ ID NO: 7403 - DNA, 288 bp, Homo sapiens
  misc_feature (1)...(288): n = g, a, c or t
nccaggttccataggatcccatcagagcagattcaggtttggcttgagttatcgatattagggtcctactaggattctctaantttatatcaaagttcagcctctcttcaaactctcctgattccttttgcctcaagaaagaaagaactccaggatccttgggctgcaggacaaatatgccatactccttgtgggtggacaatatcataggattttctgtatagctgctccagatttcagatggagcatcccctggcttcatgcaaagtaacttcaaatctgctttgg

SEQ ID NO: 7404 - DNA, 152 bp, Homo sapiens
  misc_feature (1)...(152): n = g, a, c or t
nccaggctggtttnnaacttctgacctcaggtgatccatcctcctcggcctcccaaactgctgggattacaggcgtcaactaccacgcccggcactccagcctgggtgacagagtgacactctatcaaggaggaaaaaaaaaaangaaanga

SEQ ID NO: 7405 - DNA, 391 bp, Homo sapiens
cctggcccccaagaacacagtgataggattcagcatttggtgtttctaattatacaatgactacatatatatcatagacttgctctcatccattctccaccataaagtttcaatttcctcttaaaatatggcagtcaagtttagtctcattcaaaatcttatctggtcctacagcatattacagacttagactcactcttctgttttaattgatgttactgtgtagcccgaagattttaaaaaaagatttatagatatacacttgaaattctgcagtcttgaaatactacaataaatttttcttacttatgaaaagccaacaacaacaaaaaaggccaggccaggcataagacagaggggaagggaagatgaggagggaggtttgagagtc

SEQ ID NO: 7406 - DNA, 341 bp, Homo sapiens
cgagcttacattttaggagttaagttctagaggccaatgatcctttgtttggggtattgaatattatctagtatatccagtacaggtttaagagtagttgctattttataaatgttcaacatggaccagaaaagcatcagtctataaatggattccttgggcccagagctctgacagaagaaaagtttgagtgtttgggggtagtggggtggtgactgcattactatattactgcagcatttctggtttatgtacagtagcactcaataaatatatgtttactttaattgagtaggcataaatagcattcaccagaaatcctttgctggcagccagacctc

SEQ ID NO: 7407 - DNA, 219 bp, Homo sapiens
  misc_feature (1)...(219): n = g, a, c or t
gncttgcttcttacctctatgggttcacgtcattgtatcgcctccctttggatctctcccttattttgggtggaggagcttctttggctggagcctatgctgatgggaccaacgttagagctttgatgcagagaaaaatntaaattctgcaggtacatactgttcttccttcccttctttgccatctttgtagaacctgggccttttattgcagaaggg

SEQ ID NO: 7408 - DNA, 355 bp, Homo sapiens
  misc_feature (1)...(355): n = g, a, c or t
ccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggtngccattttgtgaagccatagacatgtggtcattgggatgtgtgattgcanaattatttcttggatgggcccgctctacccangagccttggagtatgatcagattcgatacatttctcagactcaagggttgccagggagaacaagttgttaa

SEQ ID NO: 7409 - DNA, 168 bp, Homo sapiens
  misc_feature (1)...(168): n = g, a, c or t
nccactgtcacggtgtccccagccccccaggtggctgcgcactgcatcctcagtgtccagtggaaagatcgtccagtccgtgaggatattggaactgagagtcaggttagaaaccaaacccttaaaatcgttgatatatgcaccatagttcacacgtcccatgttctc

SEQ ID NO: 7410 - DNA, 440 bp, Homo sapiens
  misc_feature (1)...(440): n = g, a, c or t
nctgactatgtcactcttatgagttctgctcaggaacaagcataaaactgaataatatgacatcacagtccaagacctggtaagagttggtttctttttatttggaaataactatggtcaactttcattaatgtggaagttgactgataatgttaagagtcaaagtgaaaaagaaagcccgatcccatattcaacagtgctttcagttacaacattttttgaatttccttctctaaaacattcacagcagaggtgtccatttcacttgcctgtttcacctctagataccaccacagttgctggggtcatgtgaggtaaaggaatatatccaattgactgttagcccaacatgactatctgcaattctgatagaaaagctactttcagccatgtcttacaaagtgcttaaaagctggacagaagactttaaataaagctta

SEQ ID NO: 7411 - DNA, 319 bp, Homo sapiens
  misc_feature (1)...(319): n = g, a, c or t
nctgccggctcagcattgttcaagattcttttaaaggactggggggattttaatatccagaaaatgttaaagcagcaaaagaaaaaataaattaaaaagtcattgcaattggagatattaccaaggatgtgcttactataaagtcttcttgacatgttaattataaaatcttccaacctttggtattaaaaaaaatcatgtgaatagttgtcctatattgccttgtcatctataatttataacatagaagaaatttgctgatttttttaaaaagatggcaaacatgaatcatgactcattcaaataaaatacaaccagc

SEQ ID NO: 7412 - DNA, 121 bp, Homo sapiens
  misc_feature (1)...(121): n = g, a, c or t
tttttttttnttcagngaagtttatttcaaaaccattgaacagtatgatatttgctcatttataaatattcccatttaaataatctgagcttatatattttcagngttaattaaaggactt

SEQ ID NO: 7413 - DNA, 304 bp, Homo sapiens
ctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactgg

SEQ ID NO: 7414 - DNA, 434 bp, Homo sapiens
  misc_feature (1)...(434): n = g, a, c or t
ctttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttttctgcctcttncaaacttttcctccctgaacctgagggaaactaatctggattcactccctctggttgatacccactcaaaaaggacacttctgattaanacgggtgaaactagagatggacaggttatcaacgaaacttctcagcatcacgatgaccttgaataaaaattgcacacactcagtgcagncaatatattacccagcaagaataaaaaaganatcctatcttanagaaacagctttcaag

SEQ ID NO: 7415 - DNA, 363 bp, Homo sapiens
  misc_feature (1)...(363): n = g, a, c or t
ngttgatgtcgaaaggatggaagaagccaaaactgaacttcacaaaataactaggatatcagaaaatcagggagtccctgtacttatagttactaacaaacaagatttgaggaactcattgtcactttcagaaattgagaaattgttagcaatgggtgaactgagctcatcaactccttggcattgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtgggagtaaggntttctctggtctgattttgacaaataagaa

SEQ ID NO: 7416 - DNA, 143 bp, Homo sapiens
ctggatatgttttggatcatctaacactactctacatcctgttagaacttccattattacaattccaaagctgtagacatctgttttaatggaaagtttcccctgtctgatgtactcttctggcatgtaccacagatgtttac

SEQ ID NO: 7417 - DNA, 459 bp, Homo sapiens
ctgaatttctgaaagtgtttccttacaatggtggtacctggctcagggatgggcaggggtagccaaaccctccccgtgctgcccagttcgctgagggtgggagtaggaacaaaagtttaaggctgaggccactgccatgccctggatgtaacaaccaggaaaatcatgttaatcaaggaaacaaaaattcctctagactctgcaatactgcactcttaacaaaaatcaaatgaaaacaagacgtgtctgccacaggtctcaggataacagatgccctgtccactgagagcggcagttctgcagtcagagttctttgatcagccctggacccatttatcacatgggggaggaagggagggtgccctctcgcctggtcccatgatcctggcatggtgcaggttccagcgatgtcccaggcagggtggcaaagggacacccggtaggatgaggcactcagtg

SEQ ID NO: 7418 - DNA, 469 bp, Homo sapiens
  misc_feature (1)...(469): n = g, a, c or t
taaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgcncggggggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcacttgaatatgtgtgctgccctcagacaaagattattggatcttgtgtccaa

SEQ ID NO: 7419 - DNA, 486 bp, Homo sapiens
agcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgcttggggtcac

SEQ ID NO: 7420 - DNA, 452 bp, Homo sapiens
  misc_feature (1)...(452): n = g, a, c or t
nccactaatgtgccatcttgagttggaaaacaaaccccctccccccaaaaaaaaccctgccgctttggtgtcctatttatatatttttaaaaacattcattaaaaaaatcaaatctataataaaaatgtccctgtttgttttaaaaaagcattagtaggcatcccttatctactaaaaccatttgtttttcctaagatgcctggaagcagaaaagcgagtgagattaactcactgcgcaattaattaaaattagaattctttcctctaaacaacttccagagcaccagaaagaagaaggggccccatcaaagggagaaataaagcccttctgactcacaggagatgaaatgttcagccagagttctaacacattctggctgcatcaaaagtctttattggattactcagaaaataactcaaggctattttaaaaatgaaagatacaggcagc

SEQ ID NO: 7421 - DNA, 396 bp, Homo sapiens
ctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactgggtttcgcttgtcattcatgatgcggccagagcaggtttcctggacactttacagactttgctggagtttcaagctgatgttaacatcgaggataatgaagggaacctgcccttgcacttggctgccaaagaaggtcacctccgggtggtggagttcctggtgaagcacacggccagcaatgcggggcatcggaaccataagggggacacccgcctgtgatttgg

SEQ ID NO: 7422 - DNA, 294 bp, Homo sapiens
  misc_feature (1)...(294): n = g, a, c or t
gggggggggagataaattttaaaaggtaagaaacaaaaatcctctatccaaataaattacaatctagagacacgaaacttacatacataggaaaaacttataactcaccaatgctgaacagcgatgaaaccatactgtaactagagagatgggagccaaaagagtatctacatggggtcatgttaacggnctgagtttctgtctccctgctatagaatctaaaagtaaatgaactggctggctgatgatatgccatcaaagcaggaaaaaacttgtttactgagctccttgagg

SEQ ID NO: 7423 - DNA, 414 bp, Homo sapiens
ctgtctctctctctaaataaaaacagtattttaaaaatatttatttggcttgttccatgtgtaattttttaaattgcaagatgctttaaaaaatgcatatatcaaagtcctatttccacataggaaatcaagaatggtgatgattaccaaacactactcactttatttataacactttcccctcttggtgttgtcacttttatttctgatgacaaaattctcctcagggagagatcccactgattttatttgagccattccatcttacgcttttaaaggagtaaaataaagcagattaaactgccaaggacacatccaggataagggcagggaaaagaaaagctggtactcaaggtatctaagttatttcatgtgtaaagggttttacgatgagtttaacttttggtagttaat

SEQ ID NO: 7424 - DNA, 158 bp, Homo sapiens
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaaca

SEQ ID NO: 7425 - DNA, 187 bp, Homo sapiens
  misc_feature (1)...(187): n = g, a, c or t
ncnagacttcagttttcttnggggaagaagaggtttggtattttagggtagatataccctcagggctggaggctctacagcttctcagtaatttgtactgagagtgaaaattaatcttcactcactcactcatgtgtttaaatagcttttctttagtcccctcctatgtgtaacaaaatcatccaag

SEQ ID NO: 7426 - DNA, 423 bp, Homo sapiens
  misc_feature (1)...(423): n = g, a, c or t
gggggggctgangcaggagggtcgcttgagcccaggaaagttcgagtccaagctgggcaacagagcaaaaccttgtctcttaaaaaagaaaaaaaatagagttcagaatagataaaagagttgttattctaagaaaatagactactgaagggagaaaggctttaataatattaaaaatagggcaaggtaatgcttttcatagtatagtaagatttgcctaataccatcttatttctttgattaaaagttacttagcttcagcatgcgtgtacattcaaaatacaaaattaaagcatgagttgtcattaatttgcagaattctatgattgaagcctctaaatgaattgtgcaggaaagggagtttgtaaacaactgactacnnacattcccattgggtcatctttaaaanctggactctgcttt

SEQ ID NO: 7427 - DNA, 278 bp, Homo sapiens
  misc_feature (1)...(278): n = g, a, c or t
ccagtcattttaattngnngttctatttacattcccaaggtaaccacgttcagtaactctctagaggctaagctgttaaaatttccatttttatacaaatagcaaagatatttctttctctttctttctttctttctttctttctttctttcttttctttctctctttccttccttccttccctccttccttccttcctttctttctttttgtttgagacagagtttcgctcttgaccccgaggctggagtgcagtggcctgatcttggctcactgca

SEQ ID NO: 7428 - DNA, 166 bp, Homo sapiens
  misc_feature (1)...(166): n = g, a, c or t
ggagagaacgcggtctgagtggtatagtgatgccagcagctaggactgggagagataggagaagtaggactgctgtgattaggacggatcagacgaanaggggcgtttggtattgggctatggcagggggttttatattgataattgttgngatgaaattgatggn

SEQ ID NO: 7429 - DNA, 364 bp, Homo sapiens
  misc_feature (1)...(364): n = g, a, c or t
ctgtggctgnggggncgganaagcacatttttctgcngataattanaatggcttcccccatctctcacggactgtcccaagtctagaaaagaattgacntcctcttctattanncnaataaaanggaanagaatgtttgncttcctttcctttctgtagtgntaagaaaataaacgaacttaatggatnntaaattatcanngagcttaacnctgtactataaaccaaacattaccttttcaaaaagtcctttgaggngaaatattttgtatncgtaatacatagatgcacatataancccacncatatanaatctcaatattttaacncttctttgggtagttgcactaactcactaaccctg

SEQ ID NO: 7430 - DNA, 299 bp, Homo sapiens
  misc_feature (1)...(299): n = g, a, c or t
gaatattgtgaacctgctgggggccgtgcacnctgtcaggaccaatttacttgatttttgaatactgttgctatggtgatcttctcaactatctaagaagtaaaaganaaaaatttcacaggacttggacagagattttcaaggaacacaatttcantttttaccccactttccaatcacatccaaattccagcatgcctggttcaagagaagttcagatacncccggactcggatcaaatctcagggcttcatgggaattcatttcactctgaanatgaaattgaatatgaaaaccna

SEQ ID NO: 7431 - DNA, 282 bp, Homo sapiens
agagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcag

SEQ ID NO: 7432 - DNA, 233 bp, Homo sapiens
  misc_feature (1)...(233): n = g, a, c or t
ctaagttggtaatgatgcanaagctactcaaatgcngtcggcttgtcctggctcttgccctcatcctggttctggaatcctcagttcaaggttatcctacgcagagagccaggtaccnatgggtgcgctgcaatccagacagtaattctgcnaactgccttgaagaaaaaggaccnatgttccaactacttccaggtgaatccaacaagatcccccgtctgaggactgacctt

SEQ ID NO: 7433 - DNA, 112 bp, Homo sapiens
  misc_feature (1)...(112): n = g, a, c or t
ctgttggagggggccctncccaaagggtcctgnacccctcacaggggangaactgnacttgccgctcattcngacaaaggggggtgtggacgcanccctggaatatgccnac

SEQ ID NO: 7434 - DNA, 269 bp, Homo sapiens
  misc_feature (1)...(269): n = g, a, c or t
gtacttgtagaagcaaggccagtccagcatcagaaggcagaggcagcatcagtgactcccagccatggaatgaacggaggacacagagctcagagacagaacaggccagggggaagaaggagagacagaataggccagggcatggcggtgagggactgaggcccctaaattttggtcccaggggaaaggaagaggccagttggtccagttttgatggctatggggaagggaatgtattantaagcatgggggagaggatgccngcaggc

SEQ ID NO: 7435 - DNA, 264 bp, Homo sapiens
gggctccttaaccccactggtgagcctaagttgggaagcaattggctaataactggcctctcataattggattgtaatctatccctccaacagagactgacgtaagtctcctctttctcatgaaatattctgtaacttcctgcctttcttgattccttctttttctgacctcacctaccattcacaatctgtcacaccatacacctactgtgtaactatatgtttagtatgacaactgtatttgattgtgttaatgttagctgg

SEQ ID NO: 7436 - DNA, 262 bp, Homo sapiens
  misc_feature (1)...(262): n = g, a, c or t
attcttaaaacttaancatggtaaaatgttaagctgttttcatccactgatattattctactataaaaagcccttcttgagcagatttgatgataaaaaggagaacatttctaaggtataattagagaagctgttgcatgagaaatcatgtctccntctccattttgctatgcgttatctgaggattgtttctgaaagagatctatttaggcagtgtatgtatgtgtcagcatgtaaaaantaaagaactgaaaatagacaa

SEQ ID NO: 7437 - DNA, 300 bp, Homo sapiens
  misc_feature (1)...(300): n = g, a, c or t
agtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacnctgtccaaacatcaagcagtacagcttcctcgagagggacaagaagaccaaggtctgactaaggatttc

SEQ ID NO: 7438 - DNA, 322 bp, Homo sapiens; identical to SEQ ID NO: 596
  misc_feature (1)...(322): n = g, a, c or t

SEQ ID NO: 7439 - DNA, 376 bp, Homo sapiens
  misc_feature (1)...(376): n = g, a, c or t
aggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtccctttgctgttcctgatatgagacagacagttgcggtgggtgtcatcaaagcngtggacaagaaggctgctggagctggcaaggtcnccnagtctgcccagaaagctcagaaggctaaatgaatattatccctaat

SEQ ID NO: 7440 - DNA, 357 bp, Homo sapiens
tcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaacactgaaaatatataagctcagattatttaaatgggaatatttataaatgagcaaatatcatactgttcaatggttctgaaataaacttccccccc

SEQ ID NO: 7441 - DNA, 285 bp, Homo sapiens
  misc_feature (1)...(285): n = g, a, c or t
aatctgtataagtatctgcagttgctggaataatttgaagaccccatggagctaaggagattaagtggaggattttcattgtttcagaggggcaaggggcaaatccattgctaattctttaatgatgaaaaatggtaagaagttgttaaactcctttggggattttaaaaagtgatacctnaacanaacagagagagagagaganaaatcncactagtgangctaacnaaaataatgataaaaaggttagaacaacccangatacttactggatgcctacacaac

SEQ ID NO: 7442 - DNA, 219 bp, Homo sapiens
  misc_feature (1)...(219): n = g, a, c or t
atttcaagannggngaagaatggaaagtgggcattaactgaancagacacctcttgaggtaagatttgtggaanaagaggttaaagtgtgccagaaatttgggttaccctcctctagaaagaaattccagtaatggatctgtttaagtgttaagggagcanaagagaagacggtgaatgtacttcaatattttgaacatttttagaaataggaattctt

SEQ ID NO: 7443 - DNA, 121 bp, Homo sapiens
cctctctgccggggaaaggagggagctgcggctctttgacattaaaccagagcagcagagatacagccttttcctccctctccatgaactctggaaacagtacatcagggacctgtgcagt

SEQ ID NO: 7444 - DNA, 316 bp, Homo sapiens
  misc_feature (1)...(316): n = g, a, c or t
ccagtcatgtattcntttcagcttatttccaactcngctatccttggctctgaaaagctgtcatcactggcatcactgtatctatcactacattaaaanaggaactaatttagcaaggtataaanaaaaacctggacaattattcaatttgcnatttcanacacattccatattaaccccttagtatgaganaaaatactaannaatattcttttaccactttctagtcaccacaggaagaggtcantccaatcacatncaatggcctctttctttggccncagaaactgatcacttattttcatccgtaaactgg

SEQ ID NO: 7445 - DNA, 332 bp, Homo sapiens
  misc_feature (1)...(332): n = g, a, c or t
ggaatcctngggnnanggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactantagacnaaagtgatgctttccatgacn

SEQ ID NO: 7446 - DNA, 339 bp, Homo sapiens
  misc_feature (1)...(339): n = g, a, c or t
catcgataagtccaagccctggctactgctgctggagaggcaaaggaacaatcttgcctttcagcgccgtcggaaagctcgagatattctccangcattgggttcctcatagcggttgtacaagggttcaagacgctgntgcttcttctgtttgcttancttagttgggtctganaccttgaagaaggctggggcaaactccacaagccaccgagggtcgatggtggtaacttcncncatgtattccttggtggtgagcaccagctcatggtacaccncccattctggctgtctgttnaanagggcactggaaggatngatatagaccacctgctggtc

SEQ ID NO: 7447 - DNA, 375 bp, Homo sapiens
gctcgcgaaccatcatgtcatatgcatcgggcttgggtttttcctttttgtctctgttctctgacttgggagttttgtgggacaggagagtctgaatttctttccagtcttggtctagcttctccgtgagctcgagggcatcttctcgttgagcttgtctctccctcttctcttgttttgacttggcaatgagctcttcaatcagctctttccgggacttcggtttctcccgctcctcgccttcctgttgagtcttcttgtgaaggagcccaccgcctcctccaaagtgggcagcagtcagctcagcagacaacgttcctcgatcctcagcatcgctgtcactgtccacaatgtcattatgcttctcgatgtctg

SEQ ID NO: 7448 - DNA, 262 bp, Homo sapiens
  misc_feature (1)...(262): n = g, a, c or t
catccccccaccaagcacggtntcagattaggttattacaaagggcgagggggaggagggcatcccangagtctaacatccnacccnacctatgcagaatgacgggtgaccncgccctgacccagccacacncttgaaccctgggacttcagtgaggtangtggtatcacccccatttcacangtgggcaanctgaggcacaatgaaatgcaatanctcgtttttaataacaacatacnaaagtgtggagaaagcccccaaa

SEQ ID NO: 7449 - DNA, 361 bp, Homo sapiens
ctgtttcataggggttgttggtttcttcaagttgtctctttctgatggcaatcatttgacgtccaggtggctcaaattgggcagccttcacaggatcagtggaattggctgaaatccgctttttcctgcagtagatcaaggccactacagcagcaacaatggctgctacagcagtcgcaatgaccacagccacaatgatccccatcggtgaagagctgcccatgctgggcacttggacagtgatggtcacaggcttggatgagaacagcgtgtagcctatgtttcctgtgcagtggtaatcaccactgtgactgtggtttgcttgtgggatggagaaggtgggatccaaatgggagaattt

SEQ ID NO: 7450 - DNA, 101 bp, Homo sapiens
  misc_feature (1)...(101): n = g, a, c or t
ccatttaagggggngtagtaaaagactggttaatgataacaatgcatcgtaaaaccttcagaaggaaaggagaatgttttgtggaccnctttggttttctt

SEQ ID NO: 7451 - DNA, 326 bp, Homo sapiens
gttgtttcagaggtgctcacaacttcaatgaggccagagcgatctcctgttgctaaacagccataaggcaacatccgaagatccaaaccagcttctttccagagtaaatccatcaagcgcaacatttggagtgtcaacatatcctgtcgtaaatcatcaccatttttaaaaatcactccaactgaatcctcaccaaataccttgttattgtataccagccacaaaggcttcattttggaatccatgtatttgcacttttcaacatagagttctgagaggataacacatgggttcaggggtgactgcaggtcagagagggcttcccg

SEQ ID NO: 7452 - DNA, 160 bp, Homo sapiens
tacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtgg

SEQ ID NO: 7453 - DNA, 347 bp, Homo sapiens
  misc_feature (1)...(347): n = g, a, c or t
caaagcaccccatattcttntgaacctaaaggggnntcctcctcaaagaagcatgttttcaatccctaaactttggggccagatacagctccaagtggcatttattgctctttggagagtcaaagccaagccaccatgagcacgaaagctgtctgagaccctcctcccctcctccccagcatggagagaataattgccatttcaccctacaaatccgaaagagtctcccccttccgtgggtttaagcatggacacaagccaagcaagcctcagatacccaggcctgtttgattgtagctatgttggtgtatctcgtgtacaanatggaaaagtgcttttgttgttct

SEQ ID NO: 7454 - DNA, 101 bp, Homo sapiens
  misc_feature (1)...(101): n = g, a, c or t
ngantngggggnttttaaaaaattagaggnaattaaatagtgatttattntanctataagtaaaggtttaaaaagagganagatgatttnananaangaat

SEQ ID NO: 7455 - DNA, 353 bp, Homo sapiens; identical to SEQ ID NO: 427

SEQ ID NO: 7456 - DNA, 376 bp, Homo sapiens
cagcactttgggaggctgaggcaggcagatcacttgaggtcaggagttcgagaccaacctggccaaactactttcatcgaagttgctggaagcctttctctggttttggcccctgtaggaagttaatctcatattcccttagcaataatataaggtcactgtttcagtcctacacacttttatattcaatgggcttcttagtttatcacataaggactggcacttttttcaaaagaatattgctaacagggttaaatgagtgctaatggctgaacgtttgccaaatgcttacttctgcgatagtataaatatggattattaaagttgtctactcaagtataaaatatatgcaaaactctcataggcaaaatgttca

SEQ ID NO: 7457 - DNA, 245 bp, Homo sapiens
  misc_feature (1)...(245): n = g, a, c or t
ctgacagcggggncttgcatttntttacccgngnatntacanatatcatttcttgtgtatgccatgacttgaaaaagtttgggaagctctttagcaatatcagctaaaangatatgaaatcacangtgatagcagttgncattcagtaatttcctacaagcagcaccccaaaggaaatatagtcctaatctttactatccacttctaaatttaatgtgaatttcatacatgttattagttgtttt

SEQ ID NO: 7458 - DNA, 316 bp, Homo sapiens
  misc_feature (1)...(316): n = g, a, c or t
tttagaattaggggtaaaaaggcanaattagtatagagtacattcattaaacatttttgtcaggattatttcccgtaaaaacgtantgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggnt

SEQ ID NO: 7459 - DNA, 305 bp, Homo sapiens
  misc_feature (1)...(305): n = g, a, c or t
ccttttgatangggnttttttaaaaaacaaaattatagaagtttaanaatttaattcaaatttggaggggttttnaggaaattttnacaaaatggctngttggtttnanctgtttcctacntttgntnttgnagnaaatgggnacaggnttgnagtcaaaacactngnaattttgnatcttgatgtctttgttaaaactgctgaaaaatnattttttttnttttataataaggaataaacccccacctttattccttnntttcatctnccattttctggtcttggggntggctgtggcangcccc

SEQ ID NO: 7460 - DNA, 178 bp, Homo sapiens
aggcacactcagtattgcacttcattaaaatttcaggctcaaacttaacctagaagtttaaatgaaattgcatttgtaatttagtaattcttatacaggacaaacattgatatgtttatatacagtgtgatacttattacatttatatgctgtcctaacacaatgttttttttttttt

SEQ ID NO: 7461 - DNA, 144 bp, Homo sapiens
  misc_feature (1)...(144): n = g, a, c or t
tattttcctaactccatctcctaaaaaattccacctcattctgctcaacccaccacggcattcttgctgttcttgaacatgccaagcaggcccagggcctttgcattcactgtttattttgcttggaatgctctccccccanac

SEQ ID NO: 7462 - DNA, 116 bp, Homo sapiens
  misc_feature (1)...(116): n = g, a, c or t
aaataggaactacaaatttanatgactctcttttgggttttatcaattttcatctgctgttacattagtattatgngcactgaattaaggtattgaaattcaatcacttcattgat

SEQ ID NO: 7463 - DNA, 355 bp, Homo sapiens
  misc_feature (1)...(355): n = g, a, c or t
ccagtgatgctggngctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcg

SEQ ID NO: 7464 - DNA, 528 bp, Homo sapiens
  misc_feature (1)...(528): n = g, a, c or t
gtgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagcccttgtgttgatggttttaacacattcaggtgcctctgncttcc

SEQ ID NO: 7465 - DNA, 486 bp, Homo sapiens
  misc_feature (1)...(486): n = g, a, c or t
gttgtgtgtctgcaaacaatatgtgagccgaacatcaccaatgcctcctgaaaatgggctctgactcacttcctttttttgccaagataggttttgctttgttgtttttttctaaattgtttttgcaaacagggcataacaggtaaaaaaatactttgtaagaatattattttanaaaacccaacacaaaactgcaaatacagctccggaagcccttctcttcaactgtggttagtttgtttttgtaccttttaccccaaaggaaaaaagntggcatcttgttacttatttttatccattacattcagcacctcatccaaaagtgagggcccaagatcaagctgcagggagaggagggaacctgtaaggtcagagagggactcctctgacttannctttcccttgatgagctccnatggggtgggatggtcaaacntgtcctcggntggacctgccgggccgggccgctcgaaagcccaattcccc

SEQ ID NO: 7466 - DNA, 384 bp, Homo sapiens
  misc_feature (1)...(384): n = g, a, c or t
tatacaactatagaggatgnaatttttgacctattttaaatattgtcattctaaaataagcatgtaatatcactttcaggatatattcagtggaatctaaatatcatagtggtttnacctcttacatcattcttttaaaagtagtcttttattaagagtcnaaaattttatatttttgntttcnntggactaattctaaaatntaacttcctcttacngaatgttatcaaanattatatagctatatgcttanaantcttctattgattaagccctccaacttaagtacntcaaaatttgtactttnaagnttaaatncttttttccttgtgaacataatcctataanctaaaattttcctggaccnagctatttttgtagctc

SEQ ID NO: 7467 - DNA, 436 bp, Homo sapiens
atcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 7468 - DNA, 453 bp, Homo sapiens
  misc_feature (1)...(453): n = g, a, c or t
aggggacttccacacctcctgcctttaggccatgggtggaaagtgctcagtgaagtacacctgtgtggcccagttctgaaagctttatacagttgaattttaagtggggttgataacaccttggactgttagtgttaaaaatctantgggttgacctttaaatgcaacagtttttaaaatatattgctgcattttatagaatagtaaaggtaccattatacttganattttcctccatttttatttcttccngaacntagagnttggggccgaaaatgtttttaaagtatgtgtttgagttaaatataaagttggttcncttcaaagctaaaaaattgttaaacttgcngcttggtattgcaganaagattttataanaattttgctttanagaatgccctttggctgaactaccantgtangccnccattataatttataaatacngcatac

SEQ ID NO: 7469 - DNA, 219 bp, Homo sapiens
agggaggctctaagctaggggcactgcatggtgggacaggatggccccttgaggactgaaccctggggagaagacaaacagtaataataaaaacaaataacaagtactttaagaatggattgtatgacctatagtgacagatgacatcactaatactgaaagcttcttatattaataattttggcaaaatgtcattttgtaatatagtatatgctttcc

SEQ ID NO: 7470 - DNA, 273 bp, Homo sapiens
  misc_feature (1)...(273): n = g, a, c or t
tggataattctctaccctcaccccacagagccatctctctccagaccaaaagctggaaggagagttgctttgagagcttgtttttacaactgcatgtttattatgatactttctctccaaaggaaacttttaaatcaatgggaacaattagcaacagaaagagcacagtccctgcttttgactgggttcctattttaagcacaaatgagagctctggagccagaatgccngggttctaacttcagcattcacttactagctgtatgatcttgg

SEQ ID NO: 7471 - DNA, 553 bp, Homo sapiens
  misc_feature (1)...(553): n = g, a, c or t
gagagaagctcctgaaccaaccatttgtcaggtctggggacaagactggaagtattgactcatttgcaaggaaactaagtgggtcaacaatgaaagaaggtaataggacctcatctgcaatcctccaatttatctgcaggataaattaaatgcctaaaaaagaaacttattttttaaagtatctgctaccatcaggaaaccaaataaatagtcagtctattaatttcgttcttaaataattccgatcctttacctaatttcttgagccatttaatcatctcaactctaccttagaaccctcccaatgttttccaaatctgtcttactgggaaacaaagattaaaattcctaataaggattattttgtggatcttaatttctagattcccattttaaaattttaattccattaatttcttaataatagcattctattactgattgaatcatctctaataagccatcataatttccagaccatttctaagaacacgagctgatattgaaatgtttactaatgaccngccccgggcggcccgctcaaaacccaatt

SEQ ID NO: 7472 - DNA, 465 bp, Homo sapiens
  misc_feature (1)...(465): n = g, a, c or t
ggcactacagttactaagcagcctttggattctttgtttttgaagttagatcttttcagctattagtggaaaatgtgcctcactctactccaggattaccaatagaaatgaaaggacagaaatggcattagtgtttagagaagattatgtatatatggctgtgtgaacactgaaaattatgagggtcaacataaaatcagcattacaggtactaaaacataaatcctgatggctttcaccgttttcttaagagcaaaattgcaaaaagtgatattaacagtcatcctagacgaatatgagcaaatgatttgtttttccttaaaagagcctccaagtgtattgtgatcattttcacactgatcaaagagagcacccttctgtcaacaggtatctgcngttttcaggacctggcanaaattcttctatgttctgcctttaaaggtcaggtaccaaaagcagagacag

SEQ ID NO: 7473 - DNA, 500 bp, Homo sapiens; identical to SEQ ID NO: 271
  misc_feature (1)...(500): n = g, a, c or t

SEQ ID NO: 7474 - DNA, 531 bp, Homo sapiens
  misc_feature (1)...(531): n = g, a, c or t
aatggttctgacttaaataggttgttgagcaaggagatctcacattttaaagaatattttcagagggagaatttgagaaggggggagaaaaaaacaaacaggaatgaacataaaagtataaaattctanacaacccactaaaccagttagcaaaaagaggagctcttaattgaaatagagaatttccccaaaaaaaggtctgaatttatttttaaaacattagatttggaaaatacctaatttgaaagtttaattttcatatatacgtcaaacctgcttttagggtagtttagtcaaagctgaaacaaaacaaataaaattctggcttatatatctgatacttgaataaggactctgaaaaaaaatgttcccgttttttttctcgtcngcctaagatatatttttgacattacataaatttcagtgatatgatctggctcctatttaacntttatgccctttctcttccaatgntaacttttaattttctcctcttcttctagctgggatcnttaaaaaaaacngaaaact

SEQ ID NO: 7475 - DNA, 251 bp, Homo sapiens
  misc_feature (1)...(251): n = g, a, c or t
tcaccatggagtggtgagggtccgaggctgagacgtgtgcagatggaggagaatgggcagaggagcctgtgggttttctctgactctaggtccccactccagcaagacagcgccgctgcagcttggcccagcaagttcctccttgcagtttgggggtcaaagccacagttcatatgaaacaaaatgttcctctgcctggtctggtcctctctttgtgtattttcctanaggacctcacagtgggtgagtgg

SEQ ID NO: 7476 - DNA, 450 bp, Homo sapiens
  misc_feature (1)...(450): n = g, a, c or t
tgaatagcgtttccagccgaaccaaacaccgaacaaaattatcaaaatcgatgatgagctggtcatctgcaaaccgagcaacgatgacttggtggagttgacagggcatcttgaaacctgcttcttctaatgccttccgcatttcataggaattcatggtaccagacctgtcaacgtcgatttctcggtaaattttttggtatttttgaatcttcntccagagaatgtagaactccttcagccccagcttgccactcccgtccgaatctagcatgtcaaccataattttgcatgtctcgatgctgaagccatctgacttgatatcttggcgctttgctanaacccttctcaggatggtctgcagctcaaaggcaganatctccgcatcctctcctgccaactgggcaaacagtctcctgaatccatcatcaatgtcatccctcgcttgat

SEQ ID NO: 7477 - DNA, 477 bp, Homo sapiens
  misc_feature (1)...(477): n = g, a, c or t
gaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcaggtaaggctggcctagggacattcttctgtttgaatgggcttagagggacatgttagaaattgagccagcaataaatgagatggtgatatttttagaggattagtcctttgatttctgccatttccacaaagaagaatacttaatgtattattatcatgggcatattaggatccaaaactgaaataatacataggtattatctagttcagctncttcttctgcaccagaagatacccgaggacctcgc

SEQ ID NO: 7478 - DNA, 420 bp, Homo sapiens
gcacccaaaatggcaccacccaaaaaaacacaacctatgtcgggttcggatttttaagaagttatttcagttaagcagacactaaagtacaattatacttggcttcttgtggcataaatgatcttgaattttaagatcatttggcttttacctatttagaacaaaacagtctatattttcctgtacttagaagttggaaatgaaataatttttaaagcccacaggagattaatttgtactaagtcattactatgtatcaggcattgtgcttggtgctttctagtcactgaaggagtattaaatatgtgaaatgcctgtcacagtgacttgcatgtggcaatcactcaaagatccccttctttaaccaatgtggtgaggttgtagtattattataaatttttaattatataacaactgagg

SEQ ID NO: 7479 - DNA, 389 bp, Homo sapiens
  misc_feature (1)...(389): n = g, a, c or t
tgtaacccacctcagggtgggaattctttgcatgggatcgttcaaagttctgagaaaagcccaatgtaggtcagacacgactgctccttggactggggaagactttccttggttgtcagtccatagtgggcaggcggtcggctgcacagcggaatcccagattcnaagcacanctatcaggtgtgttctggctccgagcagcacagcgatacctgtaacaataagacctatggcacatgtaggatccacctttcttcnctcggtctttcccagaagggggaccttttgggttaagcgtttcttcaacagaatgatgaacagtccaccagtctgaagnccattcccatgcgttccccnctatgttgnatangccataaccattgggaggg

SEQ ID NO: 7480 - DNA, 511 bp, Homo sapiens; identical to SEQ ID NO: 272
  misc_feature (1)...(511): n = g, a, c or t

SEQ ID NO: 7481 - DNA, 101 bp, Homo sapiens
  misc_feature (1)...(101): n = g, a, c or t
atgtgatggtgtccaccttccacaagtactcgggcaaagagggtgacaagttcaanctcnacnagtcntaactaaagganctgctgaccccnggagctgnc

SEQ ID NO: 7482 - DNA, 117 bp, Homo sapiens
  misc_feature (1)...(117): n = g, a, c or t
ataggtggaggnatcccatattctccacatttttanctctgtcangctgctccctttccnccagtcctatccantgatactgcagacaaagggtgaggcaacaggagacatcatacc

SEQ ID NO: 7483 - DNA, 101 bp, Homo sapiens; identical to SEQ ID NO: 273
  misc_feature (1)...(101): n = g, a, c or t

SEQ ID NO: 7484 - DNA, 415 bp, Homo sapiens
  misc_feature (1)...(415): n = g, a, c or t
aatactctaatgggagaaggaatttgttcacttgttgaacttttcgttcagttggcaagggacttaaaattggggccttatgtagatcattactatagagactacccaacgcttgtcagaactactggacnagtgtgcacaattgatccaggtcaaacaggatttatgcatcntccatcattttttacctctgagccnccaagtatttatcagtgggtgagttcttgtctgaagggtgaaggaatgccnccttatccttacctccctggaatctgtgaaagaagcngacttgtagtcttgagtattgcactgtacatacttggtgatgagagcttgntttctgatgaatcctcacagtatttaaccccaataactatacccccccnnaagttgccagtagaacaagaggaaaaca

SEQ ID NO: 7485 - DNA, 176 bp, Homo sapiens
  misc_feature (1)...(176): n = g, a, c or t
gctatgacctggantttgctaacagcnccatgaagatccctgaagctgncaaggtgtcccattcnacagcacagccncntgcctctgcantacatctaccccctgtttctggagcacgatctcancctgggaaccctngacctccgncgcgaccacnctaaccccaattccagcac

SEQ ID NO: 7486 - DNA, 180 bp, Homo sapiens
  misc_feature (1)...(180): n = g, a, c or t
gtacctccttatactgagtgtgaccaccctcagcctcttgctcgccccggtgctgtggagagctgcaatcaccgaggtgtgtgcccagaccggagagacggtccagcctctgatggctcngagatgatggaccgtggaagggaagcntctgtggggagtgagcgcttanatggccagcag

SEQ ID NO: 7487 - DNA, 224 bp, Homo sapiens
  misc_feature (1)...(224): n = g, a, c or t
agccacatgctgggccctctaggtctctccngcccactctaaggacccaanaaatgcanccccagtccatntctcttttttctctccttccgggggaccaaggtaccttctggggcatacaacatggcagcagggccctcnggaagaggggtaggaggaccnagcaccattctctgtanaggaagacnggaaaggagaccctcttggcncacatttatggaggg

SEQ ID NO: 7488 - DNA, 176 bp, Homo sapiens
  misc_feature (1)...(176): n = g, a, c or t
tcccagggcacacactgttcttgcccttttctccattggggttggatttaaagatcacataggtggctgctcanaggagctgaggagaanctccatcctccccatgcaccttcaccaggtggcctaaagagcttccctgaaccccacactcagtagcaagatgaggcttcattctt

SEQ ID NO: 7489 - DNA, 352 bp, Homo sapiens
  misc_feature (1)...(352): n = g, a, c or t
cctgagactggatctgttcaaacagcaaacgcccacagatggcccagaggtggtggtantcanggtgtgtgggtgtttttanggttctttactgttgtttctttcacccaggggtggtggtcccacccagtttgntgctgacggngacaggaaattanaatctgtttgcaaattgtccnacccacccccctcaacatgaggggcttccattttctgtgttntgtaaggnaactgtttccttcatgcccccatgttcctgatnttacttctgatttctttttaaccnatgttatcatgattaacaaaatttccccccctttaatgacctccgccgcgaccccctaancccaat

SEQ ID NO: 7490 - DNA, 382 bp, Homo sapiens
  misc_feature (1)...(382): n = g, a, c or t
cctgcaataaccatctcacctataccctgcaagaaaggaacagttgcttgcggccanccccctgttgtagaaaatgccaagacctttggaaagatgaaacctcnntatgaaatcaactccctgattagataccactgcaaagatggtttcattcnacgncnccttccaactatccggtgcttacgaaatggaanatgggctatacctaaaattacctgcatgaaccccntctgcntaccnaaggacttattctatgaaatactttaaaaattcctcntcaccaaaggacaattcnataaatacctcccaacctnatcntccttggagcccgaggtggcangagtccacgccctgatccctaaaatggccaacatgtgttttc

SEQ ID NO: 7491 - DNA, 117 bp, Homo sapiens
  misc_feature (1)...(117): n = g, a, c or t
aaaataaaaatcntcaataattttatcncccaccaaacaatcacttttaatgtgctggtacaggttagtctattttaacntttctgaaatcntatacatttacatgattgttctcac

SEQ ID NO: 7492 - DNA, 101 bp, Homo sapiens
  misc_feature (1)...(101): n = g, a, c or t
catgancaccctgcnataattagagtttccccaataantttacccaactatcaacctttattactacttatggcttatngtntnntttaatgtctttttta

SEQ ID NO: 7493 - DNA, 160 bp, Homo sapiens
  misc_feature (1)...(160): n = g, a, c or t
gtaagactaaatatttccatgtgaaantcttccgacatcaacttgaaagagaaatttgtaaggaagaangtcattaccatatctnattactctgaatgtaaaggagtaatggaaataaaggaaccntcatctgtgtctgactttaatcaaaattttgagg

SEQ ID NO: 7494 - DNA, 184 bp, Homo sapiens
  misc_feature (1)...(184): n = g, a, c or t
ttcagcgagggaccatcaactgcaactttgcgggggttgccttgggtgattcctgnatctcccctgttgattccgtgctctcctggggaccttacctgtacagcatgtctcttctccaanacaaaggtctggcanaggtgtctaangttgcacaccaagtactgaatgccctaaataacgggct

SEQ ID NO: 7495 - DNA, 297 bp, Homo sapiens
  misc_feature (1)...(297): n = g, a, c or t
aaaacccaaactaggctgatactcctgtnttgacctgaggtcattctgtgcctgtcaaaccaaatancacattcaatcttttgtatattttgaagactcacaaacccanaaatttttacaacctctttctcactctaattaaaacctactgctctgtcaatgggaaagaatgagtccnaacnttctgaaaaccgtacaaatgtgtttacattttagtgggggcttcctgcatctttaacctctttaaattnacatacgtaanatcttgtgtaataacccntttncaaatatgcagat

SEQ ID NO: 7496 - DNA, 111 bp, Homo sapiens
gtagtaaaaaaaaaactcaggctgtctttctggaactttcatgctacatggaattaactgttccaactgggtagcaaatgctatggtcactgacataataaaggactcacc

SEQ ID NO: 7497 - DNA, 134 bp, Homo sapiens
  misc_feature (1)...(134): n = g, a, c or t
atggtctccgatctcctgacctcatgatcccgccaccttggcctcccaaaatgctggnattacaggccgtgagcgaccgcccccggccaattcaaactatctttttaaagntatatgagtgatggaatgctaac

SEQ ID NO: 7498 - DNA, 101 bp, Homo sapiens
  misc_feature (1)...(101): n = g, a, c or t
tgtaatngtgggttctgatnatacncatagcccctaattgacagcctttagtacttgttaccttctgttctaagagttttatgtntattaactcaccnaag

SEQ ID NO: 7499 - DNA, 392 bp, Homo sapiens
  misc_feature (1)...(392): n = g, a, c or t
atggaagagccgggaacngagaagtgtggggaagagataggaaccngcaggatggcaggggcaaagggctcaagggtgaggaggccantgggaccccacngagttggggagataaaggaacattggttgctttggtggcacctaagctccttgtctgtctccngcacccngaatctcattaaagcttatttattgtacctccaccgnctgtgtgcnatggggtcttttgtggaaatcaaggancncacaggnttcatgtgtactgtcnccncntgggatggaacccgaggcntggaancaanaccctaaatgaagagggcctaacggctgnnattccccgcccccttacgaacnncttgtctttttttttcctctccnnaaaaaatgtttaa

SEQ ID NO: 7500 - DNA, 350 bp, Homo sapiens
  misc_feature (1)...(350): n = g, a, c or t
gggacatctatttggggatcaacatcnccnacngcgaggaagtggcagtgaagctagaatctcagaaggccaggcntcccccagttgctgtaccagagcaagctctataagattcttcaaggtggggttggcatccccncatacggtggtatggtcaggaaaaanactaccatgtactantcntggatcttctgggacctancctccaagacctcttcnatttctgttcnanaaggttcacnatgaaaactgtacttatgttagctgaccnnatgatccgtagaattnaatatgtncntaccaacaattttatacnccgagaccttaaacccgataacttcctaatgggt

SEQ ID NO: 7501 - DNA, 104 bp, Homo sapiens; identical to SEQ ID NO: 428
  misc_feature (1)...(104): n = g, a, c or t

SEQ ID NO: 7502 - DNA, 117 bp, Homo sapiens
  misc_feature (1)...(117): n = g, a, c or t
aagcgtgcatggcagaagtggagagtaagtaacacccaacaagtcngggtgggcactggatcaattttggggaccngatggaccccagtgggaatgctggctctgccactgcaatgc

SEQ ID NO: 7503 - DNA, 373 bp, Homo sapiens
  misc_feature (1)...(373): n = g, a, c or t
gtcaagtatacggtatgctctcaaaaaaatgttagctgtggtttttattgncttattataattagtaattctttcnaattaataatataagcttttacacacatatcataaaagttattaaaattattanagatattttgagtagngacgctgaagaaagtaaaagtggaattcctaantcatacttgaaagtatcnattatatttatagaagatcagtcctactttcaaccnccaagcccngcangaattgaaaacccactggtcaacatatgtcnatgcacatggaaaaaggatacnactgtctttaaattccctaaagaaagctgagtggagagccttctggtcactgcagtccnacctatcattacncn

SEQ ID NO: 7504 - DNA, 409 bp, Homo sapiens
  misc_feature (1)...(409): n = g, a, c or t
ttaggtggttttagctcttatctggggtatgaaagcaatttagctcatctcacagaaacaaaagcnggtgctgaatcatgaaaacctcaattatttttancatgcctcttaatttttctttcccctggtttcttgtcgtctgtgcttgattcttgaacaggtaaccacttgagaggatgccggcgatagatgggccntggaggaagtgtcancaaacatgaaaaagcaaatccggccntaactatatagacagtccaccccaactgttcagccacgtacccntagataaatccnactattgcagaaaaaagaataattccctgaaacatctgttcnnctagcttctggcccttgtaatccatctgctgggcagcgagctcagatgctccagcntggntggctgaggagg

SEQ ID NO: 7505 - DNA, 321 bp, Homo sapiens
  misc_feature (1)...(321): n = g, a, c or t
ctttaagaatgagagcctgggcatggcctttctgcacctctgtcacctccctctccgccntggcatcccccctggaggaggtggccntatgtgtaacctgtaccnaattaanctgttttaaatttacagactacaagcaactgaacccnaatgtctaaatgtacnttcttttctgtactacatttcacctaatattgcagaactaatgacaattttaaaagttnctattacccnattctgtctactgtagcaagataccttaagttacaaccaaatcttacctgccccgncngccnctccaagccccaattcnncacccct

SEQ ID NO: 7506 - DNA, 191 bp, Homo sapiens
  misc_feature (1)...(191): n = g, a, c or t
gagtgaacagccccgcttggctgtggcatctcagtcctatttttgagtttttttgtgggggtacaggagggggccttcaagctgtactgtgagcagacgcnttggtattatcattcnaagcagtctcctcttatttgtaagtttacatttttaccggaaactacnaaattattttgggtgggttcagccca

SEQ ID NO: 7507 - DNA, 441 bp, Homo sapiens
  misc_feature (1)...(441): n = g, a, c or t
tcaggtgattatcctgaaccatccaggccaaataancgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggnctcagaactgtttgtttcaattgg

SEQ ID NO: 7508 - DNA, 548 bp, Homo sapiens
  misc_feature (1)...(548): n = g, a, c or t
gacaatatcctggttaatgaatccaaanctattttaaagctttgcgattttgggtcngcttcacatgttgcggataatgacacaacaccttatcttgtcagtagattttatcgtgctcctgaaatcattataggtaaaagctatgactatggtatagatatgtggtctgtaggttgcaccttatacgaactctatactggaaaaattttattccctggcaaaaccnataaccatatgctgaagcttgcaatggatctcaaaggaaagatgccnaataagatgattccaaaaggtgtgttcaaagatcagcattttgatcaaaatctcnacttcntgtacatagaanttgataaagtaacanagagggagaaagttactgntatgagcaccattaatccnactaacgacctgttggctgacttgattgggtgcccgagacttcctgaagacccacgtaagaaagtacnccanctaaaggacttgttgggaccncattctgatgttggacccccctaaaccnaattagccatcaacccaggncccctacc

SEQ ID NO: 7509 - DNA, 476 bp, Homo sapiens
ccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactgg

SEQ ID NO: 7510 - DNA, 476 bp, Homo sapiens; identical to SEQ ID NO: 7509

SEQ ID NO: 7511 - DNA, 642 bp, Homo sapiens
  misc_feature (1)...(642): n = g, a, c or t
gagggtcaatagtgcagtcagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgtttttacatatttcagttaaatgaatgaatgctggttgtattttatttgaatgangtcatgattcatgtttgccatctttttaaaaaaatcagcaaattcttctatgttataaaattatagatgacaaggcaatataggacaactattcacatgattttttt

SEQ ID NO: 7512 - DNA, 251 bp, Homo sapiens
tcggggtcagctagtgtcctctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcag

SEQ ID NO: 7513 - DNA, 636 bp, Homo sapiens
ccatcttaagttaaagaccctttatcataaaatatatggttttaaattttactcaaattgaatttataatccctatgacttccctacatatacataacaaaagagtgtagtaaaattagcaaatactaaactatattgataatttatcattcttagtttgtggtttttagaaacagtacacgcacctaatatatgtcgattccttggcttattagttgcagtgtacaatgcaacaaaatacaaaatacatgcttggtgaacattcgttcatatctacaagacggcagctagagattaggtttcaatactgaccatttactatcctacaagcaattagcattacatcataatatgccatcaaggcaactttttttatactgaaaaaatcaaaataaaaaccgttatttgtaaacttttatacgaaatgtaactcttcaagtggaaataaaaaataaaatttgtctatttactattgaatacacataggatttcaattttcattataccgagaaaaaagctcttttgtgttgggaaaataatgcttcaaaaaataattagtagaaaaacccctagtataatgttttgtcctttcaatgccagcacagatttgggaacatactggaggatgaagttata

SEQ ID NO: 7514 - DNA, 640 bp, Homo sapiens
ccaactctagtcatacttggacctcgtggaaacatgttgttttctttgattggagagggacacaaagataaattatttttatatacttcaattgctttaaagtattacaaagacagggagcagatcagagataataaaattggaataaaactctataaagattctttgccaccttcaccattgctatttcctggcaaagtaacagtagaccaagttactgatagattggtaatagcagacactggacatcatagaattttggtcgtttggaagaatggacaaattcaatatagcattggaggacccaaccctggaagaaaagatggaatattttcagaatcaacttttaattctccacagggtgtagccataatgaataatatcatatatgtggcagacactgaaaaccaccttataagaaagattgacctagaagctgagaaggtgagcactatagctggtattggaattcaaggtacagataaagaaggtggagcaaaaggagaacaacaacccattagttccccttgggatgtagtttttggaacatcaggttcagaggtccaaagaggtgacattttatggatagccatggcagggactcatcagatatgggcacttctgctggactctggcaaac

SEQ ID NO: 7515 - DNA, 383 bp, Homo sapiens
ctgtagagtgggcttatcatctttcaacacgcaggacaggtacagattcttttccttgaggcccaaggccacaggtattttgtcattactttcttctccttgtacaaaggacatggagaacaccacttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcaaagaagataggttcttcttcaaagatgaagggaaagaaggtgctcaggtcattctcctggaaggtctgtgggcagggaaccagcatcttcctcagcttgtccatgg

SEQ ID NO: 7516 - DNA, 301 bp, Homo sapiens
ccagtcggggtactgttcggacaggctggaggagtggctgtctctgccttggctggactgagatgcagaaccgctggagccccacgaggtgtctccctggtggactgtcccattctccaacagactgcttttctcctgagctttttcctccatgacgggctcgcagctaagcctgggcagctttgctggcccgaaggactcctgtttggaattaaatgtcactggtgacaataagggcaacatgagagcttgggatcctccaatggtcgggagggagatggcatttttgagcaccggggag

SEQ ID NO: 7517 - DNA, 582 bp, Homo sapiens
  misc_feature (1)...(582): n = g, a, c or t
ctgntgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtat

SEQ ID NO: 7518 - DNA, 306 bp, Homo sapiens
ccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttataaaaaaaaaaaaaaaaacc

SEQ ID NO: 7519 - DNA, 191 bp, Homo sapiens
ctgcaagataatgaggcacactcagtattgcacttcattaaaatttcaggctcaaacttaacctagaagtttaaatgaaattgcatttgtaatttagtaattcttatacaggacaaacattgatatgtttatatacagtgtgatacttattacatttatatgctgtcctaacacaatgttttttttttttt

SEQ ID NO: 7520 - DNA, 565 bp, Homo sapiens
  misc_feature (1)...(565): n = g, a, c or t
ccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgntcattttaattgcaaagctg

SEQ ID NO: 7521 - DNA, 403 bp, Homo sapiens
ccacagaacagtccctttttgagtaaagcagcaaggttgcttaatgacatgctatgtggttaacaagattcaactgccacatcaaggactttaaataatttcaagattttaaatgtatttatgaaatgaactcattacagcagctaatcaatgcaaactttgtcctttttctttgtctttctaagagaaactgaatttaatttaaatttaaattacagtgtctaaaacttggtaaaatattttaaatttgaataagaggaaaaaaaaaacatgaatttatttatgatggagcttcatacccaggacagtagcttcttaaatgttagtaaaataattatgttaagcattaaaacaattttgaatatgtaattaagcatttatgttaaaaaacatgtttcttacg

SEQ ID NO: 7522 - DNA, 350 bp, Homo sapiens
  misc_feature (1)...(350): n = g, a, c or t
tggagtaagtctggcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttcttttttttttttttttttttttttnaaaaaa

SEQ ID NO: 7523 - DNA, 281 bp, Homo sapiens
ccaattgatttgatggtaagggagggatcgttgacctcgtctgttatgtaaaggatgcgtagggatgggagggcgatgaggattaggatgatggcgggcaggatagttcagacggtttctatttcctgagcgtctgagatgttagtattagttagttttgttgtgagtgttaggaaaagggcatacaggactaggaagcagataaggaaaatgattatgagggcgtgatcatgaaaggtgataagctcttctatgataggggaagtagcgtcttgtagacc

SEQ ID NO: 7524 - DNA, 500 bp, Homo sapiens
  misc_feature (1)...(500): n = g, a, c or t
cctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgacgaggcccaagatgagccccaaaatcaggggcaaggtttcttccagttgctcccgctcatccactgggcatttatgctcttcactgaagacaaaatctgagataatgtcaaaaggttggatgtggaccgcagacaggatcatggtgaccgtcttctgcggatcactagaggccagtgaaatggtttgttgagcttgacactcataggacttcccagcgggggtgaccaaggcaganaggtggtgcgagttggctgtgtgcttccaacactgactgcgtctttga

SEQ ID NO: 7525 - DNA, 304 bp, Homo sapiens
ctgttaaagagtggaggacacccttgaccctaacaaggaaaacaaattaagcctttatgtacaagcaaatttagagctcttttaagtgtccaaagctattaattagtttaattaaggcattaaactaattctgaattaacatttttataaccaagaactaaaatgttcaaattttttctagtacaaaaaaattaaatttgctttagttataaaagagctctgtcaatatacacaaactatatacttcagacattcacaaaaatgtgagcagaaggcttatcaaaagacatttaatacaattagt

SEQ ID NO: 7526 - DNA, 436 bp, Homo sapiens
  misc_feature (1)...(436): n = g, a, c or t
ccacgtacatcctcccccagaaataggataaataaagagtattaatgagaattaactgccttgagacatttctattatttcttgttgagagaaccattcctaaagtcttcttgatcactattagcatatggacattataaaataaataacctgacaacttgacctgcagttcctggaggatgagtaaacaaaactgatgttaacccactgagtncactcttgtaagagtaatactgtagtgatgagagtactcccacatacacaaacatcacagtaaaaggtgcctatgattttcaacttcattgttcaaataaagggttcgctaagtgatcacaagacagcaggcttggttgcttccacatattgacttcctagagattacatatgaagnttaatctggtctggctgtacactatatgtgtataacggtgagtan

SEQ ID NO: 7527 - DNA, 534 bp, Homo sapiens
ctgggatcatgcaagaggcagtaccttcctctctaagtcatagcagtgaataggaagacaagaaaaactgtctttcgagcaccctatatccaagtcagaattctgaaggttttttccagtagatccaatgctataatggttaggttcccaggctagcctaaaaaattccacttacccaaaataatccttttcattttgcagaaataaattttgtgagatagtttagaaacctaccatcatttagtccttcattttttaagaataattctaaatatgtactaccaattaacaataaatgtagggagttagggactaaatgtaaggtaaataaacacagccaaatcttttctctacctattctcccagaagctccattaatactaatctgtatcttttctcgtaggttcaccatcaaaacttatcaaatgagtgtgaagacacacacatggacacaaacacacacacaaacgcatgtgcacgaagcttcatttctgaagtgaatctgtagttgagtttttaaggatgtccctggca

SEQ ID NO: 7528 - DNA, 562 bp, Homo sapiens
ctggcaatgacaagactgggagtatcaaactaggattgttagttcaattaaaatttcagataaacaataatgtacttatactaaaaaattatttgttgtttatctgaaatgaaaatttaactgggtacccaattgtttgtttgtttaatctaaaaaccctgattgaaatttatctaataaaacatcatttaatatctaaaataaaataaatttactataacatctttataactattcaatcaatgattcatcttctatttttccaaattcttgcacaaatatttgatgcttaaataaatacataaataataaataggttaataagttacacttgaaaataatttatgttatgatgaaaaaacttaaagtgcttccacatgtcctcacaacatcactgtgaggtaagatggtggctaatactttttccacttagaaataaaggagaaaccaaggcacagtggaacaaggacttgtggatcctggctagcagactaggggttgccagatttaacagaaaaaaatccaggatttccagctaaatttgactttatggcaaaattta

SEQ ID NO: 7529 - DNA, 616 bp, Homo sapiens
  misc_feature (1)...(616): n = g, a, c or t
ccaagatggttggggcataccttggttttatacattttagggagacataagacattaatcaatatatgtaagaagaacattggttcagtggggagggagcttccaggtcacagataggtgagacacaaacagttgcattcttttgagtttctgattagcctttccaaaggaggcaatcagatatgtatctatctcagtgagcagagagataactttgaatagagtgggaggtgggtttgccctaagaagtttccctaagcttgagttttccttagtgattctggggccccaagatattttcctgtcacagttgacatccccaacacagtgtttagggctcagaaaaagataccctaaaatagggtgctttggcatgctgaatgctttgaataaaggaggctgaagggcctcagaaataagagaacaaaggtctgtctctgacccactgctgcccacctcccttcccttccaaagcacagggagggattttctttgaagttctcttatttgattaagggaagtttcttccagaaggaaggtaattgtcctggacaccccttnctgggaatctacatcgatcagagaagaataactcatattgcaggacgggagaata

SEQ ID NO: 7530 - DNA, 554 bp, Homo sapiens
ccaagtaaatttgagaaatgaattaaaattaagaccattcattgcaggactcttcaatgtccttaatgtgtgttgtgatctctaagggtggttatgggggtatgatatgaagtatttcccaaacttactttaccctggaacccttcagtggaccacctctggggattaatgttcaatgggaacacattttgggaaaggctgtccaagcatacacttttgtgttagatacaattaaaaatgacatctaaggttaagaaatgacaaaacatggcaagaatatgttttagaaatggtaatgttcacttaaaaatactaatcttctaaaactataatatttaaccagcactgagtcagtttgtaacttgatatggaaagagtaagcaagcccaaatggcccattttacccgaacaaaaagtgagagaagactttatattaacatattagtctgaaaaaaaatttgtgcttaagtgtgccaaggaggtaaaggataagaaaggcaagacagttttctggctgccgtgtgatggctcacacctgtaatcccagcactttg

SEQ ID NO: 7531 - DNA, 445 bp, Homo sapiens
  misc_feature (1)...(445): n = g, a, c or t
ttctctggtaaatgcttngattgctaaatagtgatggtanatgaanacaaantaatagggggccaagctnttgngaaacaaaggtataggtntggnttncattgctctggaaattttactctcattcctgaaaagcataagcagggatgaaaaatagcttntaaaantttactttccttccagaaataaaggatcnattcctacctgtccaaaactttcanatggagtagtaggttccggtaaaaatttctatcttgacttcagttcccanagaggtttgctcttaagaagcgtatgaggtgactttggaacaaggaatatgcatgaccaacatctggtgtanacagagtctgggtcctgaaaatgtcagcaaatgagatttacaatattagagcttggaaataacctcagaaaacatctagaccangcncattacatcacagat

SEQ ID NO: 7532 - DNA, 663 bp, Homo sapiens
ccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatattaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaattttttttcttccctgacacagggtctcactctgtccccagactggagtgcagggcacagtctctgcacctcacctttgggctcaaatgaccctccta

SEQ ID NO: 7533 - DNA, 608 bp, Homo sapiens
ctgggaaatactttatttaagatattttatatggttttctcccttttacagaatgaaacagtgattcagagtgcatataaaagcctcatacaacacttggaagaaataagggttttagtattagcaactcattttgaacatttgaaatggaatgatatgatggaagaggtattaaaatttttatttctttaaataaaagtttgatagaatttggtaaatgagaatgaacttgtgattagttcagtccttagaccagactaaagggtgccatatacctccttagtacatgtatactatctgaatcttagaatgtcatgctctcagagtaccttgaattcatcggatggcatatgtaattttatatgcatttccggaagccatattttaaaacagactctgggaaactagaaaattgtagtacttaatgcaacagtaatgtttattttccagtattcaaattgaggagggctctaagatatcatttgccatataaacggtcaaaatgtggaattaattataccttaagtctaattttctgattatcttctcaagctatgctttatactactatttatcatgatggattactaagaacctctttctttttt

SEQ ID NO: 7534 - DNA, 417 bp, Homo sapiens
ctgaaccctcgtggagccattcatacaggtccctatttaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttg

SEQ ID NO: 7535 - DNA, 414 bp, Homo sapiens; identical to SEQ ID NO: 600

SEQ ID NO: 7536 - DNA, 620 bp, Homo sapiens
  misc_feature (1)...(620): n = g, a, c or t
cctatgtcacaggggagagaagctcctgaaccaaccatttgtcaggtctggggacaagactggaagtattgactcatttgcaaggaaactaagtgggtcaacaatgaaagaaggtaataggacctcatctgcaatcctccaatttatctgcaggataaattaaatgcctaaaaaagaaacttattttttaaagtatctgctaccatcaggaaaccaaataaatagtcagtctattaatttcgttcttaaataattccgatcctttacctaatttcttgagccatttaatcatctcaactctaccttaaaaccctcccaatgttttccaaatctgtcttactgggaaacaaagattaaaattcctaataaggattattttgtggatcttaatttctagattcccattttaaaattttaattccattaatttcttagtaatagaatgctattattaagaaattaatggaattaatttcttaataatagcattctattactgattgaatcatctctaataagccatcataatttccagaccatttctaagaacacgagctgatattgaaatgtttactagtgaatatagctaatgtaattactctttaaaacttaataggnta

SEQ ID NO: 7537 - DNA, 612 bp, Homo sapiens
  misc_feature (1)...(612): n = g, a, c or t
gttagtaataaatgtagccattacctattctactggttattagtacaaaaaaacccagccttttcagccattcatttccaaacactgatggtttccactgccagactatacacaagtttctaatggtccacagtaaattgagaatgagaacaatgcagtaaattattaataaaactacattcttttcttttttaaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacacctaggtaattcncgtcattttataataaaattatgattttagggaagtactccatgttctccatgagccttactctgatattcacttaccacacccta

SEQ ID NO: 7538 - DNA, 645 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgttttgaaggcatctacaccattaagagtgatgtctggtcatatggaatattactgtgggaaatctt

SEQ ID NO: 7539 - DNA, 481 bp, Homo sapiens
  misc_feature (1)...(481): n = g, a, c or t
ctgtgacagggcttttgtgtcccgccagactttgtacatagcataacctgtttaaatcccatatgatgcaggttccgtctctgctcacacttatcagtatactgtatggtttgcaaacaaataagctggttatctcttctgtgtgaccatagagatgtatttgagtctccatttctatttctgatggctgaaattttaaaattaagtatgagataaaaaccacaacaaaaagtactctagtatagtatctcaaaaataaaacaaccaaagtgactcaaatggtcttctcaaacatatcattcttcaatcctattcagagtaaaacaaagaaagaaattaaaaaatttttaattcctcataatttccagttatctggntttcatttttgtctattcttgtccaatctttgttcaaatatacatgtatttttatagttgtaatattgccacataaaaatttcctattttatattttacatatt

SEQ ID NO: 7540 - DNA, 561 bp, Homo sapiens
ccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaatttcatttcagataaacacaaataatttttagtataag

SEQ ID NO: 7541 - DNA, 411 bp, Homo sapiens
  misc_feature (1)...(411): n = g, a, c or t
nggncgaggtccaaattgctcactttctaatgatagcctaatagttgtaaagttgttctggaagaaagcaggggaagagagcagactttaagactcaactcactcaatcaactaacaatggaataatacaacatggactcacgatcaaaatgatagcatttcaactactactgcattcttgtacatttagtactaggagactgtcaacagtaccaaatatttatttctgtaggttattaaaagaatcttttgtgtgtttcccacattcattcttagcttactatcaattaccaagatcttagttgttgcaattactcaggttttagggtacactccttgtttcctgtcacaaatctcattttgaaatatggcagagtaggaccacataagctattacttatatgaattcag

SEQ ID NO: 7542 - DNA, 423 bp, Homo sapiens
  misc_feature (1)...(423): n = g, a, c or t
ncgaggtctggcctaggtgaggagaggcaaggggtgcagtcgtgttagtaaagttctgggggaaaaggcgtagttgttcaagttaaggcatggaaaatcatgcgacgaaaaggattcttgaagtagaatcctattctgatcttatctagaatgggtgataaggctggaaagttanaatgacataaggtaagttgttgatccanatattagaattctgattgctaagtgactaaaagtttagggcatgggcaaaagatacataaaattatgtatctgagccctttcctatttccaaggccacccaaaagtagaagaagccacatggtaagaaaggtagtggaactctggaaagagcagagtctggtctggaagtcaggagacctccttagacctcagctctgtgattcaccagtggtggggtct

SEQ ID NO: 7543 - DNA, 306 bp, Homo sapiens
  misc_feature (1)...(306): n = g, a, c or t
ccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggnttggagcacttacaaggctgtggtagaatcataccccatggataccacatattaaaccatgtatatctgtggaatactcaatgtgtacacctttgactacag

SEQ ID NO: 7544 - DNA, 385 bp, Homo sapiens
gtctgtaatattcctaaaaggaatatctacatactatagcctatcaaatataatctgcattttgcaaatcaatacaaaaatctatccatcatttatacattttatatttatatactttttaaaaattagattttattgctagggtgaatttggaattcaaattaaatttggaaacttaataatgctcttctcataaccttctccccattctttttttaatttttaaacactggaagcaaatgattatcaaaatgagactgcaacttaaggcattttaaaagaaaaaataattaggtgccatatagcattttatttcaaaagtatattttgtcccacttttctcactagcaagagtaaaacacaaaccttttttcataaatatgac

SEQ ID NO: 7545 - DNA, 369 bp, Homo sapiens
ctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagagg

SEQ ID NO: 7546 - DNA, 292 bp, Homo sapiens
ctggtgaaagaatgatgctcgagttgctgcaactgaagctctgccccaggggtgcttggagatctcgaagggatgcattctgagccgagaatgtccactgtgctgcgtgggggaaggacacattgtactccacccgccatgtagctcaggtagacaaccttctgctggaggtcctgcatgaatccaaagctgaggtgtccataggggaatgagagaagcaggtggggatgggcaccctcacagcttccctggaccttggttttgttggggttcagtacagagatgccccagg

SEQ ID NO: 7547 - DNA, 442 bp, Homo sapiens; identical to SEQ ID NO: 663

SEQ ID NO: 7548 - DNA, 476 bp, Homo sapiens
ctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaaaagtaa

SEQ ID NO: 7549 - DNA, 567 bp, Homo sapiens
  misc_feature (1)...(567): n = g, a, c or t
ctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcaagaaagaagctcaaaattattcctgangatcaatcctggggaaggccaggctaccaacgtctttgtgaacatgggaggaggacttcatgaagcccagtcattaacattgtggacnagttgctggaggcagggatn

SEQ ID NO: 7550 - DNA, 566 bp, Homo sapiens
  misc_feature (1)...(566): n = g, a, c or t
cctttcaaacaagttttaacattgaaaacacccatccttcaaagagcttgaagccccaagtgtccatcttccaggatgcacaagactccccaagccttcatcctcccattactatttaatatccacactacattgttcggcacttggtttccctccagtatgcaccgtggcagccagtaagacacccccagggagcacaaccgcagctcactatttttctccccatgctcaataagttcagtaagtgcttgatgattgactagcatcaggaataaactaggagcattttacattcacactatctagttaaacattccaaatgacagatttccagaaaaatgttgcaacaaatgtaagtatttatagacatgcctggtaaggtatgtagcatttggagaaataataactagaacagagtactgtacaaaagaaaatggtacacttttgtatgagtctaagatatattggacaaatgggtattcctattggtaaacatggacatcttaataaaaatacaaaattactacataaagaagcattacatccttcaactcattgggnggacc

SEQ ID NO: 7551 - DNA, 490 bp, Homo sapiens
  misc_feature (1)...(490): n = g, a, c or t
atttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttancatcctactttc

SEQ ID NO: 7552 - DNA, 558 bp, Homo sapiens
  misc_feature (1)...(558): n = g, a, c or t
cctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctaaacagggantgtctccccgggtactcccattgancccctgagtnaaattcagctggccc

SEQ ID NO: 7553 - DNA, 565 bp, Homo sapiens
  misc_feature (1)...(565): n = g, a, c or t
cctagaatcaggcattcctccaaggaactggttcttttaagtaggttgctgncacctttttgtttttttagctctgaaacatttgtctaattttaaaaatattctcaaccatttttcattgggttttttctctctcctgaaattcttattatttgtatttaggcatgcttttctctcttctctacattatttaactttaatattttctactttttaatttccttcttgtctcctgggaagttctacaaccagctctcataattaatatgtaaattcttctgtaatttgattttaataaacctactactcttctcttttaaatattctctagcagtgtttgaaagagagttaatggcctatgctggttctccatcttgtcctgtttattatctttttcaaaagcatatatttgtaagtgtgcttcatgttttaaaatgtaaaaatacnagtcttattaaaaaaacttcagctttaattttcatttattttcattataaaaagntaaaggtnatatatgggangaaataaaatcaactananataactacntaatcacaggagtngg

SEQ ID NO: 7554 - DNA, 564 bp, Homo sapiens
  misc_feature (1)...(564): n = g, a, c or t
cctgcacgagcagacacattccgaatactaaaattccttaggaaaattagtcattgcccatgtgtgatagctgttttccattttgaattttaaccattttgggaaaaggaagagaatgggaaataccagtatagtccgaaaagcccttaaaaaatgagtgcgaaaagtggaagggtggagtggacataggaagatgatgaacttgtcattttttcctttccatagcttcattttattgtgtcaaagttgcagaaagcacttcactttcatcgaggctctttttaggcagggtacagccaagaaaacttttttatggctcagatgtaaatcctagaaaacgtagtagaaatgatggcaggatctctaactgtaaaataacagtagtgntagtagtaagtgtcattataataacgttatagaactctgcacatcaaaaataccacattttatcatgatctctgcaagagatttctgttggtagtcattctaacttctaataaataataccttgagtnnggaaaggttctgtgaggatccaataataatgaaaatgacagtggtgat

SEQ ID NO: 7555 - DNA, 564 bp, Homo sapiens
  misc_feature (1)...(564): n = g, a, c or t
ctgtagatcatttgcattcattggcatgtaatcataaagggccacaacctttttcagctcacttgtggagactggtgctgctgctggctcaggcggtagtggctttttcaagatctggtcctcctcaggcgttgggggaagaggcttttttgtcttccggtgagaactcccaggttttaagcttccattcctgttctccaaaatttggcagcccatagcatttttggctgtctgagagcagcagagatactgcccatcgatccagaagcaagggtgatatttctgaaccagatcactgttgtaccggattacgtttttgagctggtgaatccaccgcttccttagttcttcagttggggagaagacgtagagaggcccttcatcatatacaacctggaagggataagggaacctttcaatgattgaaatttgctccatttcactggactcttcacctcttctcggaatctgtctttctggaggaggatttttttcaggaaccactgtttcaacacaagtgatcttctcaacatctattgaacccttcttactgctcttcttccn

SEQ ID NO: 7556 - DNA, 457 bp, Homo sapiens
  misc_feature (1)...(457): n = g, a, c or t
ccaccttatatataattatatattctaccataaatgctggccttcttcaaattatgattttggaaaatctaacccatacagagggataaaaaattgacatcccttggacaacttctccttgtttttttttgttttgttttgtttttaacattccaagctctctctggtcccctatccaaggagaaatgctagggcctcgaggatgtccgctatatatttttataactaaatgataaatttatattcaaattgtttgaatacgtttccaaaactttcagagtacaagtcattgttaagtttgcctttactttaaaaactaaaagaatacatttctatataaactagcagtcaggaatttgcctgttttctagcttcttcatctatctaaaatatatatttagctaccagaattatgggnctcctaataaaatcttaataaaatagcatataaaatcaa

SEQ ID NO: 7557 - DNA, 509 bp, Homo sapiens
  misc_feature (1)...(509): n = g, a, c or t
gttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggccaaattgtnaacctttgtttttctaaaataaagtaattgaaaacctgcn

SEQ ID NO: 7558 - DNA, 536 bp, Homo sapiens
  misc_feature (1)...(536): n = g, a, c or t
ctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcagggactggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccaccattttaggtatganaaggacactgttgtggtccaggatttggcaacatcttcctcgcctgcca

SEQ ID NO: 7559 - DNA, 329 bp, Homo sapiens
ctggaaatgaacctaaggaattttgctgaaattatcgaagctgatgaagtacttctttttgagagagctacttttctgaccaagtttagatgtgactgaacattttcactgagcggggtgaagtcaagcaagggggatttgttcttccactggtatagaaattatgttttgaaattttcacattgtctcatggaatttccctgagttttcttctggtgagtgactcagttttgcttcctactagacactctgcatctgtatattcagcctataggtaatacttgtgtggttttattaaaatctgaaaaagttagaaaaagtattttcag

SEQ ID NO: 7560 - DNA, 519 bp, Homo sapiens
  misc_feature (1)...(519): n = g, a, c or t
tcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgaccagttgtctcttttgttttgggtcccacttaggattaatggatgtaaggtattttcctgtgcctttattttntgtcttctattggaaggaggtgtaacggcagaatagcacccgtgttgggggttttccnttcaacactgcaagtgaatattgccaccatgtgaaccctcaaaat

SEQ ID NO: 7561 - DNA, 455 bp, Homo sapiens
tcgactcgcttaggcccttgtttattccctatctagtgcaaagccacgaattggcagcatgttttctgacctttggtttggttggtttaaaatggtgttctagattttaaaatcgtttaagtgaccagttagatactcattcagagcagactcgggcggatagatagggaatactgtatgggtatatctttgtgtctagactttttgagatcgccctgaaggactgtttttgttttgttttgtttgcttggcatagccccttcaaggaatttaatctctcggccatattcttgtctgattttacggaggttgatgtcgctactgtgttaaataaccagtactttggttttcattccgttactaagtactttaaggtcttatatgtcataattttattgctaacatcaaatatttattttattttttaaaaaaataactaaacatggggcaaagga

SEQ ID NO: 7562 - DNA, 446 bp, Homo sapiens
  misc_feature (1)...(446): n = g, a, c or t
gttgaaatcatanaanatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaccagtatgtgcccatttgcaaaacaaaaatgctaataatcagnaatagtcctataaaagatgttaactctgtttagtcattgactgattttgctctaaccttaaaattttgtgattattgacctctgttgcatttattctaaagccccccaaaaattatctagccgtttcgaatatcaacattaccctggtgtattcactgctgtatgcattattgntctttnntgctgt

SEQ ID NO: 7563 - DNA, 336 bp, Homo sapiens
ccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccagg

SEQ ID NO: 7564 - DNA, 428 bp, Homo sapiens
  misc_feature (1)...(428): n = g, a, c or t
cgaggtccaatctaatttcttaagatggataataggtcactatttttgagtccttttttttcccctaaatatttatttaaggctataaaatcactacatctctcaagttttaatttggcatattcttattgnttcattcaaatatgctttaattnctcttgcgatttattttttaacccttgaattatttagaaggncactgtttaattttcaaacactgatttttttatggnttttaaaaattaggnttccattattgcattgggatcagnagaaaatatcctaaatggntttaatcctacaatgtcatctggcttcgngaccagtttgttgtcatttagtttaaatgttctgtgtgcacatgagcattttgtttaatgcattctgtacagggccttggatttgaatgattatgtaaatganggttt

SEQ ID NO: 7565 - DNA, 406 bp, Homo sapiens
cctttctggggcaaagtatcaacgcaagaagcaagaactcctaaggaaggcatctgtaagtctgtctggagcttaattcccagatggtctgacacagggcgtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggactttggccctatttaaggcagattttacagagcgcacctcaaacgtacaagtcagtaggactccttatttggcgtgacccgacctggccgcggagcctgcatttcctcgcagcctctcagt

SEQ ID NO: 7566 - DNA, 555 bp, Homo sapiens
ggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaaggtaaaagcaaaggtaaaaattcattattctttcctctatctgcagaaactgcctattcctaactgactcatcatttcatctctgaagcaatttaggtatgaaagccagctacagatggtacaggtgacccggctcctcaaataatgagtaccttctaccgttgatttcagagaatatgaatatgatct

SEQ ID NO: 7567 - DNA, 392 bp, Homo sapiens
ctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaagg

SEQ ID NO: 7568 - DNA, 564 bp, Homo sapiens
  misc_feature (1)...(564): n = g, a, c or t
ncgaggtttttgagggtaggtaaaatagctatattacttaaaagtcaaactttataaaaaggtaaagcggagatgtctgtctcccaatcccatctattcctccttcaccctgttccccatctatgagaaattatatttattagtgtcatggttattttttcagtgtttctatatgtaatactcattatatgttatacaaacacaaatatacatatacataatttccttccatttttatcaatttccttcctttctcactgtcctgctcctagctttaattttaccaattaataaaacatactaaagatttttttcatatcagtgcatgaagcttttcctcttttttctttcaactgcataatattccactatgtggaaatatcatggtttatttaaataaattcttatcagggaatatttgagttgttccagggttttctttctttctttcttttttgctgngaaaaacaatgttacagtgaataactaacatcatttctcatttcatatgtggacaaagtatctgtgggatagagttccagaactgaaattgctgcttgaagg

SEQ ID NO: 7569 - DNA, 534 bp, Homo sapiens
  misc_feature (1)...(534): n = g, a, c or t
ctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggntaatgatgtacagtcctgttctgggccaacctgtcgcactt

SEQ ID NO: 7570 - DNA, 463 bp, Homo sapiens
  misc_feature (1)...(463): n = g, a, c or t
nggncgaggtctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcaaaactgtttgttcaattgg

SEQ ID NO: 7571 - DNA, 187 bp, Homo sapiens
ctgtccaactgcagcggctacgtgtttccatggagacaaacttggtgtctcaagttcagggcttcgaaagtcccgaatatttgtttgtcccgagagaagagttttgactttgaagaggtccaggtgggactcgctgggggtggggtgctccgggattagttcagagggaggtgttctggaagactcc

SEQ ID NO: 7572 - DNA, 281 bp, Homo sapiens
  misc_feature (1)...(281): n = g, a, c or t
ccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaangntttcc

SEQ ID NO: 7573 - DNA, 336 bp, Homo sapiens
ccacttcaccagaacctctgtgtcagaaaaatttctcttccttttaaaatgatgagggggaactttcagacagtgtctgattagggtgggtggagagaggggcttcctagaaagtcaggcagggcagggctgaagccctctgggttaactgagtgcttttgatatgaaggcaggtaagactggacaggtgggggtgttagtgaggggatggtgtagggtgtgctgaagaactccacttgagctctgcacaccagggaaaatgaccataaaacatcccatcttcactgctcagagaaggctagatctgctgtgagctagaaagccatgtgggggcag

SEQ ID NO: 7574 - DNA, 495 bp, Homo sapiens
ctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtgagactctttccctaatttcagtttagagcaacttgaagaaga

SEQ ID NO: 7575 - DNA, 526 bp, Homo sapiens
ccaactaggtagacaaagccttatgtttttccattgttctgtatgaaccaggaggatcacggctcgtattggttcctgctatgcacagcttgattaatgggtaaggtgtactccatatctacaaaccttcaggtagtttacagacattcttggtgcacccctaactatgccagatcattggctgggcactaaagatacaggtggagtaaaaaattaattgtcaaaataactggctaatttaaaatttacaattgcctagaagaccatctttgatgttaagaaggaacaattaagtaaatactaggatggcaaacaggttccataatttcattttgttgagacaacagttttgctcatgtcaccaggctgaagtgcaatgttgtgatctctgctcactgcaacctccacctcccaggttcaagcaattcttgcctcagcctcctgagtagctgggattataggcatgcaccaccatgcccaggtaatcttggtatttttagtacagatggggtttcactgtgttggg

SEQ ID NO: 7576 - DNA, 337 bp, Homo sapiens
ctgcagaggccacctggattgcgcctaatgtgtttgagcatcacttaggagaagtcttctatttatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatgg

SEQ ID NO: 7577 - DNA, 509 bp, Homo sapiens
  misc_feature (1)...(509): n = g, a, c or t
ccaccctcagggttcaaagagactggcccaggggtacacaattgctggaatattctctgcgagtcatgcacacgtgcgggggtgaggtgcagttatatggtgacacacacagtgttactgtgagctctcagggtgcacagagggcaggtgacaagggcatcagctaatctgtcccacctggtccagcccatccagttcaggggcatcaagggggctgaggccccggtagccactgtagaccctgtgactatcactgacaccgtcactgggctccattgggcaaatgtagtccgtcgattcatcgaacttcttttttcttatgtttccgaagtgtgaaaatcctagtttccttggccggactttggctgtggtggtcagtgggtgtgtaagctggtgaggccattttctctcgcttttcctgttcagcctccggaccaatcaaggcattgaacttggtggtcaggtggcgcctgangagcgtcttttgtggggggatgttgagaacatan

SEQ ID NO: 7578 - DNA, 446 bp, Homo sapiens
ccacagctaacatcattgcagcacctttactccttcggctttttgccagcaccaacattggcctttgcagtccccctgactttcttcattctgttcttgcgttcctttcgttgctttcttgaggtctttttcttctcatacaggccatgtcttgcaagtctatgtttgggttcatttttctttgcataatccagggaatcataaatcatgccaaagccagttgtcttgccaccaccaaaatgagttctgaatccaaatacaaagatgacatccggtgtggtcttgtacattttggctagtttttcccgaatttctgtcttaggcactgtcgccttcccggggtgaaggacatcaatgaccatttgtttcctctgaagtagtcggttggtcatgaactttctagtgcggatagttacggtgtcgttcatgatggcgatctatcttca

SEQ ID NO: 7579 - DNA, 507 bp, Homo sapiens
  misc_feature (1)...(507): n = g, a, c or t
ncgaggtaaaaagagtgttgcctccaaaaccgaagttaaaaaaacccgacgaccaagatctgtgctgaatactcagccntaacagaccaatgcnggggaggtggnctcctcactctcaagtactgaaattcggagacntagccanaggcggcacacaagtgcggaagangaatagccacccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacagggggatgggaaatttatcgatcaatttgtttattcaacaaagggaattggtaacaaaacagaaataaantgtcaggggggcaagacaggcttataatttctacaccaaaccagagaaatgaaaagccaacgcagagtgtatcatctcctgaagccaccttctggttctacagggctc

SEQ ID NO: 7580 - DNA, 561 bp, Homo sapiens
  misc_feature (1)...(561): n = g, a, c or t
ccaccatgcacatttccaacacatgcacactcacagccctgaaaacagtgttaggtttcagttaatacatttattacagcaggtctttagtcattattgccattaaaaagttttcatgaaatttcacaaaatcttttaggctattagtattagctttctttttatggagtgacactttgttaatttatgaaatatttacagcatttacaaaaagtaagagaatgtctaataaaatttcttatacttacaaaattcatacattatactactgtatttgagatgtcttacttggtagaccaattaaactatgacataaaataatttacaaagatatatttaatctttcttaattcattgaaaacaaaaccatattagttataaatagtcctttacaaatcattgtaaaacacttcattgttttaactcgagccttagcttttacaaatatacttaataaatgaattagttcagatagcaaatagaactgtgnatttaaaatttcacttaatactataaaaacaaaacacctgaaaaancaaacggcctggtacttcaagtaaa

SEQ ID NO: 7581 - DNA, 473 bp, Homo sapiens
ctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactgg

SEQ ID NO: 7582 - DNA, 573 bp, Homo sapiens
  misc_feature (1)...(573): n = g, a, c or t
ctgaaaaatcctcagtgcaagaaggcaatagaggtgatagattcagagtatatttaggaggtagaccagcctagcagatattgttaggaccccacatatgtccctcactgttcccatgccctttacagcttgcccctgcaagtatctctgagtctttacctgaagacactaaggtttggtttgtacaaagggtaagccaagaattaccagggagttagcatccctggcagtggtcctcaaccagtgtcagatggaagtcagtggataaataccccaggtttgcttgcccttcaaatgggacagttctgaggaatgctttaggcagaggactcagatggcagagtgccaaccgcccacagtggaaacctgctcattaacataccccatactanctctcttcccttcctggtttcatttccccattctcatatcggtatttcctggaatcatctcccatataaactgcttgcattcagatctttgtctcaaagtccactttgtgggaacccaacttgagacaaacagaaaaaacttttanacaagtagatgatgaaaaatgaagactcaaatatg

SEQ ID NO: 7583 - DNA, 320 bp, Homo sapiens
ctggctgtgcaagaccctggcagggccctcgcctcctgagaaaccgagagtcagaaccaaagccaggctgtcctggttggagactgagccagaaagggtggctcacctcacggtgaggctgtcgagtgacctgagaacctcagaccctcacgtcagccggatgtcgcaccagcctgctgttgccaccaaaatgccagaagagatggacaagccactgatcagcctccacctggtggacagcgatagtagccttgccaaggtccccgatgaggcccccaaagtgggcatcctgggtagcggggactttgcccgctccctgg

SEQ ID NO: 7584 - DNA, 252 bp, Homo sapiens
cctgactgaagtgcttcccacactccccacatgtatagggtttttctcctgtgtgcaccctctgatgcatgtcgaggttcaagctccacttgaagccctttccacactccccacatttgtatggcttttctccagtgtggactttttgatgggcttgaaggtgtgcactccgactgaagctcttcccacactcttcacatttaaatggtttttccccactgtgaactctctgatgggttagaagatgcgagg

SEQ ID NO: 7585 - DNA, 526 bp, Homo sapiens
catttcaaaaccataagctctagccagaaaatcagtagatgaggttgttgtttcgttaatttctgctgttgaagaattcttgttagagtcttgttcagttatggtttgtggtctactagtctggatttcttctgcccacctgacagtctgattttgaggatgtcccgatgtccgtggagaaagggagaggtgccaccgtgggtccttctgctccagtgtcacttaaaatttctattaatgttgtgctggttactgacccactaccttcaaagatgtctgtttgagatacgagtggtccaacttcttttgccacattttccattctgttatagtcttcaattttgtcacttgaggtactttccacttgagaagtgtggggatataatgtgttattgatttgttccacttcagtaaaattcactgactctgttggtagagtaggtaaaacttcttctcctgatcccagtccagagaataagactcagtatctgactcttgaattgttggcctcatgcctttcggaaaa

SEQ ID NO: 7586 - DNA, 391 bp, Homo sapiens
  misc_feature (1)...(391): n = g, a, c or t
ctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaanctggagaat

SEQ ID NO: 7587 - DNA, 452 bp, Homo sapiens
cggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactccacctcagcaacccctaccccagtgaagaagccaaagaggagctgg

SEQ ID NO: 7588 - DNA, 542 bp, Homo sapiens
  misc_feature (1)...(542): n = g, a, c or t
gggncgaggtccacaccataagtcaggggcaaactggaactgtgggaaggagctgcagcctgtacttccccttcagttagagcctgaagctggaggagcttctttagcaagtacctgagatcaggaaggaaaggagcagagaaatgaacttccgtattgtctcaattcagtattttactcaagtactgggaaaagccagaattatatacaaagattactatactcataaaagaaaggttcttattaggccctatgaatcataaagccctggaggataatcaatacttcaagaggccaaggataagaactgtagcttatctcttgcatctggacggttcctctaccttgatgttggacggtgttaggcttctgaaaggcacattatttacacatgtatatatacccattgtgctttgcacagaatagtacgtacagaataaatatttgtagaacgagaggcagttgcttttatcacttggcttttataattgggccataagattaaataatcttagtaagattatttattagatgtggcaaga

SEQ ID NO: 7589 - DNA, 545 bp, Homo sapiens
  misc_feature (1)...(545): n = g, a, c or t
ncgaggtggccctttaaatttgtaaattaaactttaatttcttcctaagttataatattgatgtaatcacagaccggacacactagttttagcattctaatccatctgttaaaattatgttgtttgtgcatcacctgaaattgccatgggtactgctggtagtgtgcttacccctcactgagaaatacttacctctgctttttgctatgtggagttgaatagtgctgaaggctgcattaactcgttcagatggcagttcttcccatataatgtataacatctttgttactctacttagcaccttagtgaatacagagatggctgtacagcctccagaaatgctaagttggttggttgtatatggaaatctctgttaatatttgggacaaaccctgggaataattgtgtgagcaaacttatttactaaagaactgcattgctaattatggacttgttgacaccagtggagcccaggggaagaagttgtggttttgggcaaggggttctttcttatcaacttcaaacttacagggtgaagttagcca

SEQ ID NO: 7590 - DNA, 287 bp, Homo sapiens
ctgttcttggaggtcctgcccctgggacttgtccggctcatccggagtgaggagggcctggagatgctcattcaatgagcgggaggcatctctcccttcccgtaacttctcctttaactgcgtcagctctcgttcctgagagtgaaccaggactttatattgcctgagctcctcagcttgcttgagctgctctgcaagcttctcctccttgaactgtcgctcattcctcagcataaattttatgaggtctttacactcttcatacttgtatttcttctgtcggttgg

SEQ ID NO: 7591 - DNA, 579 bp, Homo sapiens
  misc_feature (1)...(579): n = g, a, c or t
nggncgaggtgtctccagggccagtgtctgctgcgatcgagtcccaccttccaagtcctggcatctcaatgcatctgggaagctacctgcattaagtcaggactgaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttcttcccactgaagaactaaggaagcggtggattccccagctcaaaaacgtaatccggtacaacagtggatctggttcanaaatatcacccttgcttctggatcgatgg

SEQ ID NO: 7592 - DNA, 393 bp, Homo sapiens
ctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaaagtgactgctgaaa

SEQ ID NO: 7593 - DNA, 439 bp, Homo sapiens
gcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcag

SEQ ID NO: 7594 - DNA, 473 bp, Homo sapiens
cgaggtcctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaagggggtaggtgttcctcttgaggaaggcaggaattcctcttctgcccctgttgg

SEQ ID NO: 7595 - DNA, 336 bp, Homo sapiens
gcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccag

SEQ ID NO: 7596 - DNA, 366 bp, Homo sapiens
ccattttaccagataattatttcagtgaatttgaatttagtgtatttgtcacttaaggaagcttataggcttgggccatatacttcttttttggatatgttaaagaaaaaaaatgttttaggcttgttgtacccctgaagttggagcattgagaactttgtttatatttgtatattaaaattgttcccacccccaaattattaaattggtgattaccttttttccctctccaggaagtatttatccatgtagataatacgttttgaagggctttggatatcaggggctgtgtatgaatccctatcttgtcaaagaaattatttttttaaaactttattttgaatttttataattctagttattcag

SEQ ID NO: 7597 - DNA, 519 bp, Homo sapiens
  misc_feature (1)...(519): n = g, a, c or t
nggncgaggtccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcacttgcctgcgacagaagacggaagaggagctcttggagacgacattgaaaatgaaattcttatctctggacttacagggagaccccagagagagtcaaccccttctgggcactgtgattgatgggatgcttgctgctgaaaacacctgaagagcttcaagctgaaaggaatttccacactgtcccctacatggtcggaattaacaagcaggagtttggctggttgattccaatgcagttgatgagctatccactctccgaagggcaactgggaccagaagacanccatgtcactccttgtggaagtcctatccccttgtttgcatttgctaaggaacttgattncagaagcccctgagaaaata

SEQ ID NO: 7598 - DNA, 449 bp, Homo sapiens
  misc_feature (1)...(449): n = g, a, c or t
ctggagagtgtngatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 7599 - DNA, 359 bp, Homo sapiens
ccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattcc

SEQ ID NO: 7600 - DNA, 250 bp, Homo sapiens
  misc_feature (1)...(250): n = g, a, c or t
ccaagacggnctcaatctcctgacctcgtgatctgcctgcctcggcctcccaaagtgctgggattacaggtgtgagccactgcacacanccaaacattanactttcaaaccaaatttagatatagtgtttataagaactcgtggngtatctcttcaaaacctggcatcttgaaaccaanatctggtaaacagaaacatcagtatgggggcctttgatangggaatactgaattgcangcctacncagcga

SEQ ID NO: 7601 - DNA, 380 bp, Homo sapiens
ccaaagcacacatatcggcttttctcactatatatctaaaattgctattgaggaaagtaggccaaatttcaatgagagctatttgaagaagggagagagaaattactttcacctgactgaaagaagtggtagaggtgtacatagctttttattcttaattatctagtctggcaaaagacagtaatctcaaatacaacaatacactctaagaaaaggttcccctcccggctctcacaacgtctcccttcctaataaattttaaaagcataagggtcacagggccagttacatagtatgtattcaataagatttgttaaatgaatggcacttcaagttcttattaagaagctaggtctcttttttccccctatccttcccaa

SEQ ID NO: 7602 - DNA, 297 bp, Homo sapiens
cctttgtatcagggcaggtctcctgcagagtcttctctttgtcatgggagaagcttcattgtgcgttgaggctacttctgtgttattgaggagtctgggcttttttctgataccacgtttcttttctttcctgggccattgtagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtgg

SEQ ID NO: 7603 - DNA, 248 bp, Homo sapiens
ccatcatctccaactctttaccccaacctggcaccttgtagggggctagaagggtgaggggaggtgtctttcacttatgcttaggtcactcttagaggactatcctcaaacttgaggtgacagggaactcttcacgggggcaggatttgatgttttgtttttagccatgtttgtcaatgacaatgtcaatttctagttccaatttgtacccttgtctcatttctacattaaaaacaaaaaacaatcat

SEQ ID NO: 7604 - DNA, 167 bp, Homo sapiens
  misc_feature (1)...(167): n = g, a, c or t
ccaagaacctcttccaccgggccatttctganantggcgtggccctcacttctgttctggtgaagaaaggtgatgtcaagcccttggctgagcaaatttctatcactgctgggtgcaaaaccaccacctctgctgtcatggttcactgcctgcnacagaagacggaa

SEQ ID NO: 7605 - DNA, 384 bp, Homo sapiens; identical to SEQ ID NO: 527

SEQ ID NO: 7606 - DNA, 333 bp, Homo sapiens
  misc_feature (1)...(333): n = g, a, c or t
cgcgtggatggatacagagcggcttctacacggcgccatcaacattctctttatgaacgtgagtggattctccaggcaaactatgcactatttcatggtcggaaagaatcaaaggaagtttaaatgagggtggagttaaactgtgctaaattacagtagtgcttattagtaactagatttcaaaaggttacagaaaatttacattctctacacaaaaactgcatctcctgcacagacaacatcgacatcgacacaggaaggaaactgattgtccattctttgcccangaagnctcngtactttatagattcgnctttacctnttttttgttnc

SEQ ID NO: 7607 - DNA, 127 bp, Homo sapiens
  misc_feature (1)...(127): n = g, a, c or t
ccatgcaggagttcatgatcctcccagtcggtgcagcaaacttcagggaagccatgcgcattggagcagaggtttaccacaacctgaagaatgtcatcaaggagaaatatgggaaanatgccancct

SEQ ID NO: 7608 - DNA, 207 bp, Homo sapiens
ccactgtgtagcaccttctaattcaatttcatcggcagttgtaataacagttccagcctcaggtgttttaatggtgggaaacatcttgattgcttctccagaaacttgaccataggttttgttttggaaatcttggagaatctcagttccttccacagcaataagttctgtgggagaagcttccatttcttctaataactcaggttt

SEQ ID NO: 7609 - DNA, 169 bp, Homo sapiens
  misc_feature (1)...(169): n = g, a, c or t
ctgtgctgccctgggtcctggataaaccaaaatgctttggattctggaaaacgtattgaagaggcatttataccactattaactaggaggtattttaggtgtggctaaggctctgaagtaatctcaattttcaaaatactgagattttcttccctctccggggtctatn

SEQ ID NO: 7610 - DNA, 212 bp, Homo sapiens
  misc_feature (1)...(212): n = g, a, c or t
ccagtgtatggaatggtatacgatgagcacctgcccccctgaaaattgttcaggctactgtacctgtagtcattgcttggagcaaccaggctgtggctggtgtactgatcccagcaatactggcaaagggaaatgcatanangattcctataaaggaccagngaatatgccttcgcaagcccctacaggaaattantatccacnncccctgc

SEQ ID NO: 7611 - DNA, 312 bp, Homo sapiens
ccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctactctgctggcctt

SEQ ID NO: 7612 - DNA, 313 bp, Homo sapiens
ctggggaaagggttgcagcagcaaggcatccgtggccgcattcagaggctggcccccctccttgcctttactctcgagtcttacttaacctaaaagacaaactgggtcaacttggtaaatgaacacagtcaaagacttagccataagaggtaagggaccagtcaatactcccaaggctggttaggcccttcaacatgtaggtggatgtgtatatgtatacatcgctacactaacatacagatctagccctatgggtatatatacgcatttatggctatatagaaaaactatgccaatactaaccacacagaac

SEQ ID NO: 7613 - DNA, 374 bp, Homo sapiens
  misc_feature (1)...(374): n = g, a, c or t
ctgttggtgttancagtgctcttgccgcttggggcattgccattgtaaanacttgggaaatccctagaaatganccantatatgcgcttttacattttanntggagaaataaacatatgancatatatttcattacacananaaaaaganagctaggcttggccatgaacattcctttatcttcctacttaatgatanggaaatttnatggtcttctgatgggaaataccctcctgatttgcttcctgtcatcatagagatggaggngcttcatcctatggngagcggnatcagctcactcaaaggcggtaatacggttatccacagaatcaggggataacgcatgaaagaacatgtgagcaaaangccagcaa

SEQ ID NO: 7614 - DNA, 290 bp, Homo sapiens
ttttcacacttctagtaagcctctacctgcacgacaatacatgaagtgtgaaaacgtaggcttggattaaggcggcagcgatttctaggatagtcagtagaattagaattgtgaagatgataagtgtagagggaagggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccag

SEQ ID NO: 7615 - DNA, 159 bp, Homo sapiens
ctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcag

SEQ ID NO: 7616 - DNA, 263 bp, Homo sapiens
  misc_feature (1)...(263): n = g, a, c or t
ccacactctacttctgcttctgccacctatggggtcgaggcaggtgtggtgccttggctaagtccacagacttctgagaggcccacgctttcttcttctccagaaataaaccctgaaactcaagcagctttaatcanagggcaggattccacgatagcagcatcanaacagcaagtggcagcgagaattcttgattccaatgatcaggcaacagtaaaccctgtggaatttaatactgaggttgcaanaccaccattttncct

SEQ ID NO: 7617 - DNA, 252 bp, Homo sapiens
  misc_feature (1)...(252): n = g, a, c or t
ctgatcaggtcgaggtaacccaagaggacatgcagccctggacgccacgagaaatcctgttgtctgtcagttgagtggatcaaaggtgcaccggcccagaaatggcctccagcaacaggtgcttagatgttctgttctaggggtgccagcgagatggtacagtcattgtttaccactgccttttcccatgaaaacaacgaacaactccatggggacaggaatttgncttttattctttgccatatncccagt

SEQ ID NO: 7618 - DNA, 317 bp, Homo sapiens; identical to SEQ ID NO: 664
  misc_feature (1)...(317): n = g, a, c or t

SEQ ID NO: 7619 - DNA, 317 bp, Homo sapiens
  misc_feature (1)...(317): n = g, a, c or t
ccattctgtctagctgtaaagttaggctgtgctatccaaaagagctttactttagagtcatgagaagcagcactgatctttgcaaaacttaccccaaaaaatggggagagagaaaaacaggaagaaaagtctctttcttaggctaccagtcagttaacaaagtatcttagattaagatttggaaaccaaagaatgcataattaggagtgtaccatatcatgcaaagtctatgaaatactaaataaggtaaaacagttaatcatttaaagcacgatgagcaaattctcttatcatacggctattctnatcccgnacga

SEQ ID NO: 7620 - DNA, 287 bp, Homo sapiens
  misc_feature (1)...(287): n = g, a, c or t
ccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttnacacactgaagactttggaagc

SEQ ID NO: 7621 - DNA, 196 bp, Homo sapiens
  misc_feature (1)...(196): n = g, a, c or t
ctgcatggctcccgctctccctccttcaagtctctgctcaatgncacttcattaaaggcaccttctataaactaccttgtataaaatattatttattttctctatcccggcattctaatttctcttatcctaatnaattgttctttagccnttattttgatgactattatgnntgaatacaggcagccctcacttt

SEQ ID NO: 7622 - DNA, 288 bp, Homo sapiens
ctgctcccaaatggcgaattttttttcaattacctttactggatctgccaagtttgttttgaacaatcctggttcaatgcatgagacgtgcacaccaaaagctttcatgtcccgtcttaagctgtcattgaaaccttccactgcatatttggatggagtatagccccctccaacgattgcaaggcgacctccaacactggagacattaataactctcccttgagctttcttgaccaaaggaagcatatttagtgtcacactgatgagtccaaacaggttcacttcaat

SEQ ID NO: 7623 - DNA, 272 bp, Homo sapiens
ccttgcttactgcctgcaaattttgagaaatttaaaaataagcattctaacacttttattcccacagaaaaattccaagtcaaattatcaaatcaaacacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccactt

SEQ ID NO: 7624 - DNA, 224 bp, Homo sapiens
  misc_feature (1)...(224): n = g, a, c or t
cctgagccaccgtgccttgccacaaactatttttaatcattaaaaaagaaaaaggaaaataaggcaggccggcttctcacattacatgcttttagaaaaaggtctcatccttgaagcagctttgttatatgcagagcacagtactggcttcaaaaaatatataaaggttctgtgcactggcactgnttacatgtgaacaatngccatcaacttctgngaaaatt

SEQ ID NO: 7625 - DNA, 275 bp, Homo sapiens
  misc_feature (1)...(275): n = g, a, c or t
ctgctatgcaaagttctaaggcccgagtcaaatcctgggcatctccacagatgtgtggtagggcacgggctccagctcttgtgtaagaaagaacaggaatgagaacagctttattttgtagcgccaaggtctcactatgctcacacctgtaatcccagctttgagaagaggatctggcaccagaagggtctggtagaagaaagtgggaaaggtgaaggacaggaatcttttcctttctgctacaacctaaggacagaggcacatgactccagcna

SEQ ID NO: 7626 - DNA, 121 bp, Homo sapiens
ctgtagagtgggcttatcatctttcaacacgcaggacaggtacagattcttttccttgaggcccaaggccacaggtattttgtcattactttcttctccttgtacaaaggacatggagaac

SEQ ID NO: 7627 - DNA, 357 bp, Homo sapiens
ccacattggagatgtcaccttctgctctcacgcaaccacaattactgaagatgtttgtggtttcttttccagctacatgaatcacccgcaaaagatcaatcactctttccagcaagccagggaaaacctgcagatagccgagcagctcagtattcacagtcatttcgcacaggacgtcgagaagcctaattgtagccagtgcctcctcatcatcaggaggctcctcagaggccagcttgagcacagtcttgcactgatccacaaaggtgcttgcaatcaactcagcatgccgcaaaaacacagggatgtcatccttggtgagtggctcatcactcgttatcttggctatcataaggt

SEQ ID NO: 7628 - DNA, 185 bp, Homo sapiens
ccgggatgatgagaacaataacccagatatccaggatgtgcttgggaagcacgacttccatggggacttggctgactgcatccatgttgcttcactcccagatggcggcgagtctgcggaaagttcctgggtcagggatggctcggtgcttctcagggtccccaggactgcacgggatctggcag

SEQ ID NO: 7629 - DNA, 197 bp, Homo sapiens
  misc_feature (1)...(197): n = g, a, c or t
cctatgatttatttgaaggtagcttttgtgtctggtgtgaggtaagggttgaggttctttgtgtgcgtatgaatctccaattgttctaggaccatctcctcaaaatcccagcaatagcttccctttcttttttggcgagctcactacgcttgaaatattttttattttccaccagcaggttcctgtnctccaccana

SEQ ID NO: 7630 - DNA, 246 bp, Homo sapiens
  misc_feature (1)...(246): n = g, a, c or t
ctgcaccatccccctggctgtcttcaatttattccagtttgatcccagtagggtttgagagcagaaatggaagatttcttcttcaaggatcagctcagaaagccgggatgggggcggtcactaaaggggtaggatagacggccagggccactatccctaccctctgtgtgttcctaaagtgcttatgagaggtggtggggaggggtgtcatcttcactatccccactttacggatgancagactga

SEQ ID NO: 7631 - DNA, 384 bp, Homo sapiens; identical to SEQ ID NO: 434
  misc_feature (1)...(384): n = g, a, c or t

SEQ ID NO: 7632 - DNA, 219 bp, Homo sapiens
  misc_feature (1)...(219): n = g, a, c or t
ctggctgtgatttttgctacaggccacagtcaggagcacatgatagtagcattggcacaggccacggtggaccgtttttcagtgtacagttccagcaaaacctggtattctccctgaggaatagtaaattcaggattattgacaggcccancatagtaaatctcctttccttcttccacagaaaganaacttgggcagagccgcctcacanatggnata

SEQ ID NO: 7633 - DNA, 236 bp, Homo sapiens
  misc_feature (1)...(236): n = g, a, c or t
ctgttgattactatactattctgtctcttcagtttaattttatgagatgatgccaaatctattttcagcatttttactttttttgccaatctgatatatgttaacagtagttcattattttaaaaattatatattttgtggtcatctttcttccacagtacttttaggcactaangaaaaatgcttctaagtatttctggtgattaccacgttttaagttttcaggaaatcatnta

SEQ ID NO: 7634 - DNA, 325 bp, Homo sapiens
  misc_feature (1)...(325): n = g, a, c or t
ctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaananaattgaagaanaagtgga

SEQ ID NO: 7635 - DNA, 153 bp, Homo sapiens
  misc_feature (1)...(153): n = g, a, c or t
ctggcctgtcatataaaacatactgtcattgagcttaagctccgcttgttctgaggtttcacctccatgtgtttcattggtgcaaaagtggatctcttaactggtcacttanttctttctttttcanaaagatagtatgttcactggtatatt

SEQ ID NO: 7636 - DNA, 197 bp, Homo sapiens
  misc_feature (1)...(197): n = g, a, c or t
ccatcgtgcctctttgggcttccatgggcnnctacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcncccag

SEQ ID NO: 7637 - DNA, 326 bp, Homo sapiens
  misc_feature (1)...(326): n = g, a, c or t
cctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggngttc

SEQ ID NO: 7638 - DNA, 111 bp, Homo sapiens
gctgccgtgaaggacacacagcctgaggacggggtggaaatggacactcggcagagcccacacgatgaagacccccaggcagtgacgtatgccaaggtgaaacactccaga

SEQ ID NO: 7639 - DNA, 278 bp, Homo sapiens
  misc_feature (1)...(278): n = g, a, c or t
ctgaaggtttttttattctttctttttttaaagtgagcccatgatttggtgtctttcccagattatcccctttgcgacaacacaagcaaaaatatttacaaaggtaaggcatagtcaaactacataaagagaaaaaatcatgaggaaaatacatgaaaaagactaaagacttcgccataacaaggtcttagtgataatagtgtccgtaaagatgtcatcanaattggtaaagtcaaccatgctgcaaatataccctttggattacaaaagagcacaat

SEQ ID NO: 7640 - DNA, 211 bp, Homo sapiens
ctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcaccttgggaggccgaggtgggtggatcacaaggtcaggagatcgagaccatcctgg

SEQ ID NO: 7641 - DNA, 273 bp, Homo sapiens
  misc_feature (1)...(273): n = g, a, c or t
ccagccccactgaggagacacagcagttctaatgggtgactatgctggaggtctggtggtgccggctgtcagaggctaacagtgctgggggtcccctggctttggcttgcagaaggcagcacaagcattccactgatgtttgctgggctttcagcaagcanaaccaagctgtggagacttctatgaaactgactgaattgtttccnatagtttgcattattagtctgggcaatacctcacatctntttcttctccaaatcatattcctatctt

SEQ ID NO: 7642 - DNA, 276 bp, Homo sapiens
  misc_feature (1)...(276): n = g, a, c or t
ccactgacaagtttcaggcatagaatgaaaactattcttactgatatcaatgttagtcaagtttttcagagtgagcaaagtctctccggttttttccaatgatgccaaatgattttgccttaaaattaaagtttgtagagagggccaggcatcctcacaggctgaatttttcaagtattcttcaaccatcaaattttcactgagatccaagtattctaatgattttaaatgttgtnaaagnaaacaaggaaccanaaaaactttactgtnntctac

SEQ ID NO: 7643 - DNA, 127 bp, Homo sapiens
  misc_feature (1)...(127): n = g, a, c or t
ctgtcaaccgggaatactatcgncaacagatggaggaaaaggctccgcttcccaaatatgaagagagtaaccttgggctgttggagagcagngtgggggactcnaggctccccctggtcttgagaaa

SEQ ID NO: 7644 - DNA, 290 bp, Homo sapiens
  misc_feature (1)...(290): n = g, a, c or t
aggtctgactgagggatggctctaaatagcgggctgcccggtcttccaactcccancacagccgcccattctgttcaccccttcaactgtacaaatagccctggttgctttttttgtttttgtttaaaaaaaaagaagactcggtctttgtcattgagtccaggtattttaaaaacaccagcaaaggctataaccaggtcatgaaaatgttgaatattatcaaagacgatactaaaatattcacaaagatatttacaaaagcgattcttaaaataattgatttgcatact

SEQ ID NO: 7645 - DNA, 261 bp, Homo sapiens
  misc_feature (1)...(261): n = g, a, c or t
ctgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttacaattcaatatgaaaatcacctcggagctggtaaaaagaggacctcggcgacctcngtcgtaccacgctaagtcgaattn

SEQ ID NO: 7646 - DNA, 349 bp, Homo sapiens
ccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaa

SEQ ID NO: 7647 - DNA, 136 bp, Homo sapiens
  misc_feature (1)...(136): n = g, a, c or t
cgcagcgggattctcacacctanaccgtcgcgagcgggttctcaagttaggggagagtntcgagaatcagccgcgctgcgccttccacactgggcgctatgacttcaancctgcttctattgacacttcttctgaa

SEQ ID NO: 7648 - DNA, 217 bp, Homo sapiens
  misc_feature (1)...(217): n = g, a, c or t
gtttatttcttgaactttcagaaattcaagcttaaagcatcacacgtttttctaatattgtgtggcattttctgtcattttacttttttaacctttatatggaataacaaccatcagccttgtctttcagatgtgccatttgggggtgctaaagctggtgttaagatcaatcccaagaactatactgtaaatatganagtgatacttgttttttttt

SEQ ID NO: 7649 - DNA, 162 bp, Homo sapiens
ctgggggaggggcaggcacatgcattaagccccttccgtaggcagagccatggatggacagccccatgggggccttgaaggcagaggccctggaagcagcaaaaacggggctggataaagctactaatgggagggatggtagagcccagctccccagtcccc

SEQ ID NO: 7650 - DNA, 260 bp, Homo sapiens
  misc_feature (1)...(260): n = g, a, c or t
ctggcagcctgcttcctgcatgtattctctttatcaaccacctatttatgcagtcagcatgcctcacacctgagatgactgtgaaacaaaaaaggagactgttgctcttgccaatttttttccttaaccctgcatctcaaactcgaggcgtatacctaagtaganaaagtcccaccgcaccaaattaaccaaacgattttgttactgtgaaaagtcatctttatgtaacaaatgagaagaatagttatttataaataatg

SEQ ID NO: 7651 - DNA, 138 bp, Homo sapiens
  misc_feature (1)...(138): n = g, a, c or t
ctgggggccctcaggtggagagagctgcgatccatccaggccaagaccacagctctgtgatccttccggtggagtgtcggacaagagagcttgccgacgatgccttcctgtgcanagcttgggcntatcctttacgcc

SEQ ID NO: 7652 - DNA, 264 bp, Homo sapiens
  misc_feature (1)...(264): n = g, a, c or t
ctgtgccataagagcattaggtggttttagctcttatctggggtatgaaagcaatttagctcatctcacagaaacaaaagcaggtgctgaatcatgaaaacctcaattatttttagcatgcctcttaatttttctttcccctggtttcttgtcgtctgtgcttgattcttgaacaggtaaccacttgagaggatgccggcgatagatgggccatggaggaagtgtcagcaaacatgaaaaagcaaatccggccataactatatn

SEQ ID NO: 7653 - DNA, 272 bp, Homo sapiens
cgggaaatgactgtctggttttattatggtttataaattaataaatgggctatttaattctgtatataaatttacagcaagtaccgtacactggaataaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcag

SEQ ID NO: 7654 - DNA, 130 bp, Homo sapiens; identical to SEQ ID NO: 7318

SEQ ID NO: 7655 - DNA, 251 bp, Homo sapiens
  misc_feature (1)...(251): n = g, a, c or t
gagccatttctaatctttctctggggggaacaggccacagaactgtgttagaggtgaaccatcttaattactagttctattacctaattcagcttccttgtttggtctgctgtggatctgccttattgcatatgccatgcatcacataatggatgcatcanataatggtgttagacaaagcttcattgtgaacaacctaatgcattttacagaaacantctcatcacattttttntagcctttcctacatt

SEQ ID NO: 7656 - DNA, 256 bp, Homo sapiens
  misc_feature (1)...(256): n = g, a, c or t
aacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgntt

SEQ ID NO: 7657 - DNA, 345 bp, Homo sapiens
ctgatggaaaacatcagcgtgcatttgggttcctaaatcatttcaaaacattaatcaggaagactcacagcacccagtcctatctaagccatagattcctcatttagggaatgggatgatctcacattcacatgatctgtaagggctctatttatcccagcacagttcaattaggctgaattgcaggaggcataagaaatgataatcaggagagaaattatggcaaaggcagttcaactccctacaaaggggaaaaactacaagctccagaaaggccaagtgccagtccacattacacaatggtatttgccggaacaacaagcagattacagccctgcacggtac

SEQ ID NO: 7658 - DNA, 124 bp, Homo sapiens
cctagaagatgctggaaggtaccaccatctttgttgggaagggaatgcgatgacgagctggaaggttcctgttctcgtctgtaaaatgactgtttgaaggtgaaaaacatccatgttttcttca

SEQ ID NO: 7659 - DNA, 298 bp, Homo sapiens
  misc_feature (1)...(298): n = g, a, c or t
ggacacactgtgcagtgggtgattcacagcgtgggcccaccttagctgctgctctagagtactgctgttcccactcactaagtgattctttttttaatattctcaaattgatgatgctaagaacatcttcacggattgaaggaagtgcaaaataaggtcaaatcctgagttggcaagtacttctgttcttaagattgtttatactanctggtcttattgttgtaataagtaggaaaaggtccttttcaaatttcattcngcctancttttcctttatgtgataattctttgttcaaag

SEQ ID NO: 7660 - DNA, 188 bp, Homo sapiens
cctgagttcataccctggttctgcatttagcttctgttacctgtaaagacttgaaaaatttactcaacctttctaacctgttctctcataattgtgatgttaattgctagttgaaagaacagcatggtgtatgtgagacatatggaatagtccgtggcagataggagtactcacctatgtatattcca

SEQ ID NO: 7661 - DNA, 284 bp, Homo sapiens
  misc_feature (1)...(284): n = g, a, c or t
ccaccccggagatgacacgaggctcacatgactctagacacttggtggaaagtgaggcgagaaaaacaatgacttgggccaattacacgactgcaaagctagagctgccaacagggctccagggagcttggcttctgtagaagttctaaggaagcggtacnaactccacggcggtggggcgctaactagcagggacccctgcaagtgttggtcgggggcctcganctgcctgagctgacacgangggangggtctgcgtagccaacaggngaccgaagggcttg

SEQ ID NO: 7662 - DNA, 246 bp, Homo sapiens
ctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgagg

SEQ ID NO: 7663 - DNA, 416 bp, Homo sapiens
ctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccgatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgtcatcagaaagagacaacttgaagaaaccaacaatgactatgaaacag

SEQ ID NO: 7664 - DNA, 208 bp, Homo sapiens; identical to SEQ ID NO: 278

SEQ ID NO: 7665 - DNA, 258 bp, Homo sapiens
  misc_feature (1)...(258): n = g, a, c or t
ctgaaaaatatttagatctacttgctctaagaataaggtcaacattaaacattctcagatgaaaagcttgctggatgaaatagtgcaccatcagaataaagcatgcaatatatttacagtcagatgaaacaagtgtgtccataaatcaaccaaaagaccatctcctcctttangaaatacatgtattgcttagccannaccaataagttaacgtcntgtgaataattttgggtattctggccttcctgaatctcatac

SEQ ID NO: 7666 - DNA, 463 bp, Homo sapiens
ccactggctcaccagcttcccaccctagcattcattgctagcttaccaatcttaaggctaataattttatcgcacattcaacttcaaaacacaccagtgtttaccattaccactaatcactgaatgccatgaagccatggcactgaaccaggagctttcaccttttatgtgaatttaaaatggtactgtggaggctgaggcaattttcttcaggctaacccagattttctaaagcccaacttaaaaggtctacacctgccaaactaaaaaaaacgcagccacttgaaaataaaccagcagagcattgccatcactccgataaagctgcaggtttcatcacatgcaccagacaaatctacagggctagtttcagttctctccttttaaagaatttattaagcctgttataccacacagtatgttttatacactgacatacaactccctaataagataaagcaaa

SEQ ID NO: 7667 - DNA, 279 bp, Homo sapiens
ccacaacaactgacgcggcctgcctgaagcccttgctgtagtggtggtcggagattcgtagctggatgccgccatccagagggcagaggtccaggtcctggaaggagcacttcatctgtttagggccatcagcttcaaagaacaagtcatcctcattgccactgtaataagccatcatttcactggcgagctcaggtacttctgccatggctgcttcagacacttgagcaatgaagattggctgaagagaatcccagagcagcctgttgtgccttgtgc

SEQ ID NO: 7668 - DNA, 448 bp, Homo sapiens
  misc_feature (1)...(448): n = g, a, c or t
gtttnaataaatgttgtggacttccatttgtcaaanaccaaaacaaaggaaccccaaccttacatgtaatacaaacttaactcaaaatggatcatatatctaaatgnaaaatggaaagctataaaactgaaaacanactatntttacaacctatgcgtaggtatagtttttagacattacaccaaaagcacatgccgtaaaagaaaaaatagataaattgnnggatttcattaaaatnaaaaaactttttctctctgaaaaatcctgttaagctgggcgctgtggttcatgcctgtaatcccagcactttgggaggctganttgggaagaaattaatagcttgaggccaggagttcaagatcatcctgggcagcaaagtcatacactcttgagggaagagagagaccttctcatattgttttatattgttttatactcagtacctgtt

SEQ ID NO: 7669 - DNA, 297 bp, Homo sapiens
ctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaa

SEQ ID NO: 7670 - DNA, 161 bp, Homo sapiens
  misc_feature (1)...(161): n = g, a, c or t
ccactgcttgngaagctaaaggtggtgaaggcanacacaggcaatggggccaggagcatatgcctttcaattccttcctggcaaccttcctgtcttctcctccactgactcttccctctcatcaccctctctatggtgccaaaataggcttattgnantgc

SEQ ID NO: 7671 - DNA, 388 bp, Homo sapiens
  misc_feature (1)...(388): n = g, a, c or t
attggctggaacattttaaaccttttcagcatcgatcctatttaaatactttgtagtacccttcatgagcaatgattaagactacaaaacaaaggaagaggtataataaggatggttcccatctgcctattttcttaatctatttgtctactctggcttccctagattgtgcctgctttctcagaatgaaaagaaaattaataagtgtttcaaaagtatgtactcaagagccagtttgccagagtacacgtcattcttgccattgcttagactggttccacattgtaaaaaaatgtagtgctaatcctgatcaaatgaatatgcctcccacatccatctcccttttacctgttacaattgnctaagactaattctcattnctttattt

SEQ ID NO: 7672 - DNA, 468 bp, Homo sapiens; identical to SEQ ID NO: 435
  misc_feature (1)...(468): n = g, a, c or t

SEQ ID NO: 7673 - DNA, 315 bp, Homo sapiens
  misc_feature (1)...(315): n = g, a, c or t
ccagaaaggaaactgacgagcaggtcacataatcaggagccagactcctgagttgtaactgggcccccaactttccgtgtgattattaaaagagcccttcttcttttctaaaacttagtgccaaatgctgaggagcataatgtaggtgagaatttttttttttgggggggngaaaattaagctaaagcttnttgaagtacctantttccaggggctttttattgtatttttccttatggccctaaaatgacatcaacttggaaatgaagcttttgntgaaaaanctggaggtgatantggtggtgattttggnag

SEQ ID NO: 7674 - DNA, 414 bp, Homo sapiens
cctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatct

SEQ ID NO: 7675 - DNA, 266 bp, Homo sapiens
gaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaat

SEQ ID NO: 7676 - DNA, 376 bp, Homo sapiens
  misc_feature (1)...(376): n = g, a, c or t
ccagtggaatgatgntccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccanaggacttattctatgaaatactttaaaaattcctcatcagcaaaggacaattcaataaatacatccaaacatgatcatcgttggagccggaggtggcacgagtcaaggcgctgatcccta

SEQ ID NO: 7677 - DNA, 227 bp, Homo sapiens
ctggctttctgtatgttgcaaaataatctattcacagtagcaataaaaactcaaaagtacttaataaatttaataaggaatatgcaatactttaataaaacattataaaaggacagataaagcctgaataaaaagagccacatcatattcttggatgggaagacccaatatggtagaaatgtccattttctcccaaattactccctacatttattctgatttattca

SEQ ID NO: 7678 - DNA, 101 bp, Homo sapiens
ctgggaagccacgagaatattgtgaacctgctgggggcgtgcacactgtcaggaccaatttacttgatttttgaatactgttgctatggtgatcttctcaa

SEQ ID NO: 7679 - DNA, 317 bp, Homo sapiens
  misc_feature (1)...(317): n = g, a, c or t
ctgggtgtggacatcatggataagggggtagagacgctcccctgtgtggaacaccttctaatggcttgtgcacggcctagctcacaccccagcatcccagggctcgtatggagtggagcactgaggacatctgggttcttctcccanaactgctccttctaggctatgacatttaacacttgatcttctaacatcaggtacttttaatgactgggcctggtattggtggtcagcccatctcagcaatgtgtccagggcccagccaggactgggtgccttaagtgggggcggaaaggatcgtcccatgaagaaagtga

SEQ ID NO: 7680 - DNA, 258 bp, Homo sapiens
  misc_feature (1)...(258): n = g, a, c or t
ccaactctagtcatacttggacctcgtggaaacatgttgttttctttgattggagagggacacaaagataaattatttttatatacttcaattgctttaaagtattacaaagacagggggcagatcacagataataaaattggaataaaactctataaagattctttgccaccttcaccattgctatttcctggcnaagtaacagtagnaccaanttactgatacgattggcaatagcanacncctggacatcataga

SEQ ID NO: 7681 - DNA, 396 bp, Homo sapiens
ctgcacctccacctccgtcttctcctctgccaagcaaatccacatcggctccacagatgtcgcccggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcga

SEQ ID NO: 7682 - DNA, 185 bp, Homo sapiens
  misc_feature (1)...(185): n = g, a, c or t
tggttaaagttcacgttctctttggggaattttacaatttaagtttaanagcttttaattaaacgtaaatgtacaccaatctactcancagagatatattaggatcacatttcttttttaaaatggatnttattttaatgtgtaacaaaaagattttgnttncctatttaaaaaatacaatacac

SEQ ID NO: 7683 - DNA, 271 bp, Homo sapiens
  misc_feature (1)...(271): n = g, a, c or t
cgaggtccttggatgcagatcaatgctccnataangttcattatcagctcctcctgccttgtgacnggatgatttgattttacaaaagtcnctttgaaaacaagagtaaacgcagacagcttctagagaaaagtctggtgaagcagcagttgataatagattttcttttagtgatgaaattaatcttgttttggtaatctacagcctgttagggataggtggagggatgaagtccttaaaactaaantgttcctctacgaatcttcgacct

SEQ ID NO: 7684 - DNA, 280 bp, Homo sapiens
  misc_feature (1)...(280): n = g, a, c or t
ncnggaccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaancacagtatgatggtttaaatatttctctaatttttgaaaaatcgtgccaagcaataagattnatgnatat

SEQ ID NO: 7685 - DNA, 326 bp, Homo sapiens
gaattctggttgtttgtgcaataatcatagtgatttacattgcttttcttctttcagagcaataagaaagttatttggggtagtacttgaaataattcatatacacagtcatttaacatagatcgtttctagtcgagtatgagcatacattcatgggaacaatctgtttcattcttcaaagtatgtttgtactttggaatgaaggagaaattctagggaaaaattaattcagaaatcttttgaaataagacagttcaaacctaggaccaggtaaccacattgcattgcctcccagtgtgatatgactgtgcttccaagtatgcatc

SEQ ID NO: 7686 - DNA, 252 bp, Homo sapiens
  misc_feature (1)...(252): n = g, a, c or t
gtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaanttatctttatcca

SEQ ID NO: 7687 - DNA, 388 bp, Homo sapiens
cagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaat

SEQ ID NO: 7688 - DNA, 369 bp, Homo sapiens; identical to SEQ ID NO: 7545

SEQ ID NO: 7689 - DNA, 124 bp, Homo sapiens; identical to SEQ ID NO: 436
  misc_feature (1)...(124): n = g, a, c or t

SEQ ID NO: 7690 - DNA, 210 bp, Homo sapiens
  misc_feature (1)...(210): n = g, a, c or t
ccaatatgcctttggagcacagcctatggtttatgtttcttttatgaccacctttaatatctgtcaaacgactagacatgctatagctttacccgaaggtaatttgattgactgtgctctgctagaagatggtgtatgggtccctctcgacgtaactgccaataaatgataagnggtatttgttttagatantgcctctacctcagncgg

SEQ ID NO: 7691 - DNA, 264 bp, Homo sapiens
tcgaccctgaataaggtggtacaactaaggcatattatggaaaactggcattattgcttaatgtaacatgagggattggaatttctttaaagtaattttaagatatgattatttagcagaaatattcactggagcattttacttttagaaattatcgtcacacaaggaagcctttataggaccgactacctaattgcagtcaaagatctcttgaatgaatgaacacacacacacagaagaacacacattttaagaatatagcgg

SEQ ID NO: 7692 - DNA, 314 bp, Homo sapiens
  misc_feature (1)...(314): n = g, a, c or t
ccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtanacaatgagttgcgtatttgtgctagagataaggaagttggaaatctgtatgacatgttccacactcgcaactctttacaccgtagagcttatcaacacaaagttggcaacattattgatacaatgattacagatgcttt

SEQ ID NO: 7693 - DNA, 255 bp, Homo sapiens
  misc_feature (1)...(255): n = g, a, c or t
cccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccancaagagttaggggccttagggcactgggctgttgttccattgaagccgactctggccctggcccttacttgcttctctagctctctaggacct

SEQ ID NO: 7694 - DNA, 186 bp, Homo sapiens
ccatgtggagaaatcagatcactgcttaatgaaaggaattgaccaccgtcagctcgaaaatccacccacagtctagaattgggtgtttatcaggcagaagttctctccaaagacatttttagcatgtatctagtcaacaaactataagagagaaaacccaaagcttaaaggagggtgtgtaagggg

SEQ ID NO: 7695 - DNA, 161 bp, Homo sapiens
cctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggagg

SEQ ID NO: 7696 - DNA, 217 bp, Homo sapiens
ccacatcttcttcctgagcctactattcatattgccttatattcacaaagcaatggtgccaaggaaagagaagttaaagaagatggaataatccatttccctgcaggtggcctgtgcgggactggtgcagaaactactcgtctcccttttcacagcactcctttgccccagagcagagaatggaaaagccagggaggtggaagatcgatgcttccag

SEQ ID NO: 7697 - DNA, 220 bp, Homo sapiens
  misc_feature (1)...(220): n = g, a, c or t
cgaggtttgcagtttaagtattgnaatttcacaaaagacataggacttaactggaaaatgaaaaaaaaaagaaaaagaaaaaactaaacaaaaaatccctctaggtagtttaggtgaaaaatgtcccttttattttggctttggttgtgatttcaaagcataatgctatgtttttttgtctttttactatgtttttcggatttttaagtccgtaagtgca

SEQ ID NO: 7698 - DNA, 224 bp, Homo sapiens
ctgggcaagaaatgcctcaggaggtttttatttttcctcttcagatagatgttgcttcctgccaattgcatcctgtacccactgttccttctggattccatgatttaccatccagcagggcttttctgagtcgtctccagaagatgtgccgccccaggacactgtcctcccactccaggtaagtgttcctgctgagaaggcggtacagctccacctgctgcctg

SEQ ID NO: 7699 - DNA, 232 bp, Homo sapiens
  misc_feature (1)...(232): n = g, a, c or t
cctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctaccgaaaagaacaacaagtcttaccctcangtcaaaatct

SEQ ID NO: 7700 - DNA, 246 bp, Homo sapiens
  misc_feature (1)...(246): n = g, a, c or t
cctaatgaaaattgtacacttcaacacaaggtaattgaaaccttccttttgactgaaaccagtgtttgtagcactagtatattcctgcagacagacttgtagttacttgtagttattgtatagtctgtatagtctgttatttttttttttaagcanaaagtcaaaaaaattgttttatgtaaatatatataaaangtgaaggtacaggagggactatggcactgtgtgtgatgnaaaagggtattg

SEQ ID NO: 7701 - DNA, 152 bp, Homo sapiens
cgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctagg

SEQ ID NO: 7702 - DNA, 418 bp, Homo sapiens
  misc_feature (1)...(418): n = g, a, c or t
cgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcancagtttaaagacagtgatctctctcatgttcagaacaaaagtgcctttttatgtggagtcatgaagacttacaggcagagagaaaaacaanggaccacagtagcagattcta

SEQ ID NO: 7703 - DNA, 176 bp, Homo sapiens
ccagataaaatagtaacaaaaaaagtaaagagatataaaacaaactgtacactattacaaagtagtggttctctgtatgtctatgtgtatatatgtatatataaaactatacagatacatgtgtgtatataaacatacatatgtatatatacacacatatacttaattctaaagtt

SEQ ID NO: 7704 - DNA, 458 bp, Homo sapiens
ccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacga

SEQ ID NO: 7705 - DNA, 253 bp, Homo sapiens
  misc_feature (1)...(253): n = g, a, c or t
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccagactcggtaggtttgtcgcctctacctataaatcttcccactattttgctacatagacgggtgngctcttttagctgttcttacg

SEQ ID NO: 7706 - DNA, 275 bp, Homo sapiens
  misc_feature (1)...(275): n = g, a, c or t
ctgtcatcctatggcataaattccacttttattccctaagtgctttgagggctctatttggcaaatattacaacagatgctgaaatacaggagttgtgagtactacaatttgtcatctataccacacaaccanaatctgtatataaganatctacaaatcaaaatgnacgaggccantttctcatgcttcaccanctacacaaagcagtaaagacagacaatatacaagatttattangtaaaacanaacagactgcatgatatgctattccant

SEQ ID NO: 7707 - DNA, 163 bp, Homo sapiens
caggtcctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgc

SEQ ID NO: 7708 - DNA, 334 bp, Homo sapiens
ccaggaggagtcttagaggtgctaaatggctttcagacattccaatgacatctgagtcaagataattttccattttagaattagcctgtagatctgtaaagtcgcaggaaatgatacctgtatactgctaaatacaaatttaagaactttctagacatgtctgtacttgaaagggttctgtaatacattttaagtaatgtgtttactccaaaagctgctttccgtgaacatttaagtatctcataggtgaagttaaaaatcacagtcattcccacccttacccctgtacctatattatataagccatacctacccttacaaatgcctctctgga

SEQ ID NO: 7709 - DNA, 327 bp, Homo sapiens
  misc_feature (1)...(327): n = g, a, c or t
ccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctganaacaaaatcacctattcactgcttatgcagtcggaagctccagaagaacaaagagcccaattaccagaaccacattaagtctccattgttttgccttgcgatttnagaagagaattanagagggctgtattgattggngtgaagactganctatcccggggtc

SEQ ID NO: 7710 - DNA, 275 bp, Homo sapiens
ccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctaaagccttcagttcacccctctgcacagg

SEQ ID NO: 7711 - DNA, 281 bp, Homo sapiens
  misc_feature (1)...(281): n = g, a, c or t
ctgatcataaatagagcaagagaagatggggagcaatagagaaagatgttgaaagaaagacatcttcatcaagtgtaaggtgagaaggaaccaattggtggttcatgcacataataccaaaacagagaataaggacttcggcaggctttttaaagcacanactccatgtagtttctagctggctaancaaacaaaacaaatgtattataaggaggtgttaattacaaaagtgaccagttcttgccatgaattttanagcaccccaacagttctaacgtctc

SEQ ID NO: 7712 - DNA, 273 bp, Homo sapiens
caatgtggttggtcttcagcttgcagttagccaggttccataccttgaccagcttgtcccagccacaggagacgatgatagggttgctgctgttgggcgagaagcggacacaagacacccactctgagtggctctcatcctggacagtgtatttgcacacacccagggtattccatagcttgatggttttatctcgagatccagagacaatctgccggttgtcagaggaggaggccacactcagcacatccttggtatggcccacaaatcgcc

SEQ ID NO: 7713 - DNA, 351 bp, Homo sapiens
  misc_feature (1)...(351): n = g, a, c or t
cctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatgtacttttttttgttctaggaatgagggtaggataaatctcanaggtctgtgtgatttactcaagttgaagacaacctccaggccattcc

SEQ ID NO: 7714 - DNA, 282 bp, Homo sapiens
  misc_feature (1)...(282): n = g, a, c or t
ctgaagatttggtatcacaggtttttaatgactattcacaattcaatagcaagtgggaagtgaggttaagaaaggggattaaactccacaactgcaatgagtatctgaaatccttggttttagatgcggggatgggggtgaacaaaaaggatgacagagcaaagtgctaccaggaggagaagtccagtctgcatgaagatttgtctttaataaataacttcataaactgtggccttcttatccccanagccantgacaatgtatttgtcgccacggagatgt

SEQ ID NO: 7715 - DNA, 250 bp, Homo sapiens
  misc_feature (1)...(250): n = g, a, c or t
ccaatttcttcactctcctgacactttgaagtaaccactcaactccacagacttcttgttgagacttttttgcatggaaaacagatattttgggggggggcattatatgctaccgatattaggataaaatgtgtttacctagaggtttctaggagagagtactgttctcttctggtgagggaagagaggattgtgaaaatatttctccttgaagcatcagcatgtntcanatcaaaatcttgacccgagg

SEQ ID NO: 7716 - DNA, 218 bp, Homo sapiens
  misc_feature (1)...(218): n = g, a, c or t
cctactgtaaagagatgatgcatggtaaaaggaaaatggcagctctatgttattaccagtagtgaaggtgaatgatanattgttacatacagagtaagacttaaatgttgtgaagtttcctacagtttgacaaccaaaacatctaaaaaattcaaataaattttaaggtaatcttgatcttggttgnnagttgcaccaganaggacaccttattttta

SEQ ID NO: 7717 - DNA, 451 bp, Homo sapiens
ctgtctgaccatggggaccttctgtctgaagaggagctggatgaatgagactctgggaatcatctacacaggaccaaacccaacaggcgccctggcaccggggaggcgggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaagtagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccag

SEQ ID NO: 7718 - DNA, 101 bp, Homo sapiens
ccagtggggcagcccttccccattggggtttccattgcgagcaaagttggcccagaatttcatcaccatcttgctaagtctgatctcctcttctgaggcac

SEQ ID NO: 7719 - DNA, 139 bp, Homo sapiens
ccaagtcagtcccagccagaaggctgtgtctccagggagtggctgacctgatccttcttgcccattcttggggttctgggacttggaggaactcaagtcttcgctgtaagaaaatccctccaggacaacaaactgttaa

SEQ ID NO: 7720 - DNA, 390 bp, Homo sapiens
  misc_feature (1)...(390): n = g, a, c or t
cctcttggctctggagaaggcatccttagcatcctcttctgaagggtgatcataagccccaagttaattaaataggcccaatgtctgcctgctctttctgtattcccttcctgaatctagttcatgtcaacaaatgtgtactattattgtagaaaatcgaatgctctcatacttttaataggtttgcttcttggttaatatgcccaggtcaggaagtggcttatatttcaggagtgctctctaatacttattgcagatattcaagcatttattctctcacacacacgcacttaaaaaccgcacactacctcacactctgcaataatccgatagtatggtggtcatcatacccacatatatacatganaagatagaatgcattgcttaaat

SEQ ID NO: 7721 - DNA, 149 bp, Homo sapiens
ctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttactt

SEQ ID NO: 7722 - DNA, 208 bp, Homo sapiens
  misc_feature (1)...(208): n = g, a, c or t
cacaactgcttacagaatggatcatgtcccccttatgttgaggtgaccacttaattgctttcctgcctccttgaaagaaagaaagaaagaagactgtgtttttgccactgatttanccatgtgaaactcatctcattacccttttctgggtttgaagctgctgtctctanaagtgccatctcaattgtgctttgtatcanncagtgct

SEQ ID NO: 7723 - DNA, 331 bp, Homo sapiens
  misc_feature (1)...(331): n = g, a, c or t
ccttgggaannnagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcanaaatgaaaaagggcttttaacctatacttcttgggaggatgcgctctctcgcagtagctggaatgtttgcagagttttcaaggcaaanatgtggcaccaattgcaggtggcttggtggatgctgaagccct

SEQ ID NO: 7724 - DNA, 232 bp, Homo sapiens
ctgctggttcttctttttggggctctccattactgggctcctgggactggctgtgtggttctgtgtttgtgtgtgtcgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtg

SEQ ID NO: 7725 - DNA, 205 bp, Homo sapiens
aaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttat

SEQ ID NO: 7726 - DNA, 434 bp, Homo sapiens
ctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacag

SEQ ID NO: 7727 - DNA, 383 bp, Homo sapiens
ccacgaacactaccatgatgggaaaaacaaggcaaagaaaccactcgggatcttttagctccaatgaatttgaggaagaattagtgtctccatcgtcatcagaaactgaaggcaactttgtctatcgcacaggtaagtccgtgctttctgtagtaattcctgcgatacctgtttaaagcacaattaaaactgcatcagagggatttattttaacaggtataaagacatcagattattcacatattgcccataattcagttttaaagctttcgttttgtttagaattgccaatggatacatttgttagtagattatggtcttactgagaaattttcagttttcatattaaagacaggaagttttattctttttatattttttaa

SEQ ID NO: 7728 - DNA, 449 bp, Homo sapiens
  misc_feature (1)...(449): n = g, a, c or t
ctgctgaagttcaggttggtggtgctgctggtggtgatgttgcattaactgatacaaaaaggcttgatgttgttccttaggcaaaaaacatgtgagagaaaatgagttcccaagcacggaattcagcagtcagatgagctgccttatgttttctttcctttaatattagatatttgcaaagaaagaaaacaagtatctcatctagaaaaatatgctgcactagataataaccatctactataaaatgtcagtatcttcagcaaacagcttattttcaaaacaggacacacataggagagctctattaggttatccgtgatgatcaatcaggaagtgcnncancttaagagaaatcaaggtggacatttgaatgcatcatgcgtggtcaaaccctttcccaacttaaaacaaccttaaagttcccgtttctgcctgtnattagggngctt

SEQ ID NO: 7729 - DNA, 382 bp, Homo sapiens
  misc_feature (1)...(382): n = g, a, c or t
catggggacatttgcggaaatttatggattgtatgttactactgtatcgatgttaaatttcttgagtattataccttgtttttaggagatgcatgctaaagaatttatgcataacgaatcccataatgagaatgcaaatgtggctagatgttaaagtttgtgatctagctgggtgcagtggctcatacctgtaatcccagcactttgggaggctggggcaggcagattgcttaaacccaggagtttgagaccagcccaggcaatatggtgaaactccatctctataaaacataaaaaaaattagcttggcatagtagcacgtgcctgtggtcccaccactgnggaggctgaggtgggagaaacgcttgagcttacnaagtcg

SEQ ID NO: 7730 - DNA, 294 bp, Homo sapiens
cctttgaacagcgccgtctggaagctatccaccaggacagtaatcaccaggttgaggaagatgaagtactggatgatgatgtaaattatgaggatgggaatgatgtaccaggcgccctgggcacggctgtccatgtagatgagggaccagtcatccagcgtgagcaaggtgaagagggtgaagatggtggtgaagatgttctggaagcgcttggggtcagatttgcggaacagtgcccggaggaccgcggagaagaggaagaggcaggtaaacatgaggatgaggatggctgcg

SEQ ID NO: 7731 - DNA, 241 bp, Homo sapiens
  misc_feature (1)...(241): n = g, a, c or t
ctgcatcacttcacaagaagaatttgaatcctcactagaaggggtaccatcctcttccagttcatacttcccatatccaacaacatgaacgctgagcattttacttcctggccctctatgggccttgaaccatgtgaccaagtctgattttgagaatgacttcagtgcttcaatctcctgggcaaggcggtcaaagaggtactgctgtgtaaccacttcattccagttcctatccncctcc

SEQ ID NO: 7732 - DNA, 338 bp, Homo sapiens
  misc_feature (1)...(338): n = g, a, c or t
gaaggcggcccgggtcatcatagaaaagtactacacgcgcctgggcaacgacttccacacgaacaagcgcgtgtgcgaggagatcgccattatccccancanaaagctncgcancangatagcaggttatgtcacgcatnngatgaancgaattcngagaggcccagtaagaggtatctccatcaagctgnangaggaggagagagaaaggagagacaattatgttcctgaggtctcanccttggatcaggagattattgaagtagatcctgacactaaggaaatgctgaagcttttggacttcggcagtctgtccaaccttcaggtcactcanccta

SEQ ID NO: 7733 - DNA, 433 bp, Homo sapiens
  misc_feature (1)...(433): n = g, a, c or t
cctggctcaacaaaagggcnggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgntattgatttctatcttgntgaagacaaatcgcttttccatcttcttctttgggtaatttttgg

SEQ ID NO: 7734 - DNA, 348 bp, Homo sapiens
  misc_feature (1)...(348): n = g, a, c or t
ctgcataccnctgggtacangagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaagg

SEQ ID NO: 7735 - DNA, 471 bp, Homo sapiens; identical to SEQ ID NO: 429
  misc_feature (1)...(471): n = g, a, c or t

SEQ ID NO: 7736 - DNA, 522 bp, Homo sapiens
  misc_feature (1)...(522): n = g, a, c or t
ccacactctacttctgcttctgccacctatggggtcgaggcangtgtggtgccttggctaagtccacagacttctgagaggcccacgctttcttcttctccanaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgncgtaatggagccacttgtgttgatggttttaacaca

SEQ ID NO: 7737 - DNA, 450 bp, Homo sapiens
  misc_feature (1)...(450): n = g, a, c or t
ccaccggcctgatggaanncgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtacggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgc

SEQ ID NO: 7738 - DNA, 501 bp, Homo sapiens
ctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttg

SEQ ID NO: 7739 - DNA, 488 bp, Homo sapiens
  misc_feature (1)...(488): n = g, a, c or t
ctgcatcccatgtgcgtcgatgggcaaagtatttgtagcactgcccttggaatttgtgccagccatagtcacatgtctcggtatcttgctcacaaagtgcaccaacataacttggaaggcagaggcacctgaatgtgttaaaaccatcaacacaagtggctccattacgacagggattagagtgacattcatcaaaatcaagttcacactggtctccgctgtatcctggcacacaggtgcatacgtaggaagtttcagtaggataacaggtgcctccgttaaggcacgggttcattttgcagcgatcaggtcctggtaaatagattgccgtgccttccactgactcttcattaatgccaatcaggaaatctgtttcattagaagtctccagaagggaaaatggtggtgttgcaacctcagtattaaattccacagggtttactgttgcctgatcattggaatcaagaattctngctgccacttgctgt

SEQ ID NO: 7740 - DNA, 451 bp, Homo sapiens
  misc_feature (1)...(451): n = g, a, c or t
cctgtctgactactttgccnncttttgtngcatataggngatgttngctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattntgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttatac

SEQ ID NO: 7741 - DNA, 490 bp, Homo sapiens
  misc_feature (1)...(490): n = g, a, c or t
cctgatagatctgggcatangagcttcaggaataaaatgcatgtgaatgcggtgtttcccagggagaattaaccgcattctcgccttcaaatctgaatacctgagagtcataaccagcccagtagggtagactatgaaatgtatagcaaaattttcaaaaccagctcctcctaccagacaagaaaattaacattttttagggcacagaactgaaagcatttttactgaaatctaatccaggatgaaacctaacagttaaacattcttttccttctctgcttctttggctctctatcccagcacaccttgtcccaggctaacttgagtaaacatacacatgtgaccacatgagggcgggaagaacaccaagtgggggtggtgaaattctgaatggaatgcagccccagctagttagggggccccgggctganacctctggcactggcagtanacttatacaggcaaagaagccaaaacaatgagctcatgg

SEQ ID NO: 7742 - DNA, 230 bp, Homo sapiens
gcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccag

SEQ ID NO: 7743 - DNA, 345 bp, Homo sapiens
  misc_feature (1)...(345): n = g, a, c or t
ctgtagagtgggcttatcanctttcaacacgcaggacaggtacagattcttttccttgaggcccaaggccacaggtattttgtcattactttcttctccttgtacaaaggacatggagaacaccacttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcgaagaagataggttcttcttcaaagatgaagggaaagaaggtgctcaggtcattctcctggaaggtctg

SEQ ID NO: 7744 - DNA, 413 bp, Homo sapiens
  misc_feature (1)...(413): n = g, a, c or t
ccactgtggncttagggggngccctccccgaggcctggtgtggtggctcacgcctgtagccccagctattgcaccactgctctccaagctgggcaatggagtcagattctctttcttaaaaaaccacaaaaaagctggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctgg

SEQ ID NO: 7745 - DNA, 457 bp, Homo sapiens
  misc_feature (1)...(457): n = g, a, c or t
ctgggaattgctctattgtacaaatacagttttgtacaaaaaaatcacaaaatgttacaaaataaaaaaagtacaaactgcattacttaataaatatgactaaaagtagttaaagtggcaatgagattgattttaagttggaaacattgtttgacccagcaaaccatacaagctctgtttacagacatttctacatcaatacagggcaatcctattttgccttttgaaagaatgtaaagaaatattaagacagtgttctcctgctataactgccaagnttggctccagacatttatgccattagtttataaatctcttagctggattcaagaagttatataaagcaggaggcttatcttgtcacagagttttataccatgttaacattctcttacaacaacgtgacaaatgtaaataaaaacaactgagagcaccagacaatctactctacacatca

SEQ ID NO: 7746 - DNA, 240 bp, Homo sapiens
cctggatcttctttactggggcctgcccctcggggtacagtgcattaatgagcccacatagcaccgtgccatccttgagccagttctggaagttctcgcgtccaggctggggccggcccacatcctttcggcactgggtggtgatccactggatcaggatctgctccagatctgcatcatattgtttctcaatcttctgctgcacctcccggctcaggccatatgcaggtcccctgttgg

SEQ ID NO: 7747 - DNA, 294 bp, Homo sapiens
  misc_feature (1)...(294): n = g, a, c or t
cgagctggatccagagntgcatacagaccaatttctgcatcagtgttatctcgaccagaggctagtgggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcag

SEQ ID NO: 7748 - DNA, 607 bp, Homo sapiens
  misc_feature (1)...(607): n = g, a, c or t
tcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactganagaagatgatgttggaacagg

SEQ ID NO: 7749 - DNA, 90 bp, Homo sapiens
  misc_feature (1)...(90): n = g, a, c or t
ctcctttatttctaagtggaaaaagtattanccaccatcttacctcacagtgatgttgtgaggacatgtggaagcactntaagttttttc

SEQ ID NO: 7750 - DNA, 395 bp, Homo sapiens; identical to SEQ ID NO: 430
  misc_feature (1)...(395): n = g, a, c or t

SEQ ID NO: 7751 - DNA, 382 bp, Homo sapiens
  misc_feature (1)...(382): n = g, a, c or t
ccaacaggnggcagaagangaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcantanatagtcaaagncaaatcatttctaatgttttaaaaatgtgctggtcattttctttgaaattgacttaactattttcctttga

SEQ ID NO: 7752 - DNA, 406 bp, Homo sapiens
  misc_feature (1)...(406): n = g, a, c or t
gtttcataagaattctgttgatangaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgtcatcatttacttttaaactttgattttatatgctatttattaagtattttattaggagtaccataattctggtagctaaatatatatttttagatagatnaagaagctagaaaacaggcaa

SEQ ID NO: 7753 - DNA, 550 bp, Homo sapiens
gacggctctagctaggtgagcggctccggccagttcccttttagactatggcgacatacctggagttcatccagcagaatgaagaatgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagacgaccttcaagcactcaaagagtccctgcagatgtccctgagtcttcttcctccagatgctctggtgggtctgatcac

SEQ ID NO: 7754 - DNA, 598 bp, Homo sapiens
  misc_feature (1)...(598): n = g, a, c or t
ggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgtatccaccagatgaattctgaactgtcagtgcttgctaacttcagtcaacctgaaatagtaccaatttctaatataacagaaaatgtgtacataaantttgacctgctcatctatacacgg

SEQ ID NO: 7755 - DNA, 387 bp, Homo sapiens
  misc_feature (1)...(387): n = g, a, c or t
ccactgtgtagcaccttcnaattcaatttcatcggcagttgtaataacagttccagcctcaggtgttttaatggtgggaaacatcttgattgcttctccagaaacttgaccatcggttttgttttggaaatcttggagaatctcagttccttccacagcaataagttctgtgggagaagcttccatttcttctaataactcaggtttaccatcatcttctgaaggttctaattttgtgtcaggagataaagagggaggctcagttatgtgaaggtattcctcacttgatggtttgaaagtcgcttcaatatttacatgaatttccttaaaagaatcctgtggggacattacagatgagccgacgtctattcctggcagagcactggg

SEQ ID NO: 7756 - DNA, 477 bp, Homo sapiens
  misc_feature (1)...(477): n = g, a, c or t
ccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttnganacggagtctcactnttccgcccaggctgcagtgcagnggcatgatcttggnttactgcaacctccgcctcctgggttnaagcaattntgnggcttcagcctccggagtagctgggattacaggcacatgccaccacacccagggaatttttgtntttttagtananacggggtttcaccatgttgg

SEQ ID NO: 7757 - DNA, 410 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccag

SEQ ID NO: 7758 - DNA, 484 bp, Homo sapiens
ttataatgtacattctgacaataaactctccgagatgcttagcctctttgaaaagggactgaagaatgttaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcag

SEQ ID NO: 7759 - DNA, 445 bp, Homo sapiens
  misc_feature (1)...(445): n = g, a, c or t
gaggagagaantcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgaga

SEQ ID NO: 7760 - DNA, 347 bp, Homo sapiens
  misc_feature (1)...(347): n = g, a, c or t
ctgtcctcngttactcacnnacagttccaaaactaagcgattatataagcacatccatattttagggctactctaagttaaaaaccttttctcttgtttcagagttatttacatnaaattaagacatttacaaattgttcatagtatacaatagcccaaatatgattttcacctatgctgtgtaaagaanttaagcattcgtaagtttgtctaataaatncagtgcacttttttccataacacgagctattctaaatgttttacatttctttcantgcatatttccaaattcattaaacngaatgaaatcanngttattaaatggctatatcataatattcangcnt

SEQ ID NO: 7761 - DNA, 392 bp, Homo sapiens
  misc_feature (1)...(392): n = g, a, c or t
ctggcagatgcagaagaagcnatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaagg

SEQ ID NO: 7762 - DNA, 413 bp, Homo sapiens
  misc_feature (1)...(413): n = g, a, c or t
cccatacccacttcctgatnctttggttctctttcctgctcaggtcccttcatttgtactttggagtttttctcatgtaaatttgtataacagaaaatattgttcagtttggatagaaagcatggagaataaaaaaagatagctgaaattcagattgaagaaatttatttctgtgtaaagttatttaaaaactgtattatataaaaggcaaaaaaagttctatgtacttgatgtgaatatgcgaatactgctataataaagattgactgcatggagaagtcttcatcaagactatttttctaacacgattacattcagtaacaaaagtagtcagcagttttaacagtttttctagacaatggagagactgagaaatgtacattttgtttcatacataatgttggttactgctt

SEQ ID NO: 7763 - DNA, 544 bp, Homo sapiens
  misc_feature (1)...(544): n = g, a, c or t
ctgcatcccatgtgcgtcgatgggcaaagtatttgtagcactgcccttggaatttgtgccagccatagtcacatgtctcggtatcttgctcacaaagtgcaccaacataacttggaaggcagaggcacctgaatgtgttaaaaccatcaacacaagtggctccattacgacagggattagagtgacattcatcaaaatcaagttcacactggtctccgctgtatcctggcacacaggtgcatacgtaggaagtttcagtaggataacaggtgcctccgttaaggcacgggttcattttgcagcgatcaggtcctggtaaatagattgccgtgccttccactgactcttcattaatgccaatcaggaaatctgtttcattagaagtctccagaagggaaaatggtggtgttgcaacctcagtattaaattccacagggtttactgttgcctgatcattggaatcaagaattctcgctgccacttgctgntctgatgctgctatcgnggaatcctgccctctgattaaagctgcttgagtttcagg

SEQ ID NO: 7764 - DNA, 449 bp, Homo sapiens
  misc_feature (1)...(449): n = g, a, c or t
cctggctcnncaaaagggcnggggattggccctgaaaggagagagctgactgtcctggctgatggacaggagatcctcttancactaccctaaggcaggcagttgggcattggngtagacaacaggaaagtccaggctatagccgnactcaaaaacctttctgttccctttctgccanccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtgccagttggggaactgggcagactcaaattccagcttgttattgatttctatcttgttgaagacaaatcgcttttccatcttcttctttgggtaatttttgggatctacactctccag

SEQ ID NO: 7765 - DNA, 592 bp, Homo sapiens
  misc_feature (1)...(592): n = g, a, c or t
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagnaaaatgagagcagaaagtaagcat

SEQ ID NO: 7766 - DNA, 443 bp, Homo sapiens
  misc_feature (1)...(443): n = g, a, c or t
ctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaaganattcatacaggccaagtgatganagggggagtcaccaaggcttcagccccaagggcatntncagcctnaggccggcaggtcctatgtccttgacacaaacgcttcttgntgaaatcctccctantgatgctgcgantgctgttggtcccanttct

SEQ ID NO: 7767 - DNA, 451 bp, Homo sapiens; identical to SEQ ID NO: 274
  misc_feature (1)...(451): n = g, a, c or t

SEQ ID NO: 7768 - DNA, 478 bp, Homo sapiens
  misc_feature (1)...(478): n = g, a, c or t
ctgaaaaaccaagaacagnttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataa

SEQ ID NO: 7769 - DNA, 341 bp, Homo sapiens
  misc_feature (1)...(341): n = g, a, c or t
gctgaaattnagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctg

SEQ ID NO: 7770 - DNA, 437 bp, Homo sapiens
cctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctgg

SEQ ID NO: 7771 - DNA, 303 bp, Homo sapiens; identical to SEQ ID NO: 431
  misc_feature (1)...(303): n = g, a, c or t

SEQ ID NO: 7772 - DNA, 513 bp, Homo sapiens
  misc_feature (1)...(513): n = g, a, c or t
ccaacatactgaaaccccnnccttactaaaagtacaaaaattagccaatgtggtgatgcatgcctgtaatcccacctactcgggacactgaggcaggagaatcgcttgaaccagggtggcggatgttgcaatgagccgagatcatgccactgcactccagcctgggcgacacagcaagactctgtctcaaaaaaaaaaaaaaaaaaaaaaaaattntgagacaaattaaacacccaacaattgagagaaaaaaatattctgttttttgaaaaaatttgtatagaacattgccttctattctataacaagtcctcagttgagcatttagagtatgtttaatgaaagcatgcagaggggaataaaacctgttcatcatctaaattaatcccctttatgtatccaatgtactttctatttgacacacaaaagtatgagtgattaggaaaatactaattgagctgaatgacataaattgtattaagtggatgatcacaaattcagatgctatatacg

SEQ ID NO: 7773 - DNA, 579 bp, Homo sapiens
  misc_feature (1)...(579): n = g, a, c or t
ctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgngagtga

SEQ ID NO: 7774 - DNA, 458 bp, Homo sapiens
  misc_feature (1)...(458): n = g, a, c or t
ccttagtcanncttagctccctgtatcttctcactctgacccactgcgcgttccttcaagcagagagctgcctcccatggctacctcctcaatataaacttgctaactaatctcttagcaaacacttgaagaaaacctgaagagtggaaagagaggcagagggggaacananacccagcgtanataaagctcangacacattcaacgggacgctggaatctaaatttagnaccaaacttaagatttctttagataggcgagctgttgcctctggaacagggattttcataacaattattttgtttttaagtctcaatcttaattcttctgctatctcttaaatagggctcactttaacataaactcccttgatttttttttctctcagtggtgatgtgcctacccttataggtattcttataggctttcttttattactgaatatctctttaataatt

SEQ ID NO: 7775 - DNA, 422 bp, Homo sapiens
  misc_feature (1)...(422): n = g, a, c or t
gttggggcnnnccttggttttatacattttagggagacataagacattaatcaatatatgtaagaagaacattggttcagtggggagggagcttccaggtcacagataggtgagacacaaacagttgcattcttttgagtttctgattagcctttccaaaggaggcaatcagatatgtatctatctcagtgagcagagagataactttgaatagagtgggaggtgggtttgccctaagaagtttccctaagcttgagttttccttagtgattctggggccccaagatattttcctgtcacagttgacatccccaacacagtgtttagggctcagaaaaagataccctaaaatagggtgctttggcatgctgaatgctttgaataaaggaggctgaagggcctcagaaataagagaacaaagg

SEQ ID NO: 7776 - DNA, 554 bp, Homo sapiens
  misc_feature (1)...(554): n = g, a, c or t
cctaggggccgcaagacggctaatttattataatttctccttttttagtacatgcacagaaagcctgacagccaagtgtacatgaacatacacacacacacacacacacacacacagaggccaatttccagtgaggaacaggctccacagaagaagctgataggcaggggggatcaaacgctgctcccctgctcaccgatctacttctccaaatacaatatcttgggtacctatgatggcaacgacatctgccaacatgtgtcccttagacatcttgtccaaaccagccagatgggcaaaaccaggagccttgatcttgcatcgataagggcggctgctgccatcagacaccaggtacaccccaaactctcccttgggagcctcaatggcagtatatgtggctcctggaggaacttggtagccctcagtatacaacttaaagtgatgaatcagtgactccatggaagtcttcatctctgctcgcttaggtggagacactttggcatcatcaaccttgatctccccaggaggcatcttgtttagacactgngcga

SEQ ID NO: 7777 - DNA, 474 bp, Homo sapiens
  misc_feature (1)...(474): n = g, a, c or t
cctgctcacnggtgaatcnnttctctgggtccttctccatcaagtgccggatgaaatctttggcagagtcagagatgtcgtcccagtaaggagagtcaaactcgtactcggccttcaaaatctgttcaaagagtttggcatcattctcgtcatagaagggagggtaaccgcagagcaagatgtaggcgatgacacctatggaccagcaatccacagccttgctgtagggcttctgggccaggacttcaggggccacgtatcccggagttccacaggcggtggagagcacactgcccgggtcctccatcttggagaggccaaagtcggagatcatgattttggagtcttcatccaggctgtagtacagcagattctctggcttgagatcccggtgtacaatgcccaggtcatgcaggtatttcacagcatccagcacctggaagatgaggcggctggcgtcccgctccgtgtaga

SEQ ID NO: 7778 - DNA, 518 bp, Homo sapiens
  misc_feature (1)...(518): n = g, a, c or t
ccacttttttttttctgcnaacctcaaatgaaacagaatctcacagatgtggggtccccctcctaattgtaataaacgttagagaaatgctccagaaaggaacaaagggagaccctctcagatcagcctaaaaccagagtggaatagggctcctctgggcggtttaagggcacagaaaggaccctcagctactcctggcctccccgggtctctttcccagaagacacaactttccaggctgccaaaagtaatagaagtcaaaaccctcaaaaccaccactgctctcgggaagtttttgagtaggatgaggaagaaagaagagagccctccttcattttgttacacgatctcaaggccaagagcaagtagaagatgtctaaagagaacaaaagaggtttcttcctggtactgtactacagatcagcaacagtttcacagggaggcgttggctcaggttctggtacatttgaagataactgaaggccaangacttanccaaggaaggacaccagcagaac

SEQ ID NO: 7779 - DNA, 518 bp, Homo sapiens
  misc_feature (1)...(518): n = g, a, c or t
ctggcctgtcctgtcgggtgaagcacagcagtctagagggccaggacatcgtcctctactggggtgggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaaganctgatgtgantgtgtgtgatgggatc

SEQ ID NO: 7780 - DNA, 564 bp, Homo sapiens
  misc_feature (1)...(564): n = g, a, c or t
cctcagaacagtcaagaaagttttgtcacttggactcgaccttaatagcagttttcatctgtcaggtgtgtcaatgatgccattttctttcaatgaatcaaagcaggcgattactcgtccattttcaacttggcagcttttcgaaggatgtgcaaatttacattccgtgtctggccgtgagcaagtccccctctggaactctctacatacttccagtgttagccattttgtgtcccgaattggtgtgacactaacagccatgtttagattttacaggtagttaaatgtttcagtgaaaccaacaaacccaacccccccaaaaaagagcaacaaccaaaaaaaaaaagctgaactgatgatgaaaatgtcccctcaaaatacttttccccactccctgctttaaaagtacatggaaaattgtgtcgtcaatatcaaggaaaagatctcccactagaaattcacagcatgaaactgttaattcaaagaggttttggtttttagagaaatactaggattgtaagtagatgaacgtttaaaagtagggcctggtatcanccttgtgct

SEQ ID NO: 7781 - DNA, 195 bp, Homo sapiens
  misc_feature (1)...(195): n = g, a, c or t
cggagtttcgctctgtggcccaggctggaatgcagnggcgcaatctcggctcactgcaagctccgcctcccgggttccacaccattctcctgcctnagcctcccgagtagctgggactacaggcgcccaccaccatgcccagctaatntttngtatttttttttancananatagggtttcaccgtgttagccag

SEQ ID NO: 7782 - DNA, 477 bp, Homo sapiens; identical to SEQ ID NO: 432
  misc_feature (1)...(477): n = g, a, c or t

SEQ ID NO: 7783 - DNA, 260 bp, Homo sapiens
  misc_feature (1)...(260): n = g, a, c or t
gtaagactccnnctcaaaaccaaaccaaaccaaaccaaaaaaagaagtgagttggcactttcaacattctgcctggaaatctccttaccaaacctataagatcattaggtatattttctgcactttgtattgtgacaggtgacagtgttaccaaactttttaccaggacataatagggtctgcctttcttctagttgctaacaatttcccccaagtccatcttgcctgcactaacagtctcctttagacctctcctctcc

SEQ ID NO: 7784 - DNA, 467 bp, Homo sapiens
  misc_feature (1)...(467): n = g, a, c or t
cctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaagnaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttgg

SEQ ID NO: 7785 - DNA, 537 bp, Homo sapiens
  misc_feature (1)...(537): n = g, a, c or t
ctgctgcancctgctttgcctgcacacaggaaaaagtacacatttggggcagaccttaatgaggacgtataaatatctggcccctgatctgacatatctgaagtgtgatctccactattaccagagttcccctgagggactatgtccatgggactttgtttatctcacatccttacttgctgtccttccctgtgccatttcctcactcatgggaatgctttctagtacatcactgtctcatgaaaccttgtcttagcgtctgcttattgggacagtgatggcaacttaagtcatacgtaattgttaaacctaggattggcaaaactgagaatcactgggcaattttatataaacgcttttccagagaagagtgaaaagaaattcttctagttggtatctctggtagataccataaagtaataaagaaaagctaaaataaaccccagagtctaactcagcatgattctacactttctgtangcttctgtaggcttctagaaattccctggaaagggaattgncaaaatataaaaaaca

SEQ ID NO: 7786 - DNA, 529 bp, Homo sapiens
  misc_feature (1)...(529): n = g, a, c or t
ccacctggagacggtgantttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtat

SEQ ID NO: 7787 - DNA, 368 bp, Homo sapiens
cctttcttgtaagtgaagaaaaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 7788 - DNA, 346 bp, Homo sapiens
  misc_feature (1)...(346): n = g, a, c or t
ccaagaancagtggccnnattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgncttttgnnaccaggaacagcaaatgcaaaaactctttgagagggtangagggtgggaaggaaacaaccatgtnatttcagaagttagtttgtatatatta

SEQ ID NO: 7789 - DNA, 362 bp, Homo sapiens
  misc_feature (1)...(362): n = g, a, c or t
ggcaacgctgaaagtacgngaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaagg

SEQ ID NO: 7790 - DNA, 272 bp, Homo sapiens
ttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttattgccaaaaaaaaa

SEQ ID NO: 7791 - DNA, 541 bp, Homo sapiens
  misc_feature (1)...(541): n = g, a, c or t
ccaccccaccctaatcttattatgcaaatgagctttggctgacactatgttgcctgctttttactgtacacatggctggcaaagagaagggaacttggagccgccattttggacatgcctagtctaggtagctttttcctattggcacagttgccagcattcacccgtggaagcttccagcttgcttgtctatgtctgcagctcgattttacaggctgttctttgttagaaaagaaaatgattttgggggctgcttttcattaaacagaaaacctcactgaggacttcctacccttgctatttgcctaaatgatttctccttaactcctatatcatcaccatgcttggctaatttttaatttttttttggggtagagatggttctcactctgttgcccacactggtctcaaactcctgggcttgagccatcctcctgcctcaccctcccaaagtgctaggattacagggcatgaactgtgccatacccatcttcgaggntttatggncatgtanaatttctgttcaaggaaagcagataac

SEQ ID NO: 7792 - DNA, 434 bp, Homo sapiens
  misc_feature (1)...(434): n = g, a, c or t
ctggtcacntcatgctgnntagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctganacagtatttagggtttctgggagtgaggctggt

SEQ ID NO: 7793 - DNA, 550 bp, Homo sapiens
cggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgattagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctctt

SEQ ID NO: 7794 - DNA, 367 bp, Homo sapiens
ccttacccccacaccaccccccagtctcaaagaattgctcatcaaggaggtgctggactaacccttgcctagatttaagccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccgggggactgtggcacaggttggggcaatgttcccttgttggtgggcccccaagctggcaagg

SEQ ID NO: 7795 - DNA, 385 bp, Homo sapiens
  misc_feature (1)...(385): n = g, a, c or t
atgcagaanaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccanacntttctctanaancngtctgcgtttactcttgttttcaaagggacttttgtaaaatcaaatcatcctgtcacaaggtaggaggagctgataatgaacnttattggagcattgntctgcatccaagg

SEQ ID NO: 7796 - DNA, 564 bp, Homo sapiens
  misc_feature (1)...(564): n = g, a, c or t
tggatattgccaatatctggattttatgtatctatcataaaatttgtcacataggagatggtagaagaccatagttaatgtggagtaacgttttatatagctaatctctacttaagaaacctttcattcagagtatgaagaaaatgatttaaaattttgtggaggtccccttatttctgttacagtaatagttttactgtattttgtgaaactctacagtctctttaaaaaaatgattatgttgtttatgataattgttttgatgtcatttttattttcatcaaaatcaatgtgaaatgtattagaaaaaggcatagaaattcataggcgtttcatttacttcctcaactctagatgtctttcagaatacctatattggtgagcatagaacgaatgcgtcggaatgattttcctctacttgaagcctaccttctttaaaaagagcctgacttgagggccaaaattcatactgaggagaggctgacagatcctttgttttgcaggggctccagancttgatatatttctnggaatttggaatatgctaaactagatttctgccct

SEQ ID NO: 7797 - DNA, 317 bp, Homo sapiens
ccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgagg

SEQ ID NO: 7798 - DNA, 472 bp, Homo sapiens
  misc_feature (1)...(472): n = g, a, c or t
attacgggttggaacccannccaatgtaatttcaatcgtgttaagaaagtaatggtgacttnacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaagaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaantaagaagttaagttgttgctatcgcaaca

SEQ ID NO: 7799 - DNA, 573 bp, Homo sapiens
tcgaccagcattatccttgcaggaaaccagaaaagcaaaatcttcatcaccaaaaaaacagaatgatgtccgagtcaaatttgaacatagaggagaaaaaagaatccttcagttccccagaccagttaaactggaagatctgagatctaaagctaaaattgcctttggacagtctatggatctacattataccaataacgagttggtaattccattaactactcaagatgacttggacaaagctgtggaactgctggatcgtagtattcatatgaagagcctcaagatattacttgtaataaatggaagtacacaggctactaatttagaaccattgccatcactagaagatttggataatacagtatttggagcagagaggaaaaaacggctatctataataggtcctactagtagagatagaagttctcctcccccaggttacattccagatgaattacaccaggttgcccggaatgggtcattcactagtatcaacagtgaaggagagttcattccagagagcatggaccaaatgctggatccattatctttaagcagccctgaaaattc

SEQ ID NO: 7800 - DNA, 558 bp, Homo sapiens
  misc_feature (1)...(558): n = g, a, c or t
cctcacgcnnaaactagtncagttcatgaaaacccgagatactctgccagcttcttgaggaagcagtgttgtcacacttttctgagcttcagtgattcacacattttgataagacagcatgttctgtgggttaagtacatttaccttttcaaaatatactcccatgaagtatcatggttcanaattacacacttacaaagttaaatggcataaaactactttgtaaaaagtgcctacactctaaaaggtgatttaaaggtttatgacatcttaattcaagtgaatactgaatcagtaggattatngagcaggtgctctaanttagggaatctggagtcagtctctcctttgcttatgtgcaatgtggacccagggatttctcaatttctctgtcagaatttttaacatggtnaaatggctattattatatggaatgatatttcctaagctctgacacatactctttctccaaatcacagggtttatgaaacnaagatacacacacacacacacacaccacacacacacacacacacatatntgtatacacacatntat

SEQ ID NO: 7801 - DNA, 441 bp, Homo sapiens
caggcattgagctactgtgctcaacctgaggtcatgtatttttaattcataacttttacaaatatttactggatgactgccatgccaggcattttgaggaattcttggctactgtctgaccacctgaatccttggagccgaagaggagcgaggagcagtgttcactcttggaggaaatgggatatttcctccggccccttgattctgctctcccttttcttttcttttcttttctttctttttttttttgagacggagtttcgctcttgttgcccaggctggaatgcaatggtgcgatctcggctcaccacaacctccgcctcccaggttcaagcaattctcctgcctcagcctcccaaagtagctgggattaaagacatgcgccaccacactggctaattttttggtatttttagcagagatggggtttcactgtgttgg

SEQ ID NO: 7802 - DNA, 380 bp, Homo sapiens
  misc_feature (1)...(380): n = g, a, c or t
ctgggggcggggtggnnagaagtgattcaacagagctacatgctttaaacttgcccaagttctacctccttcctttgaacatttcagattggagaaccaaggagttgattgcctgaacacctgaacatccgtttatgggggccagatagaatttgttttcaaataggcttaacaggcatcattaaaatttcattctgtgtgttttgtttaggcttgaggtgcttagaagatgggataaaatattctacttttttctaaattttaactttgtttcctatgtgatttttttaaatgtcctttctaaaatattctaaaattattgattcacaagtgccatgttcagaactatagaatattactgttacataatgtctgcacag

SEQ ID NO: 7803 - DNA, 546 bp, Homo sapiens
  misc_feature (1)...(546): n = g, a, c or t
ctcaaggtgcactacangtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctangatgtttcacaaactacaaagctg

SEQ ID NO: 7804 - DNA, 509 bp, Homo sapiens
ctggagggaccggagaacactggcgtctggcagccccgtttccactcctaccaagaaggctcaaagacgacggtcagctcaggcttttcttcttgaagtgtttctaacgcactttttgtctcataattgaaatacatttcagacaaccccaggttctgcaggaggcagctctgctgtttcagcacttcacagaacatcatgacccccaggtcgcccaggtcattgttgcccaggctcagctttcgcaggctctggctggaggtcagaagtgtggaaagatcccagcagcagtgtgacgtgaggttgcagttgtctaattccaacacctgaagcttgcagtcggggtgcaagagtccctcacagagtagtttgatccccttgtctccgagagtgttgcctcgcaggtaaaggtgcgtgagattctgattagtgctgagtaccgaggacaaagctgaacaacagactgacgtaaggccagaattcaccaaccccagtttctgcaggttaca

SEQ ID NO: 7805 - DNA, 518 bp, Homo sapiens
  misc_feature (1)...(518): n = g, a, c or t
gaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgnaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgngatttgtaatttaaactaattgtattctgaggtaaccacaaaataaattcaaccaaac

SEQ ID NO: 7806 - DNA, 283 bp, Homo sapiens
ccacaacaactgacgcggcctgcctgaagcccttgctgtagtggtggtcggagattcgtagctggatgccgccatccagagggcagaggtccaggtcctggaaggagcacttcatctgtttagggccatcagcttcaaagaacaagtcatcctcattgccactgtaataagccatcatttcactggcgagctcaggtacttctgccatggctgcttcagacacttgagcaatgaagattggctgaagagaatcccagagcagcctgttgtgccttgtgcctcg

SEQ ID NO: 7807 - DNA, 416 bp, Homo sapiens
  misc_feature (1)...(416): n = g, a, c or t
ccatcggngctgaaattgngcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgncctttgctgatgaggaa

SEQ ID NO: 7808 - DNA, 598 bp, Homo sapiens
  misc_feature (1)...(598): n = g, a, c or t
ctgactctncaccttaaatgttcagagggacctacgtcagaggaccagaaagaaccagtttttctgacttgatcatcttgtaattcagataaaagctttgtaaatacaaaaaaacatgtcctcatgaattgcaagaaggaaaatagacccaaggagaggttcaaatggattaccttggagtgcagactagaaaggggtttatgggaatcacttgagaagtgaaacttgcccgaatagaatatatcctcaaattccgactttttctcttctggtgaaacaggaagaaggcactgtcagtattaaatagtaatttcctgtctgcaacaccacagtcattttttttttcctgatcagagaagtccctgaactacgagccttttggaggtcagtgtgagaagaagattgtttctgagcttgagaagcttctggaggattgaagagtatttgaagtctgtgtcaaacatccatatcataagtggaattttggagatattcaaagaatgctgtcagaagggtatctcagtggacttgagtactggaatgacatccactggagttgngcctcttataatgagcaggtggctggggnaaaaggaag

SEQ ID NO: 7809 - DNA, 450 bp, Homo sapiens
  misc_feature (1)...(450): n = g, a, c or t
ctgggggagacggggaagcaggtgtcggtgaggtctggcgttgttttaagaaaatgtctgcgttgagggtttgcanagaaagtttataaagactatcagtagagctgccaggtttgtgaactggaacggaatcccactccggtggaggagagtctttttcaccctctgagctactggtgttgcctaattcttgactattcgggaggaattttgctagggcaggtggtctgttatccactaacttacttgtaccttttgttttctgggcatttcgtgatttggatccacttgtcattgcagttggaagaggaatcttgcttgggagatttctacgttgcttactttccaaagggggagtatatggtagttctaatgaactgggtttcacatctgttgggatttctttcttaatatttaagagttttttgcttttttgcttcacttgagaca

SEQ ID NO: 7810 - DNA, 297 bp, Homo sapiens
  misc_feature (1)...(297): n = g, a, c or t
ccactgaactgcgctgccngtgcttgcagaccctgcagggaattcacctcaagaacatctaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacag

SEQ ID NO: 7811 - DNA, 506 bp, Homo sapiens
  misc_feature (1)...(506): n = g, a, c or t
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgngtgttttctttttttctttctttccttccatgtagcatctgcataccaaaggacttattctatgaaatactttaaaaattcctcatcagcaaaggacaatttcaataaatacatccaaacatgatcatcgttggagccggaggtggcaggagtcg

SEQ ID NO: 7812 - DNA, 415 bp, Homo sapiens
  misc_feature (1)...(415): n = g, a, c or t
ctggtggatncagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgnggagca

SEQ ID NO: 7813 - DNA, 340 bp, Homo sapiens
  misc_feature (1)...(340): n = g, a, c or t
ctgctgctnncttccttcagatatgacatttcagcctggcctctacagtaccatgaaacctaaattacttacttctctccagcttaatcctaggtggaggaattctagctgtggtttgtgaatgtacacaggtcagagaggtttagcaccttttgggaggaggaggtcagaatgcggtggtgaaacctctcccactgtgaccaacaaaccctcatacttaaaaagaagcatgcacctctggcttaaggatctggatgctactggaatttttgtctgtttcaattgtattcattagctttgaagaggagagagatggtggtggttaacttttttgttgcat

SEQ ID NO: 7814 - DNA, 544 bp, Homo sapiens
  misc_feature (1)...(544): n = g, a, c or t
ccatccagnctcctttgccaactgaggtgcagactgagttgtggaaggtgggtgttgatggaacccagcattacaatattgtgtagaactagtctcctaatatacctcactctgcaacttacggaagctgaggaagatcagaaaaagaccacactcctcactcagaatatttattatattctgccccatggggccttgcaggaaaagggacccaagctatacccctactccttttccaagctactttcctgaaccaagggacaggattctaagagaatcatgtatctcaaataagccagaatgtatctggggaagaatagccattaatttcctagacctgacactgggtttatttgtgtctgccaggaagacggggagtcagtgagaatcgtaaatggactagatgaggggaaataggatgggcccttctttatcacagcttgagctcaaaaaggttgggataaacaggtgtttaaaaaagagaggaggtaaaagggaggatgggcaggggatagaggaaggtcaggggttgggttcacccata

SEQ ID NO: 7815 - DNA, 270 bp, Homo sapiens
  misc_feature (1)...(270): n = g, a, c or t
gtaacttcnatgacaacnnagacctggaatgcgtgaccaatcttcaggaagtggcccgcatcgtgggcaactctggcctcaacatctacaatctctatgccccgtgtgctggaggggtgcccagccattttaggtatganaaggacactgntgtggtccangatttgggnaacatnttcactcgnctgccactcaagcggatgtggcatcaggcactgctgcgctcaggggataaagtgcgcatggaccccccctgcaccaacacaacag

SEQ ID NO: 7816 - DNA, 262 bp, Homo sapiens
  misc_feature (1)...(262): n = g, a, c or t
tgactattttctactgtaggctgctttggaaataattcccatatccttgctttgtaagttggtaatatcactatgcatttctacacattttataaatttgatttatgcagattttgatacactgtatgtttctgtanaaattgnataaatattcaaaattttattaggatnnatttgagnaacttacntatatcttaattctgggttgcttgttttttaggtgacaaaaataaaatattgtattttaattcaaaaaaaaaaa

SEQ ID NO: 7817 - DNA, 551 bp, Homo sapiens
  misc_feature (1)...(551): n = g, a, c or t
tgcttctctgctgctgtaacagggactagcacaggcacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccacgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctnatataacanaaaatgtgtacataaa

SEQ ID NO: 7818 - DNA, 470 bp, Homo sapiens
  misc_feature (1)...(470): n = g, a, c or t
tgaaatannacagcaccnagaaaataatttagttttgcttgcttccattgatcagtcttttacttgaggcattaaatatctaattaaatcgngaaatggcantatantccatgatatntaaggagtnggcaagcttaacanaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgnattacccagctttctttttaatacaaatgttatttatagtttacaatga

SEQ ID NO: 7819 - DNA, 338 bp, Homo sapiens
  misc_feature (1)...(338): n = g, a, c or t
ctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttntttaaagctattaagggagtatatacttgagtacttattgaaatggacagtaataagcaaatgttcttataatgctacctgatttctatgaaatgtgtttgacaagccaaaattctaggatgtanaaatctggaaagtncatttcctgggattcacttctccagggattntttaaagttaattt

SEQ ID NO: 7820 - DNA, 431 bp, Homo sapiens
  misc_feature (1)...(431): n = g, a, c or t
ctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacantaaaaggngntacttt

SEQ ID NO: 7821 - DNA, 566 bp, Homo sapiens
  misc_feature (1)...(566): n = g, a, c or t
agtgacttgacttctttaagccttggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattannaaaaatttaagaagttttaacaaaatgatntaaaaatatattcactataagtaggatg

SEQ ID NO: 7822 - DNA, 569 bp, Homo sapiens
ctgagtctcacaaagatgccgtggaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgacc

SEQ ID NO: 7823 - DNA, 277 bp, Homo sapiens
tgatctctttcagtgcaccgccacttatgttacctttttccttttatttctttgtgtttccagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatgg

SEQ ID NO: 7824 - DNA, 510 bp, Homo sapiens
ccagggtgccacaaacccaaagcaaagtttcaaaataatataaaatttaaaaagttttgtacataagctattcaagatttctccagcactgactgatacaaagcacaattgagatggcacttctagagacagcagcttcaaacccagaaaagggtaatgagatgagtttcacatggctaaatcagtggcaaaaacacagtcttctttctttctttctttcaaggaggcaggaaagcaattaagtggtcacctcaacataagggggacatgatccattctgtaagcagttgtgagggggtagagatgggacaaaattttggtctcagaggtcttaccatcttaatttggtaacttctaatgaaaaaaataaaaaatagaaataacattatccaaagatatcttaaagctgaaaacttgaacagcacattttttgtttttgttgttgtttggctaactcctcctggaatcacctttctggtttagctagtactttgtacagaacaatgaggt

SEQ ID NO: 7825 - DNA, 525 bp, Homo sapiens; identical to SEQ ID NO: 601
  misc_feature (1)...(525): n = g, a, c or t

SEQ ID NO: 7826 - DNA, 380 bp, Homo sapiens
  misc_feature (1)...(380): n = g, a, c or t
tacaagctttttttttttttttttttttttngacagttnatcttttattttctgcaaatttaggaacatatttactcgttttcacattgaatcttaagttnaagctnttcatttggtntttaggcaatatatganaaaaaaatttttttngttcattngtaatttnaacaagttgaacattttaccatgattgaacatgtttttnttacagtntttaacattcccccaaanaatnccctgcaaagngtaaacctttgtcccatactgggatattactgttctgctacaataaatgtcaaacctaancactttgcagttcactactttngggaaaatgttntagggaactgtntcacaggtgaaactgttncccataaagg

SEQ ID NO: 7827 - DNA, 566 bp, Homo sapiens; identical to SEQ ID NO: 433

SEQ ID NO: 7828 - DNA, 440 bp, Homo sapiens
  misc_feature (1)...(440): n = g, a, c or t
ccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcanaatatcttcagagaaagcaaaatctttaatattgcagggagcctagcaatacaaatacacatttctgtggcttgatttcttgaatatgctgagacccaatttggactacatttggcagaaatcatggagtaaacagcaaggctttaaattaaattaatagttacaaggtaggttggctcttangtgaatttagccatgtcaactaatangcttttatatggtatgtaacaaatctgaattatgttatgctgtg

SEQ ID NO: 7829 - DNA, 508 bp, Homo sapiens
ctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgggcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtcca

SEQ ID NO: 7830 - DNA, 126 bp, Homo sapiens
ccaaagtgttaactagttttactacaatgtttggtgtttgtgtggaaattatctgcctggtgtgtgcacacaagtcttacttggaataaatttactggtacaaattcttaaaaaaaaaagaaaaaa

SEQ ID NO: 7831 - DNA, 505 bp, Homo sapiens
  misc_feature (1)...(505): n = g, a, c or t
caggactngantcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgntcttgaaaatacctgcattttttggtatcatgttcaaccaacatcattatgaaattaattanattcccatgg

SEQ ID NO: 7832 - DNA, 491 bp, Homo sapiens
ccagtgaacacgaaatgtgcctgacatccctaataatcaaagaaatacaaattaaaacacaatcataccaattttcatctaacagattggcaaaaatgtaaaggatcatgtgtatattcattgcagtgttgcttgtaatagcatacagcttgagtgacctccagtagaggtgatgtttaaatatattttgctgcattcttaaaaggaaatgtagcataatgcagccatttggagagaatgagataactatatgcactctctttgaaagttttgtgactactatgtgccgggagttgcactgggctttctttaaggtattttcagcaaacctgtcttttaatgatttatattgtacctaataagagatatatgaatggaaaaacagtttttgctctcacatcatgacaatcaacacaaaagacttctgtgaccaaatgtgtggagttttcttccaccaacaagcaagcaatcaattctgcagcggacaccag

SEQ ID NO: 7833 - DNA, 343 bp, Homo sapiens
  misc_feature (1)...(343): n = g, a, c or t
ccacttgngtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccag

SEQ ID NO: 7834 - DNA, 550 bp, Homo sapiens
  misc_feature (1)...(550): n = g, a, c or t
ctgtagaagtaggggtttggcttctggcccagatccacgcccttgtcctctgtcaaaaagagaggtggcagctcagcaccattctgttgggatcaggtaactcaggaaaggggctagatgctgtgggcctagagtaagtctccataaaggctggggaagcacacacctgtcatcacctggaaggcagccacactgacgtaatcctctgccactttctggaagagctcgtctggcaggaaaaatgatgatcagcgagggcccaatgccagtagccctgggatctcccagtgacccagccctctgtgccctattcagcttcctctggtgcccctgcatgttcctgctgtgaggctccagcacagcactcacccacactctggcctgtcttgctggatgtttcaaagagctgagctttgatatctgtaaagagaagtgactaaagcctcatacctgagaattagataaacagacaaaagggagggctagcagttcagggagtctcctggaccccacagttcaaggaggccaggaagacctcctanagcacctt

SEQ ID NO: 7835 - DNA, 314 bp, Homo sapiens
  misc_feature (1)...(314): n = g, a, c or t
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagnanttcgctttgactngtgaagtcttagcatgtactgntcggaggttgggt

SEQ ID NO: 7836 - DNA, 539 bp, Homo sapiens
cctgactattctcaattctccccactgcagtgttcacgcaacttccctgaatatagggtctccttaaacacatctgagcactgacctggatgagtgcacttgggagacctggtgacaggcacaaaaagcatgatcagggctagcctcaatacagggagaaatcatggatatttaaaaatacttttttgattcagattccggtatgactgaagagcaacaccatgttgagaactggaggaagacagggttctggtgccagaagctcttctccaatctttaaagccaggcttgctcaccaaggtgctcagtaatgtctctcacccctgcccatatatagcattaaaaagtgaacaaaagacagataaagatagaattcaaaaaggaaaaaaagtaaggaagcagagggacagaaacttagaagagaaaaccaaggtcaacagtcaaaaaggatggtgggaaagaatgtttagatttcaaaatttaaaagccccgagctaggaagaacctgaaaactgagtactcctcagtgaaaggccatc

SEQ ID NO: 7837 - DNA, 397 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgccgcctctacctataaatcttcccactattttgctacatagacgggtgtgctcttttagctgttcttaggtagctcgtctggtttcgggggtcttagctttggctctccttgcaaagttatttctagttaattcattatgcggaaggtataggggttagtccttgctatattatgcttggttataatttttcatctttcccttgcggtactata

SEQ ID NO: 7838 - DNA, 428 bp, Homo sapiens
cctgtccatacactaaagaacatctcattgactgtgacaatgggcgagatgaatgatgggttataaatatttctctcttccttaatagctaacaatcttctccaaggactgtggactcctgttccctgctcatcatgtcatgggcatctgccaggaaccatctttgatggtgtaaaaatcttgaatacataagagggaaattttagacttgttagaaagaagccaagcaattgagaccttagatagaacttagaattctcaccgagttttgttgggtaattgttacttcaaaaaaaaatgcaatttctgttccctctttcctccaaccatttatctgggaagcaagttattggcaacccagagctgattgttggagccggggaaaatggtgtgaaatgtgagaaaatgtaattgagataataaaaaca

SEQ ID NO: 7839 - DNA, 447 bp, Homo sapiens
tttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggtaaaaa

SEQ ID NO: 7840 - DNA, 322 bp, Homo sapiens
  misc_feature (1)...(322): n = g, a, c or t
ctgatgaangcatntgatgccttcatctgttcagtcatctccaaaaacagtaaaaataaccactttttgttgggcaatatgaaatttttaaaggagtanaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcg

SEQ ID NO: 7841 - DNA, 423 bp, Homo sapiens; identical to SEQ ID NO: 275

SEQ ID NO: 7842 - DNA, 530 bp, Homo sapiens
  misc_feature (1)...(530): n = g, a, c or t
atattttatgcatgggtgcatgcacacacacacacatttataagaaaagaattataaaaaataccaacataataattttctctaggaggtgggaataacagtgagttttctttccttttattttttaaaatctatatttttatggttaaaaaaatgtgataaggtaaataccaagtatatacatttgaatttcatgacatactttttaaatttatgcttgatactttcagaccatcagacctttattacaccttgttttaatgcttattttctctttgtttcattcccgtgaaaaatgaaaagtctttgtcattttctctctgaatctgtatctttgtctcccttttttcctcccgctctcctactttctcacactagacgtttcataggaattaaaagtattaaagggtggtcaattcttatttgcctttggaaacccagaatgtgcacagtatttagtaaactttcatctattatgtaaattcttaatgctttgaagaagcacaaatggactgnatttacctccattg

SEQ ID NO: 7843 - DNA, 478 bp, Homo sapiens
ctgttgtgttggtgcagggggggtccatgcgcactttatcccctgagcgcagcagtgcctgatgccacatccgcttgagtggcaggcgagtgaagatgttgcccaaatcctggaccacaacagtgtccttctcatacctaaaatggctgggcacccctccagcacacggggcatagagattgtagatgttgaggccagagttgcccacgatgcgggccacttcctgaagattggtcacgcattccaggtctttgttgtcatagaagttacacttgttttgagagcagcagtgggtctggagagaagaccaaagcctgttccccagaaggccatggtagtaggcaaagtagaccagggagttgtcattctgctcataggaggagagtccattgcccacagccagcccctgaaggttcatgctgggatcctgcatgaccagcacggccagggtggggatgtagatgccagcatagctctc

SEQ ID NO: 7844 - DNA, 559 bp, Homo sapiens
ccaagaacctcttccaccgggccatttctgagagtggcgtggccctcacttctgttctggtgaagaaaggtgatgtcaagcccttggctgagcaaatttctatcactgctgggtgcaaaaccaccacctctgttgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagc

SEQ ID NO: 7845 - DNA, 422 bp, Homo sapiens
  misc_feature (1)...(422): n = g, a, c or t
attttaatgnccctgtgtactaaatgactactcatcgagtatgcanaatttnacagaggaaatanaatgctgatatacatatgaaagaaaatatcctcagcatggtgatttattgtcttgtataataatagtagaacattttagaactagtacttttatgattgtattttnttcctgttcacattccaaacttttctgtnttattttcattctatatgtgatcttganncagctnattcctttctgcaactgatttaatctcatnttgacaaatntgacctagaagngttttgagtaatattaaatnttaancacatacatattattaatgaaccatctgtgatttatcttataagaggaaaacntgacaatcattaaaatgtttaccaaanaaaatatngctgangtgctaggtcaaaata

SEQ ID NO: 7846 - DNA, 467 bp, Homo sapiens
  misc_feature (1)...(467): n = g, a, c or t
ctgcccctggctaggtagttaaaactgtgtatgccttcccttgtacaatgtgggactttggtggaactgcctgggagaacttcataattactaccctgtatgtcatgccccttgcaggtaaaacagaagtggcagagcagaggtcaaaggcacagatcagcaaagggaatcctactggatcctgagactagcctggaaggggtgtcatttgtcactgggaatagaggtgcacggcctggtggaccctccgagagagcttaagattcatttttaaaacagaggatttaaaagacacaataggcattggaatcgggtagtaagaagagaaaaccagagccccaagtgaggaagtgggtgatctgtcctcacacagttggtgggggagctgggcctncccactgactggactctcaggtccttaagaggtgctctgtcctgcacaccccaaatgaccacctaaattcagg

SEQ ID NO: 7847 - DNA, 473 bp, Homo sapiens
ccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtca

SEQ ID NO: 7848 - DNA, 499 bp, Homo sapiens
  misc_feature (1)...(499): n = g, a, c or t
ggcgaatcttgcgccggtttagacaaaggaggccgtgaggacctgcatgcttttctttctcaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctanaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttgga

SEQ ID NO: 7849 - DNA, 513 bp, Homo sapiens
  misc_feature (1)...(513): n = g, a, c or t
ctgtggaggnaaaaacatacccctggttcagttccttatttggtgcaggccatgcagtgtagatgtataaagagaaagctgatgcttggatattaactgccttgatgctacacacctagaatgtcttttacttacttccaggttcatccgtccctcttttccagggaacacgcctaaaaaaaagggcaactgtgcagagtacaatataaatccccaaataacccangtttccaattttgtttccattccctagtatcatcatctgtttctttaccccagtgtgaaaaagctgattaatttaatgagaccacaataacaaactgtatttatcaggtcacatccaaatcattccattctagaaataaaatttcttttaaacgaactactttaaatgttttactgattaatgagactactgataaaactttgctttttttgtaatctaaaaatacactgcaacaaactaaaaagaacacggaggatgttagtattccatgtgttttttaacacata

SEQ ID NO: 7850 - DNA, 616 bp, Homo sapiens
  misc_feature (1)...(616): n = g, a, c or t
aaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattangtctgaattcaagagaaagtacggcaagtccntgtactattatatccagcaagacactaagggcgactac

SEQ ID NO: 7851 - DNA, 210 bp, Homo sapiens
  misc_feature (1)...(210): n = g, a, c or t
ctgacggcggcnacatgactctgaaccccagggcacctactgacgatgataaaaacatctacctgactcttcctcccaacgaccatgtcaacagtaataactaaagagtaacgttatgccatgtggtcacactctcagcttgctgagtggatgacaaaaagaggggaattgttaaaggaaaatttaaatggagactggaaaaattcctga

SEQ ID NO: 7852 - DNA, 485 bp, Homo sapiens
  misc_feature (1)...(485): n = g, a, c or t
cctgcttacaagctgccaactgtaaaaattgtggtagactatctcaagtaagtttccattctcatgaccacattaccaatgtaagtggcacaaaacagattattaatcaattaattaagcaaattgtgcatcactggcttatctttacttccaaaggcttatctttacttctaaagaaaaataagacagtgaagtcctccagttgccaaataaaatgcaaccaaattgtcagcagaatttcagaatcattatgattctaatagccatgttttattgaatgcttaagaatgtgctaaacattgttctaattgctttatgtgcattgtagcatatcatcctcaacaaacagaaaacaacaaaaatgttatttagatttttaaaaatatgcaaatgtctctaataaagttacgtaactgtagttacccaaattactttgaaaaaaatggactgctttggcaggtaattattctttgcaangacacata

SEQ ID NO: 7853 - DNA, 532 bp, Homo sapiens
  misc_feature (1)...(532): n = g, a, c or t
ccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgngctcccaaaacattttaaatgaaagt

SEQ ID NO: 7854 - DNA, 558 bp, Homo sapiens
ccaagtattattttgaaaaagtacttaggtcacttaaaatgtgaataatccaaccacaatgattaaaattcatcagctacccattactttataccttggaatagggtttcttgactttagtactactgacacactgttatgacaaccacaagtatctccagacactttccaatgtcccctttgggggcaaaatcatgccagttgagaaccactgcccaagaacaatgtctgcactttggcctatctttaaagtctttattttttcatgtttataattctagaatatccaactttcatttaacatcagtttaaatactttacatgttactacacaatgactgttttaatgcccacctatggagatgcattacagtattataaaaccacaattttcccatggctactagaaatctatattatttacaatatagctgttagaaaacatttgaaattacttccttaagacacatctatcaaattaaaaactcatgcactgggtcacttgactattttaatgattcaatcataattctaatacagagtgtcttccaaaatagc

SEQ ID NO: 7855 - DNA, 273 bp, Homo sapiens
ggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtgg

SEQ ID NO: 7856 - DNA, 510 bp, Homo sapiens; identical to SEQ ID NO: 603
  misc_feature (1)...(510): n = g, a, c or t

SEQ ID NO: 7857 - DNA, 491 bp, Homo sapiens
  misc_feature (1)...(491): n = g, a, c or t
cctactatgggtgttaaattttttactctctctacaaggttttttcctagtgtccaaagagctgttcctctttggactaacagttaaatttacaaggggatttanagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtatangggttagtccttgctatattatgcttggttataatttttcatctttcccttgcggnactatatctattgcgccaggtttcaatttctatcgcctatactttatttgggtaaatggtttggctaannttgtctggtaataangtggagtgggtttgg

SEQ ID NO: 7858 - DNA, 297 bp, Homo sapiens
ccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacag

SEQ ID NO: 7859 - DNA, 433 bp, Homo sapiens; identical to SEQ ID NO: 276
  misc_feature (1)...(433): n = g, a, c or t

SEQ ID NO: 7860 - DNA, 529 bp, Homo sapiens
  misc_feature (1)...(529): n = g, a, c or t
cctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataanatggtctctatacaaataacactgaataacact

SEQ ID NO: 7861 - DNA, 396 bp, Homo sapiens
ccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcag

SEQ ID NO: 7862 - DNA, 565 bp, Homo sapiens
  misc_feature (1)...(565): n = g, a, c or t
ttttttttaaatggttctttattcataaacttgatgcaagtttacaaaatttactgtacattgccaaataaatctgcaattaaaaataaaatccattaaacaaagcatgccaaatgtgcagctatcagtctgcttgccatcaggatattaaagaattcaacaatgtattcaagatttanccttaggcttaaggaactttactgatttaaagaattctgccttgtcacttgttatctgagcaactggcaatcagaactttatacaaatgtaatcaagtgaacaagaataccagaaaatctatttactgctctcttaaccaaaatggaatcaaaagaaattaaacacacacaatgtagaaatgacaagtctctcanatgtggtttacaaagttaaaaactgaatctcaaagctaatgcacaagaaacacttttgaactttgtaacttgtttgngcagaaaaatgtgcttctggatttcttgttaaaagtgcttaagaactagaatttacttttaaatcaaacgtgggtgtataaaaaaatctattaccaaccaaaaaggactgattc

SEQ ID NO: 7863 - DNA, 477 bp, Homo sapiens
  misc_feature (1)...(477): n = g, a, c or t
gtacaagcttttttttttttttttttttttttttgggnattnaaagttgtattttatttttaactatccaatatnttaaactttgattacatcaaatgaaatanattgngcncactcactntaananagctntgatatatgcanaancaaaggngcagggatcatgcaatagtttcgtaccanatttcaanataccaagtancaaggaaacacaatggaattgaaggctgaggngaagtacaggcntaaggcanggaaagcanaacattcaanatgtncctatatncnccagttnttaaaacncncaaatcatttccaataaggcactggctcatgtatttctgttgaggcanaantcaatcttaggatgnggtctgtacatatctgcanataanattcacaaaagctgaattcagngttattagtccttcattcanangcttcatttttgcattttcaattgctttcctgngatat

SEQ ID NO: 7864 - DNA, 498 bp, Homo sapiens
ctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagtt

SEQ ID NO: 7865 - DNA, 198 bp, Homo sapiens
ctgaggtggtcttgcttgtcatcgtcggtgaagaaggacttgttgtggtacgtgcctcgggccagcatgcccttgggagcctcctcaactggagtgaggaactcatactcctcaggccgaggtccatagctgccaaccataaatgttgctttatccactttcaccccagtcctgtaggtgtgctgaacgtatttcagg

SEQ ID NO: 7866 - DNA, 547 bp, Homo sapiens
  misc_feature (1)...(547): n = g, a, c or t
tgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgnggcccggaaccacagagatgctggnagcacccacctacatgtatgagtttcagtaccgtccaagcttc

SEQ ID NO: 7867 - DNA, 507 bp, Homo sapiens
  misc_feature (1)...(507): n = g, a, c or t
gttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcangtgtcatttatctatgaccaataggaagagcaaccagttactatgagtgaaagngagccagaagactgattggagggccctatcttgtgagtggggcatctgttggactttccacctggtcatatactctgcag

SEQ ID NO: 7868 - DNA, 478 bp, Homo sapiens; identical to SEQ ID NO: 277

SEQ ID NO: 7869 - DNA, 258 bp, Homo sapiens
cagaaacatccaattctcaaactgaagctcgcactctcgcccccagcatgaaagtctctgccgcccttctgtgcctgctgctcatagcagccaccttcattccccaagggctcgctcagccagatgcaatcaatgccccagtcacctgctgctataacttcaccaataggaagatctcagtgcagaggctcgcgagctatagaagaatcaccagcagcaagtgtcccaaagaagctgtgatcttcaagaccattgtgg

SEQ ID NO: 7870 - DNA, 567 bp, Homo sapiens
ccaagaacctcttccaccgggccatttctgagagtggcgtggccctcacttctgttctggtgaagaaaggtgatgtcaagcccttggctgagcaaatttctatcactgctgggtgcaaaaccaccacctctgttgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtga

SEQ ID NO: 7871 - DNA, 526 bp, Homo sapiens
ccacactctacttctgcttctgccacctatggggtcgaggcaggtgtgatgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccatgccttaacggaggcacctgttatcctactgaaacttcctacgtatgcacctgtgtgccaggatacagcggagaccaatgtgaacttggtaagatggtacttggctgaaaaggtgcagttctttcacagaagatatattgggggagaatttatgttg

SEQ ID NO: 7872 - DNA, 410 bp, Homo sapiens
  misc_feature (1)...(410): n = g, a, c or t
cctgtttgattgnanctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatngcgagtgttaccatgatgacgaggcccangatgagccccaaaatcaggggcaaggnttcttncanttgctnccgctcatccactgggcatttatgctcttcactgaagacaaaatctgagataatgtcaaaaggttgnatgtggaccgcncacaggatcatggtgaccgtcttctgcggatcactagaggccagtgaaatggtttgnntnagc

SEQ ID NO: 7873 - DNA, 478 bp, Homo sapiens
ccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatggacaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaagg

SEQ ID NO: 7874 - DNA, 519 bp, Homo sapiens
  misc_feature (1)...(519): n = g, a, c or t
ccttattctttagttctctactttacagtttcccattgtcctttgaagaacacatttgggcttgctctcagactcgccaacataaatcatcatttacatatcagggcatgtgtgagttccagcagttcactgaaataaaatccctgagccttaaccctcccatctcaaatacagtgaaaatttattttaatgataatgatggtaattttttatttgacactttttataatgctgatgttaaagtcaagaagcatttctctgtaatggaaaaaatgtctcatttttcttcctactgggcggtcagaagttggattttagaaaaaatatattgaatagggattataccgccttccttccttaaacctcataaagcaatggagtaggtggataagaagaaatagaaccaatttctggaaacaactttggagtaatgatcatagaagttacagatatccaagaatgcctaaagaaatatatctgnccttccatacccacgacacacaaataggatttatagtt

SEQ ID NO: 7875 - DNA, 474 bp, Homo sapiens
  misc_feature (1)...(474): n = g, a, c or t
ctgtattanagggaatacacattttaattgctctttttgaaaatatcaccaggcagttcagaatgtctcatttattgagaatattgtgacaatcaaagaccttaatatcagccagatgctaacaattgggaatagggcagaatttaataatggaatgtatgggattctcatttttactcaatcttgaatcatctgagaatgttttctattcaagccagtatttttagataaacacagatatagatatcgctactttgaaaaaaatcacttattttaaactcagaatttcttagtactaaatgctaaccaatacacattttatacataatatgtacagactttgttaccaagcgccncacaannaggacaaacatattagttaccttggttttcaaaggttgtcaactctgcatattgtgtggcaaggagatactatcaacatttttttttgcataatgtgcaagtattatatgg

SEQ ID NO: 7876 - DNA, 384 bp, Homo sapiens
cctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaacactgaaaatatataagctcagattatttaaatgggaatatttataaatgagcaaatatcatactgttcaatggttctgaaataaacttcactgaaaaaaaaaaaaaaaa

SEQ ID NO: 7877 - DNA, 564 bp, Homo sapiens
ctcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgcctttcagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccaca

SEQ ID NO: 7878 - DNA, 424 bp, Homo sapiens
gattttgataagcatcatcatatttagtgttatcagcaaagacacaagctcaaaagtgacatcttttccatgaatccaggaaagaagaaaaatccactcagttcagataaatcctagcaattcccaaagggaaaggcattggatatgtgtttgatgagaaagaaaatgaaaaaggggtggggtggtagtactcttctacctgcttctcaaaaccagaacattgctcggtcagattaaacccagtgaaaaacacttacaataaccagtatacagcatgttttcccacagcttatttggaaaaaaagacaggtaacagtcaaagttagagaagctgtaagcaatggacaggcttgatattaagtgtgcaggatctgggctaaatgccttaaaatgtgcaattcaactttccacttctgaatgtgga

SEQ ID NO: 7879 - DNA, 479 bp, Homo sapiens
  misc_feature (1)...(479): n = g, a, c or t
ccaccaacagtttcccagccacatgctgggccctctangtctctccagcccactctaaggacccaagaaatgcagccacagtccatctctcttttttctctccttccgggggaccaaggtaccttctggggcatacaacatggcagcagggcctcgggaagaggggtaggaggaccgagcagcattctctgtagaggaagacaggaaaggagaccctcttggcacacatttatggagggttgtccctgaagagaagggcaggtgggagaggttccctgttacttaagagaaggcaccagtggcaaagagcacaatgaagaggatgatgatnaaaacaatcacgcagataaggacaatcatcttcacgttcttccaccagaattttnngagccaccttctgcgatgtcgtcttgaagtgctcagatgtggcttccagatcctctgtcttgttgcggagatgttccaagttttccccccgg

SEQ ID NO: 7880 - DNA, 490 bp, Homo sapiens
ctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagaga

SEQ ID NO: 7881 - DNA, 309 bp, Homo sapiens
  misc_feature (1)...(309): n = g, a, c or t
cctgtttgantgtngctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgacnaggcccaagatgagccccaaaatcaggggcaaggtttcttccagttgctcccgctcatccactgggcatttatgctcttcactnaagncaa

SEQ ID NO: 7882 - DNA, 498 bp, Homo sapiens
tccggataggccgagaaagtgttgtgggaagaaagttagatttacgccgatgaatatgatagtgaaatggattttggcgtaggtttggtctagggtgtagcctgagaataggggaaatcagtgaatgaagcctcctatgatggcaaatacagctcctattgataggacatagtggaagtgggctacaacgtagtacgtgtcgtgtagtacgatgtctagtgatgagtttgctaatacaatgccagtcaggccacctacggtgaaaagaaagatgaatcctagggctcagagcactgcagcagatcatttcatattgcttccgtggagtgtggcgagtcagctaaatactttgacgccggtggggatagcgatgattatggtagcggaggtgaaatatgctcgtgtgtctacgtctattcctactgtaaatatatggtgtgctcacacgataaaccctaggaagccaattgatatcatagctcagaccatacctatgta

SEQ ID NO: 7883 - DNA, 556 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgatatatcatgagtgattccaactatgttgtcaggggcaatgcccgtctgcctgtaa

SEQ ID NO: 7884 - DNA, 289 bp, Homo sapiens
  misc_feature (1)...(289): n = g, a, c or t
ctgggaggnaaanggtgactgtatttccaaagaagctcttttgattcagaactccaggagaccctgacatgaaaaccttaaagcaaatgactgtcacatgcttcaaggagtttatgtcaagacagttctacttatgtaaagtaagattataaaatgaaagagagtgtataaagaaaatcctaaggaatccactaaaaaacaactagaacgaagaggcaagttcagcaaggttgcaagatacaagacctatatataaaaatcaattgcatttctgtacactngtaataaa

SEQ ID NO: 7885 - DNA, 458 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccattgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacg

SEQ ID NO: 7886 - DNA, 381 bp, Homo sapiens
  misc_feature (1)...(381): n = g, a, c or t
gggattacaggtgcatgccatcacgcctggctaattttttgtatttttagacgagacagggtttcaccctgttggccaggctggtctcaaactcctaacctcaggtgatccaactgcctcggcctcccaaagtgctgggattacaggtatgagccaccgtgcccagcagaattttttaactatttggttacgactaatttggataatgtagtgcatgcagctttgatttgtgccactaagagtgggcaaactgtcttcctttttgtgaatcagtaaaaattttccctcaacatgtgtttgacagttgtcattcactgctaagttaangcatttggtaaaccacacagcctctgcatccttcctagcgacagccacaagaaa

SEQ ID NO: 7887 - DNA, 581 bp, Homo sapiens
  misc_feature (1)...(581): n = g, a, c or t
ccatttaaaacaaagaaaaatactaaagccactagtaaacatctgatgtgcaaaatacaacatcctctagttggctttatgccattattacataagctccaaatagctcatcttaaattaaaaagaaaaagtggctgtcccatctctgctgcataaatcagatttttttttaaaggtttagagtactttaaggaagggaagttcaaaactgccagtgaaattcacagagaatacaaatttagcaatttaatttcccaaagctctttgaagaagcaagagagtctctcttcttaatgcagtgttctcccaagaggaactgtaattttgcttggtacttatgctgggagatatgcaaaatgtgtttttcaatgtttgctagaatataatgtttcctcttcagtgtctgtttcatcctggaactcatggcttaggagggacttcttggagccggtagacatcatgcgaatttcatcttcatactcatcatgatgctgcctgagccgatgaaagccatccttgngtctattagacttgattgagcagnatgcaccnaaataatgcaagctgttaggatcaatgcc

SEQ ID NO: 7888 - DNA, 357 bp, Homo sapiens
  misc_feature (1)...(357): n = g, a, c or t
ccttattttttgaacaattgagcaaaagaaacagatgaaacctcatacaaaaccctccaaaatatgaaaatgtggggtttatttgtgctaatgctcttcttttggaaacatttgtgttaaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgnntgaaacttacc

SEQ ID NO: 7889 - DNA, 178 bp, Homo sapiens
  misc_feature (1)...(178): n = g, a, c or t
aattcattttatagaaagatttaaagtttttttctggaagtgatatatgtcaaattacatttcctactgnngnatttgagcangganngtcattttttaaatgtttttggccgggcgtggnggntcatgcctgtaatctcagnacattgggaggccnaggcaggnggatcacctgagg

SEQ ID NO: 7890 - DNA, 146 bp, Homo sapiens
ctgtccttccctttcagctttccaaacatgagcacagaaggtgtctagtctgggtgaccaaagtcctcaaacggcagccggtcaacacatcgtcttcctcgttaaccatgtcatcaggtggttccacacagcacagacatggctga

SEQ ID NO: 7891 - DNA, 454 bp, Homo sapiens
  misc_feature (1)...(454): n = g, a, c or t
acgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttnctacgtatgcacctgtgtgccaggatacagcggagaccagtgtgaacttgattttgatgaatgtcactctaatncctgtcgtaatggagccacttgtgttgatggttttaacacattcaggtgcctctgcc

SEQ ID NO: 7892 - DNA, 578 bp, Homo sapiens
  misc_feature (1)...(578): n = g, a, c or t
ctgagggacctgactgttagaaggaaaactaacaaacagaaaggagtagcatcaacatcaacaaaaaggacatccacaacaaaacctcatctgtaggtcaccaacatcagagaccaaaggtagataaaaccacaaaggtggggagaaaccagagcagaaaagctgaaaattctaaaaactggagcacttcttctcctccaaaggattgcagctccttgccagcaacggaacaaagctggatggagaatgactttgacgagctgacagaagtaggcttcagaaggtcggcaataacaaacttttctgagctaaaggcagatgttcaaacccatcgcaaggaagctaaaaaccttgaaaaaagattagacgaatggctaactagaataaacagcgtagagaagaccttaaatgatctgatggagctgaaaaccatggcatgagaactacgtgacacatgcacaagcttcaatagccgattcgatcaagtggaagaaagggtatcagtgattgaagatcaaattaatgaaataaagtaagagagaagnttagagaaaaaagtnaaaagaaacaaacaaagc

SEQ ID NO: 7893 - DNA, 462 bp, Homo sapiens
  misc_feature (1)...(462): n = g, a, c or t
cgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagccattcaacaagggaggcttgtggatcanaatctgaacaaaattgggaaagatgaaatgcttcaaatgattanacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttata

SEQ ID NO: 7894 - DNA, 545 bp, Homo sapiens
  misc_feature (1)...(545): n = g, a, c or t
ccatagtaaataatgattatttatttgcaaagagaagacagagataacaatagcaataataataatgtatttcaaacaattaagagtaaatttcaaatgcctcaccacaaaatataagtaagcaaagtaaggcgatagtatgttaattagtatgatttaatcatactacattacacacatatatataaacattacgttgtaccctatgtgtacaattatgatttctgaattaatattagagtggggagaacaataatgattaatttttacttcttcagtaagattacaatgaaaatgtagagagcactagcattatagtaactatacgataggccactttaaataaatggcatcttttacaaaatttttagtcaataagttgattacgacatacttacgaactatttgctattaagtgtaagttaatttataattttagtattttcaaaaaangaacatattaaaatcctatcantatttcnaataatgacaaaattaatcatttttaatagaatccttactcaggtcctccaaaaacaatataa

SEQ ID NO: 7895 - DNA, 243 bp, Homo sapiens
cctctttttaccagctccgaggtgattttcatattgaattgcaaattcgaagaagcagcttcaaacctgccggggcttctcccgccttttttcccggcggcgggagaagtagattgaagccagttgattagggtgcttagctgttaactaagtgtttgtgggtttaagtcccattggtctagtaagggcttagcttaattaaagtggctgatttgcgttcagttgatgcagagtggggttttg

SEQ ID NO: 7896 - DNA, 341 bp, Homo sapiens
agatgtgcaaggatgtctgtgaagccatggaatacctggagtcaaagcagttccttcaccgagacctggtgggaccttagaaggattggcctaggacaaagggctgatggggtggaagtagcagtggaagatatatcatacatggttgaggggggctgctggtgccatcatttcaattttatctagaaagtactataagttaggcgtgcctctgccccagtgctgagcccatcaaatatctccagcctcagctccatgaagtctgccgtggtgggaatcagagcagtcactcactcccaaccccctaccacccacaagaaaatggtggggtctttcagtgg

SEQ ID NO: 7897 - DNA, 475 bp, Homo sapiens
  misc_feature (1)...(475): n = g, a, c or t
gttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattnagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgt

SEQ ID NO: 7898 - DNA, 250 bp, Homo sapiens
ccatcacaagaaaatgtaaggctgatgatgggcttatttgatttgggaaatgtaatttctctcacaggctttaagtcccatgtgctccataaccttacaattccattttctaatcccccagcgattacattgatagatactccctcaggctggttggagaaagccacggaacagatgatctccctgcagtggacatgtccaacgagatccccgttcaccgtccagagtctgaggtcactgcctccgccag

SEQ ID NO: 7899 - DNA, 470 bp, Homo sapiens
  misc_feature (1)...(470): n = g, a, c or t
ccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatganatactgnccaccacccccatctcagaacagaagggtgggaagccaganccgcctgccatgccccanccagtccccacagcataacagggtctnctt

SEQ ID NO: 7900 - DNA, 368 bp, Homo sapiens
  misc_feature (1)...(368): n = g, a, c or t
ccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgnnaatgggatcctgatggaactaaggactccaatgtcgaactcttctttgctgcattcctttttcttcacttacaagaaagg

SEQ ID NO: 7901 - DNA, 363 bp, Homo sapiens
  misc_feature (1)...(363): n = g, a, c or t
ccatcacancttctcaagtcagntaagtnagacagaactgcagaggtagaagtagaagggaactcagattcttnctcagctagggtagaatccttggaacagtggaggtctttaaattctttacaatcgtcatatctaccattgttggactgttcttctgcatgctgtgacctgatatttgacatgtcttctgaaaacgaagatggaacttccattcggtattctttaacagaactattttcaggggaaggaagatcttgctcagttcctggatcaataattgaggagtctctggtctcattgtcagaagtgctcgttggggtcaggacctccctggtttctgttttcatgtcactgatgcag

SEQ ID NO: 7902 - DNA, 450 bp, Homo sapiens
  misc_feature (1)...(450): n = g, a, c or t
ctgccatctgggcatttgcaatgtccatgcatactcttgaagcagcattcaattctgttcccccttttcaatgtatggttcatggggtttggtatcttgataggactaaggaaggggaagctgtcataaaccaggaagggaaatatttaattggaaagaacaaggctgttcattcaaattgcatttcctacagatttatccaataatggacaagtcaagccgcacacgtcttgctctcattatctgcaatgaagaatttgacagtattcctagaagaactggagctgangttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctca

SEQ ID NO: 7903 - DNA, 481 bp, Homo sapiens
  misc_feature (1)...(481): n = g, a, c or t
tntcaaggaagagaaagtaaagggtctccaaagaancngctggntgtncntctgtcgagaacgtccagcgtggagcggggcaaggagagggaggaggcttggagctttgacggggcattgnanaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaanaaagacaggagatccggcagcagatcgagatgaagctttccaaacggntgagccaaagacctgccgtggaagagctggagagaagaaatatcttgaaacaaaggnatgatcagacagagcagg

SEQ ID NO: 7904 - DNA, 532 bp, Homo sapiens
  misc_feature (1)...(532): n = g, a, c or t
cctagcccaactctccagaaaccaggggtagcctgctgagctctgaaatgccagaagtttaagaaaagagggaagggggcaagaggtggtggtggtagtggtactttgctatttaaaggtagaagaatgcaaggaagtaaaactttttttctccatttgttgtttggcgaccccattggagaattccaggaggcatgcaggatgacatcatgttttacaactgagaaatctcagtaattctgtaaaatggagtccctgcctgctccatgttcctgatggaagctgctttatatttatgtgcttaaagctgtattttatgtcacatttaaatgagggtttaataatcttaattatctaccaaaagtagattacgacgcatgaagatcacataaaatgaacttcacttctcagcatcacaaacatttggaatacaaaaagtccagggatggatattanaagtaagaaaagtncaaaagaggtttgcttagaaataacanaaaattaaaaaaaaaaaacggatcccccctccccc

SEQ ID NO: 7905 - DNA, 346 bp, Homo sapiens
cctggattagaagtgcgtaaacctctgtccatcttccttggccctgtggagctgcctgggaacattccatgattaactctcgtggcgtcctgggacgaccaggtgagcgataccatgtggcacctgggaacctgacgtacctttagatttccgaccatctccctgctgtggtgtctgaggaactgtgcctgggctcaagggctgaacttttgaatacagagtaagaagttttagaaagataaactcctggggaaatgggatcttttaaatccatgtaatttttaaagcagtttttttgcgggggggggcggtggtttgagataggttcttgccctgtggcccaagc

SEQ ID NO: 7906 - DNA, 198 bp, Homo sapiens
  misc_feature (1)...(198): n = g, a, c or t
gacaaattgaaccatatgtaagtaatcttttattttttattttttttttgagacagagtctcactctgtcacccaggctggagtgcagtggcgcgatcttggctctctgcaacctctgcctcccaggttcaagcctcctgagtaactgggactacaggcgtgcaccactacgcccaactaatttttttttttttttna

SEQ ID NO: 7907 - DNA, 394 bp, Homo sapiens
  misc_feature (1)...(394): n = g, a, c or t
ggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagttgaatattacggcagctaaggaaattgaagttggtggtggtcggaaagctatcataatctttgttcccgttcctcaactgaaatctttccanaaaatccaagtccggctagtacgcnaattggagaaaaagttcagtgggaagcatgtcgtctttatcgctcagaggagaattctgcctaagccaactcgaaaaagccgtacaaaaaataagcnaaagcgtcccaggagccgtactctgacag

SEQ ID NO: 7908 - DNA, 486 bp, Homo sapiens
  misc_feature (1)...(486): n = g, a, c or t
gtctggtatagattcagttactaatgcagtagctaagaaaaaatgtgacttttcagtagcttcagggagagttgngnaagattccaagccatttgcatctggatctggagtagacatgttaactaaagaagtgtcttcctccttcatttctttatcatcactgtaagttttctttgttgttagtacagaataatctgtggttttgagttcagtttcagtaaatgtctgtgaatcaaagattgtttgttctgttgcaggagagttttgaggggattcaaatgacttttcttcttgaatttgttcctctgatgttgtttcactttcaatttcttgtcttacagggttgacttcttgcctagaccataatttggctggctctatantttggggaaagtttgttgaaactgtgccactgacctttacttcctccttctctactggagctttngtaccttccacttctgctgntggtaaaatggtggatct

SEQ ID NO: 7909 - DNA, 550 bp, Homo sapiens; identical to SEQ ID NO: 607
  misc_feature (1)...(550): n = g, a, c or t

SEQ ID NO: 7910 - DNA, 466 bp, Homo sapiens
  misc_feature (1)...(466): n = g, a, c or t
ccaggaactgctttcccataggagggccaagtttgcaaaagcggggctntttncttgggcccctccatntctgggaggacagcttctttnctgcgtgatccctgcccctgccttgatagcagctnctggctggcaggagaccatccttcactggaaacccaaagcgcccataaaagacttcctttttcacattgccaaaacttaattttataattgtctgacttacaccactgggcacatctgctaagcttgtgtgccttctagacatataaaaggctactgtgataccattaaatatcagcagtgtgctttgctgtgctttgagtttataagggtgaaaggtgattgtgcaggaaaatgggacagtatatttgctgtgagacaggcaccaagacttcactcccatactcagttataattcatgacagtactggtgggaagcccttatccctctgtggagttaatg

SEQ ID NO: 7911 - DNA, 308 bp, Homo sapiens
  misc_feature (1)...(308): n = g, a, c or t
aatgccctcngtnacacagaggctgngagatcctgacataaatncttgtttgncggaatctgatgcttccaccagatgtctggatgaaaataactatgacagggaaaggtgttccacttacttcttgaggtacaaaaactgccgganatnntggaattctatcgtgatgcanagaagaaagaacggagtgaagccatttatgcctacggcagcagaaagagatgaaatcttgagagcantgggaaatatgccctattgaatgtttgcattaaaagtgtttatataacttanaaaaaaaaanaaaaaaa

SEQ ID NO: 7912 - DNA, 233 bp, Homo sapiens
  misc_feature (1)...(233): n = g, a, c or t
caagagccagnaanaaaccaccggaaggaaccatctnactgtgtgtaaacatgacttccaagctggccgtggctctcttggcanccttcctgatttctgcagctctgngtgaaggtgcanntttgccaaggnanntgctaaagaacttagatgtcngngcataaagacatactccaaacctttccaccccaaatttatnanagaactgagagtgattganagtggaccacact

SEQ ID NO: 7913 - DNA, 569 bp, Homo sapiens
  misc_feature (1)...(569): n = g, a, c or t
ctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaangaggaagacacttctttagttaacatgtctactccagatccagatgcaaatggcttggaatcttacacaactctccct

SEQ ID NO: 7914 - DNA, 564 bp, Homo sapiens; identical to SEQ ID NO: 608

SEQ ID NO: 7915 - DNA, 373 bp, Homo sapiens
  misc_feature (1)...(373): n = g, a, c or t
ccaaaagaagtaagacagcttgctgaagatttcctgaaagactatattcatataaacattggtgcacttgaactgagtgcaaaccacaacattcttcagattgtggatgtgtgtcatgacgtanaaaaggatgaaaaatttattcgtctaatggaagagatcatgagtgagaaggagaataaaaccattgtttttgtggaaaccaaaagaagatgtgatgagcttaccanaaaaatgaggagagatgggtggcctgccatgggtatccatggtgacaagagtcaacaagagtgtgactgggttctaaatgaattcaaacatggaaaagctcctattctgattgctacagatgtggcctccagagggctagatg

SEQ ID NO: 7916 - DNA, 516 bp, Homo sapiens
  misc_feature (1)...(397): n = g, a, c or t
ctgcacatggattggttaacataatatatactgctatataatcttttaagggctaatatttgtagataatttaaaagcatgtcaatttcctctaagatttgattatttaacctgcacaaaggccaatcttcagttatcaatgacaagaaaactctagggctgccaaaataacttcattttagaccccagagttagtgttaggctggtaatgtttctaatttgggaataatgagactagaaagctaggagggccccctccaaatttctcccttgtattaggctgaagtagaacataacgtggcttaaagcataaacttaaagcatatgctttgagttttaaaaatgttaacctgtaattaattattagagtattatccatagnctactatgatagtcagttaatattctctaaatcanattatattcatttgaaaatgcatntgcatatttgcaaatgtgttattacacaagatcttacctatgtcaatttaaagaggntaaagatgcaggaagtcc

SEQ ID NO: 7917 - DNA, 499 bp, Homo sapiens
ctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcattt

SEQ ID NO: 7918 - DNA, 555 bp, Homo sapiens
ctgaaggtttttttattctttctttttttaaagtgagcccatgatttggtgtctttcccagattatcccctttgcgacaacacaagcaaaaatatttacaaaggtaaggcatagtcaaactacataaagagaaaaaatcatgaggaaaatacatgaaaaagactaaagacttcgccataacaaggtcttagtgataatagtgtccgtaaagatgtcatcagaattggtaaagtcaagcatgctgcaaatataccctttggattagaaaagagcacaattttctttttttgttttgttctgttttaagaagtggcatactgctctttctccctttggataatttcttttaagcccatcaaaggaaaaaacaaacacaattcaaacaaacactgtcaagtgattcaagatcaaatatttacaataatcaaatggagtatcagatttttttttccaaactgataccacaaatacagagctgaaatctctctttggctcctctatatgcaaaattgaattagtcttcattgaagacaattatatagtcagttccagatg

SEQ ID NO: 7919 - DNA, 545 bp, Homo sapiens
  misc_feature (1)...(545): n = g, a, c or t
ccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcanaaccatgaatag

SEQ ID NO: 7920 - DNA, 584 bp, Homo sapiens
gagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgat

SEQ ID NO: 7921 - DNA, 116 bp, Homo sapiens
ccaacgtggatggagatgcactcacgcatggttgctgcttcgcgactgccgagctgatggcggagacgaagaggagaggttgttgcttcttacagcgcgactcttaggcggtcgat

SEQ ID NO: 7922 - DNA, 260 bp, Homo sapiens
  misc_feature (1)...(260): n = g, a, c or t
attgaatgcagactctaaggctccatggcancagttcatattatgcaacancatgaatggagggtcatagcgtcttcatgtcacttgggtagtaagattggcacagtttanaanagcaagaaaatgctgaaatctcttcatcagtaggctactacgtactctgtgacgctactgccttttcagaacacttattaaaaatttgactagagcagcagctctggactagactgtttcagaatgtttgtgcgcgtgtgtgtgtg

SEQ ID NO: 7923 - DNA, 434 bp, Homo sapiens
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttggg

SEQ ID NO: 7924 - DNA, 116 bp, Homo sapiens
  misc_feature (1)...(116): n = g, a, c or t
cctactatgggtgttaaatnttttactctctctacaaggttttttcctantgtccaaaganctgttcctctttggactaacagttaaattnacaaggngatttanagggttctgtg

SEQ ID NO: 7925 - DNA, 234 bp, Homo sapiens
cctacccattctcctagtttcttgttgtcatcaaccttaattaggttgatttggtgttcagcacaaagggcctccaccaacttgacatacataggctcatcacagttggatgcaagcacacaaagatgggcttggcgcttgtctaaggctttggcagcttcgcgaattccacgtgctaggccatcgtggatgagggcagtcttcagaacctcttgtaaagcagtattaacgtcc

SEQ ID NO: 7926 - DNA, 564 bp, Homo sapiens
  misc_feature (1)...(564): n = g, a, c or t
ctgcacatggattggttaacataatatatactgctatataatcttttaagggctaatatttgtagataatttaaaagcatgtcaatttcctctaagatttgattatttaacctgcacaaaggccaatcttcagttatcaatgacaagaaaactctagggctgccaaaataacttcattttagaccccagagttagngttaggctggtaatgtttctaatttgggaataatgagactagaaagctaggagggccccctccaaatttctcccttgtattaggctgaagtagaacataacgtggcttaaagcataaacttaaagcatatgctttgagttttaaaaatgttaacctgtaattaattattagagtattatccatagtctactatgatagtcagttaatattctctaaatcanattatattcatttgaaaatgcatctgcatatttgcaaatgtgttattacacaagatcttacctatgtcaatttaaagaggttaaagatgcaggaagcccccactaaaatgtaaacacatttgtacgggtttcanaatgtttggactc

SEQ ID NO: 7927 - DNA, 604 bp, Homo sapiens
ccatctctaattttattaagatctttgattatgttatccaggtgacaaaattctccaatcacgactcacctccagaagcttaaaacataattgtttcatatactgttaaacacttaagagatttgtaattttccagactttcaatgtctttacttgaatgtctgccttgcttagttactgtaaggttttgatttatttctccagtgtcattgtttttcagctttattgtttgatatagtaagatttcacatgcctagcttacgatgctgtttaaacttacaagctaactttgcctttttactttttaataggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagt

SEQ ID NO: 7928 - DNA, 541 bp, Homo sapiens
ccatatctcaagcaggtctgtccaatggcttggaacatagacttttgcagtgaaactttaaaaacattacttgaattaggattacacaaaaaaaactaaattctaagtgagcacaactatcgctgagaccctgaaatttcaggaaataaacatggttcaaaactcaaactgttcatcaaaataattacgcaggtcagccaccactgcagaaccatcactgctcagagaaattgagtcagcaatgactgatctcatcatctcttcattagcacataagcggttcaacttgggatacgcaaggagtctctgcagaggtacgaaaaatttatctccaacacagaagggtgtgggagagttctctatcttgaccttctcaatctctgtgaagactggtccaaagcatgggacaggggcctttgagccaccaatgtctttgggcttatcgccccgttccccagcctgttctttccgccttggcaggtggctcactcttaagctttccacttgttgggacacctcattaaccaacacaagtttaaag

SEQ ID NO: 7929 - DNA, 600 bp, Homo sapiens
gttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggccattatgaggtgactgggagcgatgatgagacaggcaagttacaggggagtggggtgtccctggcctctaagaagtcccgactgtcctcctcttctagcaatgacagtgggaataag

SEQ ID NO: 7930 - DNA, 416 bp, Homo sapiens
  misc_feature (1)...(416): n = g, a, c or t
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccangtttca

SEQ ID NO: 7931 - DNA, 265 bp, Homo sapiens
ctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatgg

SEQ ID NO: 7932 - DNA, 523 bp, Homo sapiens
ctgcagaggctaaacaaaaatgagatgataacatgtgacctttcttaggcagatggctggttggggaaagtagatgaatgaaaagaggaaaagatctccagaagagcgggaaggtataaagtttctctaggacagtttcccaaatcgtgcttcattggacattgacacaggagaaggctgtgggggaaaagaaaattcatgatcagataggtatggcaaatgcctcattctatggtttcctctttgagattctcaatgcaacattagactattaaaggctctgaaaaatcctacaagaaaacacctgtataaccttgtgtgaccaagtaataccaaaatttatttgccctctgagtctgctattttgccctcttcctccagcccttgacactgtttctcaggaagaaaacatccttcatgctggctactacctcatatgctctataacattgtggtgttcacagtttgaatttttcaaaatccagggtagaatttggcccccaaacctaaagctagtggacaa

SEQ ID NO: 7933 - DNA, 565 bp, Homo sapiens
  misc_feature (1)...(565): n = g, a, c or t
ctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacctttatgcgcaaatacaaaatgattgtctttttcctatgactcaaagatgaaagctgtttcatttgtgtcagcatgtctcanattgaccttaccaagttggtcttactttgntaatttatctgntgtccccttcc

SEQ ID NO: 7934 - DNA, 542 bp, Homo sapiens
ccagaaccctggtggcaggagcatctgatatccctgtctttttccaaaaacctaactgtgtacaaatatgcacacaaacttatcttatatgtgtccatttctcttaatgatatttaccagcttaagaaattaacaaacattttatgtgattctcagatttttcaagtcaaggacaaattcagttttcacattatttttcaagtgtatcttatcttcggaggcattaacagggcagtaacattattaccatcactgtatctgtcattctgttttgggggattaccattgttgccaataaaacttacatttcattcccatccttagcaaattaatttagttacatgcagggtccaaacaataattatgagtttagagagagcttcagaaagccagcgatcatctgtaaggtgtgggctgaaaccaacattggaggaaggtacggccttgattattcagcaactgaaatgacttcctttaattagctcttgaggacccaaagtgggccatctgggttaatttcagtcagctcaaatcaagcactc

SEQ ID NO: 7935 - DNA, 564 bp, Homo sapiens; identical to SEQ ID NO: 609

SEQ ID NO: 7936 - DNA, 527 bp, Homo sapiens
  misc_feature (1)...(527): n = g, a, c or t
ctgagtatagttcaacagttttgctgacagatgggaacaatcttttttttttttttccaactgccatctatacaattttnttacagatgtcaaaagcagtntagtttatataagcattctgttacctgtgatattttttanactgaactgctccattcctagtcttaattaccatattcagggtncnaactggagggcttgngtgttancttctgaattggcaattgnaggcggtagtggtcgtncctgtgtgtatcaaaagggataggtatnttgcctcctttctctcaggcagngcaaatcaccctgtggaaaaccnatggacaggaaggagtgttacacactgnttaccctgatttattcagnggttttgttttcattctggaaccatactatcaaatggngacanactgttccgttccacccccgtgaagtaatcatgcaccgngtgaatagtatcaagcaggattgntttcattgtntggagcatgaccagcgtgtgactcattctgacatttcanatccta

SEQ ID NO: 7937 - DNA, 474 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccattgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcac

SEQ ID NO: 7938 - DNA, 355 bp, Homo sapiens
ctggatcacgaggtcaagagttcaagaccagtttggtcaagatggtgagacccccgtctctactaaaaatacaaaaattagccaggcatgacagcggatgcctgtaatcccagctattcgggaggctgaggcagagaatcgcttgaacttgggagggggaggttgcagtgagctgagatcaagccgctacactccaccttgggcaacagggtgagactctgactccatctcaaaaaaaaaaaaaaaaaaaatccaagagtagggctgagcatggtggctcacgcctgtaatcccagcactttgggaggacgaggagggtggatcacctgaagtcaggagtttaagaccagcctgg

SEQ ID NO: 7939 - DNA, 423 bp, Homo sapiens
  misc_feature (1)...(423): n = g, a, c or t
gtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgtttttttttttttttttttngggggttaaaagcaaggcatgcttgtggatgactntgtaacanactaattggaattgttgaagctgctccctggttccactntgganagtaatctgggacatcttagngttttgttttgtttttttccctcctcttttttttgggggggagtgtgtgtgg

SEQ ID NO: 7940 - DNA, 138 bp, Homo sapiens
  misc_feature (1)...(138): n = g, a, c or t
aaagctgtctgagaccctcctcccctcctccccagcatggagagaataattgccatttcaccctacaaatccgaaagagtctcccccttccgtgggtttaagcanggacacaagccaagcaagcctcagatacccagg

SEQ ID NO: 7941 - DNA, 550 bp, Homo sapiens; identical to SEQ ID NO: 610

SEQ ID NO: 7942 - DNA, 559 bp, Homo sapiens
  misc_feature (1)...(559): n = g, a, c or t
ctgaactctctgaacttgtcttctccttttgatttgaattttccattgccaggagagaagggccctgcatgccttgtgaaggtttatgaanattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccanaagttgcaacacatcaacccattattgcctgcctgccttaacaaagaggagagcaaaacctgtaagtatatacaagaagagatgtccttccactaggaaaatttacagttaacttgagtggttgcccacggaatagtaccttcacagaacacttgtatcgaattattcaacatcttgttccagcatcttttcgtctgcngatgactatagagaacatgaaccatttgaaattcattccccacaaagactacacanccaatngctt

SEQ ID NO: 7943 - DNA, 260 bp, Homo sapiens
cctgaagtgaggaaaacctatttaggactgacatctaactagagaaagtcagggaatgaggcaggagaagaggcaaagtcctcatgaaccacaaagatagagtggaaaatcctaagtaggaaaaaatacatggaaaagggcaaatgagcaacagcagtgaatgagttgagattgaaaaggaaagagttcaaggaaggagaggcaatggggcaagacaaaataaatctgaggaaacagagcaaataaaaagtatggaggga

SEQ ID NO: 7944 - DNA, 600 bp, Homo sapiens
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaatta

SEQ ID NO: 7945 - DNA, 150 bp, Homo sapiens
ctgcccaatgcaggcagaaggcaggaaggctatagtgttacagccctggcttgggaaatcctgatgtctcggcccccagaagtgtcactgcttttcactcctgcagtccagcaaatgggagcatgtcaccaccacagtttggtgagttgg

SEQ ID NO: 7946 - DNA, 519 bp, Homo sapiens
ccaacccaaagaacatctttcccatagcatctttgtcccttgccccacaaaaattcttctttctctttcgctgcagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggaaggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 7947 - DNA, 383 bp, Homo sapiens
ccatggacaagctgaggaagatgctggttccctgcccacagaccttccaggagaatgacctgagcaccttctttcccttcatctttgaagaagaacctatcttctttgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacag

SEQ ID NO: 7948 - DNA, 578 bp, Homo sapiens
cctcaatgacaagatgtttgagcatgacttccgttggactgatggcagcacactggtaagatgcccttgaaaatgatgtcaagttctaccttctggaaatttggtactgtgcactgattgtgcattacagagggtgcattagactggaggcaagttaaatgacttgctcaaggtcactcagtgaaacagagaagggttagaagagttccaagctacctgatccaacatccagtcctctcttcaatagttgtggttctcttcaaaagaggagtgtaccagatttctatcaaaccagaaaaccagacaattagtagaattgccttgggtctgtctttcagatggttatctttgctttttctagcttcagagcaaaaagagaagaataaaatgtagcagaaaaagtcattttaaaaaaatacctttccgtcttaaataattcactggaaatccgctataaggcatgactcatttccaagcaaaaatatccatttatttttatcttaaagaagactgttgatatgatcttgtgaatttctgccaactaattacatatttcaacttgttttctattttttgaa

SEQ ID NO: 7949 - DNA, 611 bp, Homo sapiens
  misc_feature (1)...(611): n = g, a, c or t
ctgcatcccatgtgcgtcgatgggcaaagtatttgtagcactgcccttggaatttgtgccagccatagtcacatgtctcggtatcttgctcacaaagtgcaccaacataacttggaaggcagaggcacctgaatgtgttaaaaccatcaacacaagtggctccattacgacagggattagagtgacattcatcaaaatcaagttcacactggtctccgctgtatcctggcacacaggtgcatacgtaggaagtttcagtaggataacaggtgcctccgttaaggcacgggttcattttgcagcgatcaggtcctggtaaatagattgccgtgccttccactgactcttcattaatgccaatcaggaaatctgtttcattagaagtctccagaagggaaaatggtggtgttgcaacctcagtattaaattccacagggtttactgttgcctgatcattggaatcaagaattctcgctgccacttgctgttctgatgctgctatcgtggaatcctgccctctgattaaagctgcttgagtttcagggtttatttctggagaanaagaaagcgtgggcctctcagaagtctgtggacttagccaaggcaccaca

SEQ ID NO: 7950 - DNA, 553 bp, Homo sapiens
  misc_feature (1)...(553): n = g, a, c or t
ccttctgctagtcctggtaagaaaaatcctatttcagaccattaaagctaagttattttgacataatcatgattcttttcaataaacattaaacatgacattgtggaatatcaaatctaaccaaaaatgcctgtacttaacaaaacgaagatttttgtccgaattatctctggctacactcaacacttccagcaggcagttgctcaactttccaatgtctgcataaaatacagttctgaagccaatttttttagattaaaataaaaagccactctttagcataaaccttcattcaacgaaattgggtaaataagatttaattaagaaaattaggagccgcgttcattgcaaaccgtagtttactttancatttcacttgtaattaagttaggggcttagggatgcattgaaaacaccaaaggataagtatctcaaagttctaaaaatgtctcaatactaaaatgatgttctggggtgattttgcaaggaccanaagacatcatacattgcgaacccagtgagggtggcatcgcggacgaacagaanatgcttt

SEQ ID NO: 7951 - DNA, 499 bp, Homo sapiens
ctgtttaaccagaaccaaggtgttcaccccccacagaatgtacatgaaacactagaggactgcatgtttttccctgagagaagcgtaagacaaacagaagtcaaaaagtagtcactgggagcgccatccttctaagcaaatcctccctttcccttttggaggatttgcccgaactacgtagccagtcagcacttagaccacctgcctcctcctccccctataaacccaccactcccctcctcctttcccaaaccacttggggtgtcctaagccctcactgccccaagcccaaaatatcaactaagatccttgtctgtatttccacagtcatacctaatgaattgggaagtggggcccctaaaaaccaattcacatctatgcacttgtttccactggatttggcagacaggcttttttagttaccgtaaccagatcttaagattaattaaaaactacataaagtgcttttaggtccttagagatacatgatataaataag

SEQ ID NO: 7952 - DNA, 503 bp, Homo sapiens
  misc_feature (1)...(503): n = g, a, c or t
ttgcanagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttnatcaaagactgcgttcgaatccataacaagttccgatcagaggtgaaaccaacagccagtgatatgctatacatgacttgggacccagcactagcccaaattgcaaaagcatgggccancaattgccagttttcacataatacacggntgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtgg

SEQ ID NO: 7953 - DNA, 597 bp, Homo sapiens
tgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaa

SEQ ID NO: 7954 - DNA, 519 bp, Homo sapiens
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctgcagcgaaagagaaagaagaatttttgtggggcaagggacaaagatgctatgggaaagatgttctttgggttgg

SEQ ID NO: 7955 - DNA, 599 bp, Homo sapiens
ctggacaagaaagagcaaatgccaaaatagaacaagaatggttttgttgaggtgtttacagaataagcaaagcctgggttttaattggaatttaattcagagttctgtctgagtccatcaaatgatccctgttgaagattaaaagtttactgccttaggcagtaagtcttaaattatttttgatagtatttatttaaaaattttaaaaactatgtacctctcacattttaagttgccaacaaaattttttttcatcataaagttatacaactatagaggatgtaatttttgacctattttaaatattgtcattctaaaataagcatgtaatatcactttcaggatatattcagtggaatctaaatatcatagtggtttgacctcttacatcattcttttaaaagtagtcttttattaagagtcaaaaattttatatttttgttttcgttggactaattctaaaatttaagttcctcttacggaatgttatcaaaaattatatagttatatgcttagaagtcttctattgattaagccatcaaacttaagtacatcaaaatttgtactttaaagtttaaattcttttttccttgtgaaca

SEQ ID NO: 7956 - DNA, 392 bp, Homo sapiens; identical to SEQ ID NO: 7567

SEQ ID NO: 7957 - DNA, 350 bp, Homo sapiens
  misc_feature (1)...(350): n = g, a, c or t
ttattttcactccaaaggcncatctactgttcctactattattgctacagatattccaaaaagtgagtaggtggaaagaagggattaaanaataccaccacaggaaaaaaatatttaacttatgacctanataattttagtcattnaatatnttaaaatatatnttatgacttaaaagagaaagnattctatttaccatatatacaaanaaaataccgtatttggaatccaatagacttggttccanaatacataaanaactgctncaactgatgataaataaataacctgaccttaaaaatggnacaaaacttttaaagagatgntcntaaaagaagatatacaaatgg

SEQ ID NO: 7958 - DNA, 487 bp, Homo sapiens
  misc_feature (1)...(487): n = g, a, c or t
cctttcttacaaccagcangactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcag

SEQ ID NO: 7959 - DNA, 608 bp, Homo sapiens
  misc_feature (1)...(608): n = g, a, c or t
ccatgggaatctaattaatttcataatgatgttggttgaacatgataccaaaaaatgcaggtattttcaagaacaataagatagataacagcattaaagcataatcctttaagaattcatgagaaaaaaaaggatgataaaacttaagcttctttttcagatgtttaaaaatttctataaaattctttgtcccaagattaatcatataaccatggtacataaaatatgctaactacattgcctggtgtcaaggtgggaaaatcctcttttataacataaaatcctcttctaatccatgttgacccaagtcctggctgtctgagggcagattcctgtcaagagacctaaggttgtcatggaaagcatcactttcgtctactagttggtaatcctgttccatttccgttaggaagccactcccagatcctgatccagagccggagccggagccgaagcctgatccagagtagtcctcagaaagtgggaagatacgattcaagtcctggattcccgtctttggaaaaaggtcagtcctcanacgggggatcttgttggattcacctggaagtagttcgaacattggtcctttttcttcaaggcagtttgca

SEQ ID NO: 7960 - DNA, 606 bp, Homo sapiens
ccttatttgtagatttcattttggtttattatggtttctaattattcaaagtaataacaaagcatatacaaagagatgccacatgtcctgtactttttgcttggttttgaatacttaggaattcctcaaattactttttcatgaaaacatgactgatattactaatgggaaaaaaatctctgaaattaacaaaagaaaacacgcctacacatatatgcactaactaaagatatattctgagacctattctattactgtggtatgagggagagagaatttaattttccctttaaagaaggactggggatggcacagggagcgacaggaccagtcctgccagtgagcagcaatgtgtctgtgggtggctgtgcaagacggaaggcgaggctctcaagtaaggcacctggaaagacactcagtgtgaactactggcccaggaatcactcatggcaaaacgtaccaaggtcaccaggagaaaacagggttagaagcagcttctcataagaggctgcctgataagcaatgaaagtgatgatttgttttgggatctataggtttcagtactttgaaataacagatagtaaagccttcttcttttacacacct

SEQ ID NO: 7961 - DNA, 470 bp, Homo sapiens
  misc_feature (1)...(470): n = g, a, c or t
ttttttttttttttttttanaaatctatttatttatcaaaacagtattggcacagtaattctcatattatcatcaaataataaaattgctactttctgtactcaattctttanaatcctanaaattgcaaatgcattcaatttaacaatattgtaaataacaatacaaaanaaagaactctgcatatttatggaaacattgttgatggtncagttntactgaaactcatacacatttcactatttaatttacatatggtcttgttgaaaaaaaccagtatgttttactttttcaatttccttatgctaaaatacatgtaattctaaaggatatctcttaggtgttataaaaaccaaggaaggtccaccaccaagtcaaagttagagtcaaagatacttcaaagattccatgaaatgatctgaaaacaaatttaaccaaaaaatgngtactgtattggggcacatccatgg

SEQ ID NO: 7962 - DNA, 543 bp, Homo sapiens
cctttcttaaacaacttactctgcattaaaaagtcatcaataagaactgtaattcagtgtttttaaaaatgaaatgtttaacttcaaattgtttgtttaaaataaactgctattgtgccaaataatgaaactactattttattcattacaaacatcatataatcattctctataatcactataaaaatttaaatgcttcctttctcctgtatatgaagatggtagttctaaagcaacactctaaaagtgttaaaaagcccattcgtaacacacaccccacctcagtttttgaaagtcagtgcattcagtggttataaataggcatgatgttcttccacagctaagagttctgagtgtcaatcagttgtgtttttttctcccaagggaagacgttcccataactggagcaactgttcaccaacctgaggttctagttcctagataaatcagaagtcaaaataaacataaaaagaactggagtgaaaatttttaatgaccaaaacctacactgataaaaatgtaagaaaatcactttaaatttca

SEQ ID NO: 7963 - DNA, 560 bp, Homo sapiens
  misc_feature (1)...(560): n = g, a, c or t
ctgaaaaccatgctgttcaagggtcaactgtgtgtggtatcggtgagactgaatgattatcgttggtgttcttaaattattttcaggtcctctagaaaataagataattatagcaaaaaataaaattgttttgaaattttgataaatatataaatgtatagaacctatttttttcaatgaaagaaaatgggaaacattttttaacattgctagattggcagtgctttcttttattatttcaagttatggaaatttgcacagttgaaaactggggataaattctacaaaagtgcaagaaaacaattcaaattagccagagccctgctaaaacttttaatgtaaaatttatttatttgcactgagctgttttaccttctttaaggccattgggacctctcaatgatgcatatgtttcatacatcttgtattttccaggtagaagtcanacttggttaataccaataaatacttctgtaatcctattggctcanttacctttataatgaagtatattctgtgtaaggtaattcttccantgatggtctgagtagtanagtctt

SEQ ID NO: 7964 - DNA, 598 bp, Homo sapiens
  misc_feature (1)...(598): n = g, a, c or t
ccttgtgggtaatggtgaaaattctggattttattctgagagcaacaggattccgctgaagaatttttaaccagagaggtaatgtgatctaatttgtttgaaaaagaacaggtctgttgctgaatgaaatagattagagggaaaagtgcagatatcaagtaggcaaataaatgtttggagctcagacctagagaggaagaggatcagggatcagcagttctgaaaagatctctaacttaccagcagactgtgatcgccttgtgggaagagacttgcgtttctgaattccctgttgtgtgtttgttttgagagaaaacagagcatatttgtatgctggcagaagtgacagaagtgatagaaaattctagaaagtaaagatgcaggaattaagagtgagataattaaagggtcaacttccttgagaaggtgtgcacatgtagagagattcattttgaaaggagagaggatacttcctctacaataaagagaggaaagggcaagctggaacagactctggcaggcgtgtggcatctgtggttggggtaggaaatgctcatttgctaatctgtactttctcagtgaagtcgagcggnaagga

SEQ ID NO: 7965 - DNA, 597 bp, Homo sapiens
gtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatacttt

SEQ ID NO: 7966 - DNA, 538 bp, Homo sapiens
ctgcaagcagccgaggcagatggagcccaagccctgttgcttgtggtcttggcttactgagcctgaatccacgaccggatcattagaaaagggacggtgtgtgtgcctacctttgaagccagtaggccaaaagaagggtgagcaggacagcgccataacacctagagttactgtgtttggttcacacttctggtttcctgcagaattgctagaatttttaaaaaaaggaagcagcaagttgagagcaactaaagtaaaaagagaaaagtgatacaaagggaaaggtttatttttggagctcttagattctgaaactccttctgactcttttatccttttacctctccctttctcctcactgggctctttgtcctcatggggactgtgcatctctggtctcactctagctctgggtcccttaggctcttctggttttctggctcctggagtgagccctttcaatgaggccctccctcaatttcccatccctcttgttcttctgccatccagactcatcacagcccaaatctgagaccag

SEQ ID NO: 7967 - DNA, 158 bp, Homo sapiens
cacgagtctgactggcctttgggtggcctttgtggacggctcgtagctggaaagtgttgatctgggttttctggcattcttttaagttaaaaagttgacatcgggacaggggtttgatcttttgttgtacctgatgacagtgcagagattctccacag

SEQ ID NO: 7968 - DNA, 474 bp, Homo sapiens
ttttgctcttggtttgcattccagtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacag

SEQ ID NO: 7969 - DNA, 417 bp, Homo sapiens
ctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacag

SEQ ID NO: 7970 - DNA, 449 bp, Homo sapiens
  misc_feature (1)...(449): n = g, a, c or t
ctggagagtgtanatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 7971 - DNA, 383 bp, Homo sapiens; identical to SEQ ID NO: 7947

SEQ ID NO: 7972 - DNA, 572 bp, Homo sapiens
  misc_feature (1)...(572): n = g, a, c or t
gaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctanctagccag

SEQ ID NO: 7973 - DNA, 375 bp, Homo sapiens
ccaccatgtgttctcattgctgtaataaaccaaaggacttactccaacacctgaagcttgcagtcggggtgcaagagtccctcacagagtagtttgatccccttgtctccgagagtgttgcctcgcaggtaaaggtgcgtgagattctgattagtgctgagtaccgaggacaaagctgaacaacagactgacgtaaggccagaattcaccaaccccagtttctgcaggttacactgtggattcttggctttttcacataaaattgcgactcctgagtctcccaaggcattctcccccacatagagtctggtcagggaatggctggtgctcaatactgatgcaagatcctgacaacatgctgatgtgaggcagcag

SEQ ID NO: 7974 - DNA, 599 bp, Homo sapiens
  misc_feature (1)...(599): n = g, a, c or t
ctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttacaaacaaatataaaacctgtttctgnttatgaata

SEQ ID NO: 7975 - DNA, 265 bp, Homo sapiens
ctgaacagagaaaggaattaaaacgctttaattaaaaaatcacgagtggatgataaagtgtgtagaaactgaaaatttacaaactatttaaaacctggaatcgctgactgttcagaaactacacagatggatcatgggtggtggtgaacagcagaaagggattatggatgaatctgcattgttctagctgctccccatgccacccgtctccgaggaaagcctgtaacacagaaacaagaactcagttagtttccccagtgctcag

SEQ ID NO: 7976 - DNA, 597 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacacc

SEQ ID NO: 7977 - DNA, 596 bp, Homo sapiens
agtctaggcagaatgtaactctaaaccattgtagactgtcctgaagattcataatttctttccccaaaagaattattcttaatatgcacatttaacactgaaatgtagctgtaattcaaggtaagcttaggaacttcaccctctaagcacagacttctatgcagcacatacttctataatcagtaaacttaattcacaaaattagcgcataagggtattaagtgcatgggaagtaaacacagttatgttacacttaaaattacttttgaatgattgataaaggatttcttcatgattgattatcttaagaaaatggaagtctgtgtaacttgaatttggcagggcatgaaataagtggtaaaaacagcaaactgataacttgagaatcattttcgttttactgagaatactttatttgctggtagaagttgctaaaaatgcacagaacaaataccaatagaaaatgcactgtatttgaatctccctagtctatataaaatgaacggtgtacagcatctgttggaaaaatggctgcatggacatttcttattttatgcccacttataaataaaaataaaccttttattcaagagtat

SEQ ID NO: 7978 - DNA, 599 bp, Homo sapiens
  misc_feature (1)...(599): n = g, a, c or t
ccaccgtcacagnccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtaagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttttaattttaggctcagaggcccataggaggttttaagatttatgtttagtccgataggtgaggtctttgatattttgaattttaactccttttatgatacatcacagt

SEQ ID NO: 7979 - DNA, 575 bp, Homo sapiens
  misc_feature (1)...(575): n = g, a, c or t
ctgggagagctagactaanttggtcatgatgcagaagctactcaaatgcagtcggcttgtcctggctcttgccctcatcctggttctggaatcctcagttcaaggttatcctacgcagagagccaggtaccaatgggtgcgctgcaatccanacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatc

SEQ ID NO: 7980 - DNA, 598 bp, Homo sapiens
  misc_feature (1)...(598): n = g, a, c or t
gcttctaggacaagagccnggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaatttattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaaca

SEQ ID NO: 7981 - DNA, 450 bp, Homo sapiens
  misc_feature (1)...(450): n = g, a, c or t
ctagtcttaaaaaatatgatagtttctctactaaagtctaaaaaacaaatctgtgctatttaaagaaagctgaaaaaatctgttttatcaaataggtttcacattagttttttcaacaactctcaaatgactatagttttttttctaaataagtataaccaattacatggtatgatgacccttacttgtgacactagtgtctccctagaatagctttttgtctgtggatagagccaaagatgctagataaagttcaaattagggaaaataataaactcattcataaatcagaatcaaacttgtctctctgtgctaggttaagcattgctaatttaaataaaatctgcattaattgaaatatgctgaaaattttaagatatatttgcatttattatgatgcattttgcatcaganatattctattcttgatcaatatttctcaaatattgg

SEQ ID NO: 7982 - DNA, 603 bp, Homo sapiens
  misc_feature (1)...(603): n = g, a, c or t
ccatcggtgctgaaattgancattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgctacatggaaggaaagaaagaaaaaaagaaaacacacaatattacttgctccataccctaaactgccgataccacagccgtaaaatgaaggtgtctagtagttgttatagcacggnagtccattctttntaaaggaccacttac

SEQ ID NO: 7983 - DNA, 155 bp, Homo sapiens
  misc_feature (1)...(155): n = g, a, c or t
ctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaanatccncc

SEQ ID NO: 7984 - DNA, 603 bp, Homo sapiens
  misc_feature (1)...(603): n = g, a, c or t
ctgataatttncaatgtcataaagtttccagtttcacaatacaaaaaggataaaatgaaattgggtatcattttgttgcaatttatagaactttacccatacctgtaagaccctcaatgtatatgaaatcattttcactgggaaagtgacagttacagtaaaagcagaaccacacaaatctttatttaaaagccgaaatatcagccttctctctctcttttgctatttgaaaggtagtcttcaatttggcaggcaactgcttctctctccaaatagtaacaggttacaaacatgctactttaaatatgaataggacctaaggctttagtattttaaatcttgcccaatacagaaatgcctttcaagagactttagtgatgcttaatttatgaacaacaaggaattattttccttttgattattcactttttcaaaactcatagatcagaataaacaaaaaatcccccaacccatggtggggacacaaaagtaacataagtgactaaggtgtgccattcatagagaggttgaagactccatgccccaggaccacttanctgcaatagggtgaaatagtctactttttgatttcatgaatntttt

SEQ ID NO: 7985 - DNA, 489 bp, Homo sapiens
  misc_feature (1)...(489): n = g, a, c or t
ccttatttctctnntcctttcgtacagggaggaatttgaagtagataggaaccgatctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaaga

SEQ ID NO: 7986 - DNA, 392 bp, Homo sapiens; identical to SEQ ID NO: 7567

SEQ ID NO: 7987 - DNA, 367 bp, Homo sapiens
gcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttgg

SEQ ID NO: 7988 - DNA, 485 bp, Homo sapiens
  misc_feature (1)...(485): n = g, a, c or t
ctgcaaaaaccacttcaggntcctagctctatttctagagctgtcttgtccannacagtggctgctacccacctgtggctcttgagcacctgaaaggtagatagtgcaaactgacatagtctttaagtgtaaagtacttgacaactttaaataagataataggaaaaaagaatgtaaaatttctcaataattttcatgtgggttacttattgaaacataataacttgaatacattaagtaaaatatattgttaaattactttnatntctttaatttcaattttttaaagatgcttacaattttatatggggttttcattatatttntattgaacagtgctattctacacacaagctcatcttccttaaatattgntggngcctccaaccatgattccatcacttctttncattggccaatttctttttttcttttttttgaatngagacatannttcactcttgtcacccangctggaatgcaat

SEQ ID NO: 7989 - DNA, 446 bp, Homo sapiens
  misc_feature (1)...(446): n = g, a, c or t
cctttcttaaacaacttactctgcattaaaaagtcatcaataagaactgtaattcagtgtttttaaaaatgaaatgtttaacttcaaattgtttgtttaaaataaactgctattgtgccaaataatgaaactactattttattcattacaaacatcatataatcattctctataatcactataaaaatttaaatgcttcctttctcctgtatatgaagatggtagttctaaagcaacactctaaaagtgttaaaaagcccattcgtaacacacaccccacctcagtttttgaaagtcagtgcattcagtggttataaataggcatgatgttcttccacanntaagagttctgagtgtcaatcagttgtgtttttttctcccaagggaagacgttcccataactggancaactgttcaccancctgangttctagttcctagataaa

SEQ ID NO: 7990 - DNA, 92 bp, Homo sapiens
  misc_feature (1)...(92): n = g, a, c or t
ctcaggtgacactatggcnanattaacatctgggattaggactggaaacacatgtcattttgaactaagggaaactctttgtcatcctaatt

SEQ ID NO: 7991 - DNA, 88 bp, Homo sapiens
  misc_feature (1)...(88): n = g, a, c or t
ctgggaagccacgagaatattgngaacctgctgggggcgtgcacactgtcaggaccaatttacttgatttttgaatactgttgntatg

SEQ ID NO: 7992 - DNA, 203 bp, Homo sapiens
cctttaagaattaagtgacttgtccaaggtcactatccgtattttaggagccaagacgagatcaagttcaatattccaggagtggtactgactagaccttgtagttattttgaaaatgttagcctccaattacaaaagcaagcatttcctagttctcactcaacttctccttttccctgttcctctcaaaaaaaaaaaaaaaa

SEQ ID NO: 7993 - DNA, 72 bp, Homo sapiens
  misc_feature (1)...(72): n = g, a, c or t
ctgaaccctcntggagccattcatacaggtccctaattaaggaacaagtgattatgctacctttgcacggtt

SEQ ID NO: 7994 - DNA, 577 bp, Homo sapiens
cctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaag

SEQ ID NO: 7995 - DNA, 186 bp, Homo sapiens
cctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtgg

SEQ ID NO: 7996 - DNA, 236 bp, Homo sapiens
  misc_feature (1)...(236): n = g, a, c or t
cttacgtttagtgagggagagatttggtatatgattgagatgggggctagtttttgtcatgtgagaagaagcaggccggatgtcagaggggtgccttgggtaacctctgggactcagaagtgaaagggggctattcctagttttattgctatagccattatgattattaatgatgagtattgattggtagtattggttatggttcattgtccgganagtatattgttgaagaggat

SEQ ID NO: 7997 - DNA, 388 bp, Homo sapiens
  misc_feature (1)...(388): n = g, a, c or t
ctgaatttcacttttctttaaaaatttaatattaaaatgntttcatctcttaattattggcttgcttgcatggatcattcattaaataattttttatttgctagatacccataatatctgccgaacatctgactagccacaagtatgttacccagatgtagaattttcatcactaaacagtaagttcattatgtaatatatagttgcatatttgtggtggttttttttaagatagcaattgtatagtgcacttaaaattttgcgaaatctctgagaaaatatatacagatcacatttttatcttaaatgggtgtgaggaattttatcagacatctttataacaaatatgttaatatcacttaaatatacaaagtnctaagagaaanta

SEQ ID NO: 7998 - DNA, 388 bp, Homo sapiens
ctggcagaccccccaaccacatcagaggagttttcatttcttcctgggctgcttatctgggaagccttcaaagaattcgttacacatcatggcgatgcaggacaggaagacacagtactcttggaagtccacctcgttgtccctgttgctgtccaagttgctcatcagcttctggaaagcagcttcatctgtccttttccccaagaagctgggcagctcccgggtcagcagctcctttagttctgacttgttgagcttgaacttgtcaccctctttgcccgagtacttgtggaaggtggacaccatcacatccagggccttctccagagggcacgccatgacagcagtcaggatcaaaccaagaaagaagaagcgctgaggagagagg

SEQ ID NO: 7999 - DNA, 405 bp, Homo sapiens
  misc_feature (1)...(405): n = g, a, c or t
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtgccanttggggaactgggcanactcaaattccagcttgttattgatttctatcttgttgaagacaaatcgcttt

SEQ ID NO: 8000 - DNA, 452 bp, Homo sapiens
cctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaa

SEQ ID NO: 8001 - DNA, 355 bp, Homo sapiens
gaagaacgtgagtaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacag

SEQ ID NO: 8002 - DNA, 339 bp, Homo sapiens
ccagaggagggtcccatctgtcatccgcctggcactggctccagggactgccttccagagtatacccatcttcacacttcaaagtcacataatctccatagtgatatacttttttcatttctaactccttcgagattccattcataaacagtgggaagctacaatttacttctttgcaataatgatccaattggctccagattccctggtctgtacagaaaatgaagccctttcccactaacaggtagccggggtcacaaatgtagctgattgtcatcccaggaagatatagagatacgtgtcctccaatgtaatgcccgttttggatcttgggtggat

SEQ ID NO: 8003 - DNA, 393 bp, Homo sapiens
  misc_feature (1)...(393): n = g, a, c or t
ccagtgtgaggtttgctccttcagcaaacctggaaggtaagaatggggcatatccacatccatagacccttttgtttccctcacagaattttgtgattttttttgtgtgtggcatttttgggggagcagggaacatcaactttgttgggggaaatttctctgcataccagcacgccagcgagggcagacggccttacacactggcctgtgaacatacctatttgttggcccgcttgtgtctgtacatctgcatcatcctctgtcggaacacatcgaatgtgtcttctttgtgctcctgcccgtcagcacccaacccttccccttccgagggggttcccctagggagtgaaaaanagagtcagttgtgcacctgagcccagggcctgncatgcc

SEQ ID NO: 8004 - DNA, 73 bp, Homo sapiens
  misc_feature (1)...(73): n = g, a, c or t
tcggcttgtcctggctcttgccctcatcctggttctggaatcctcanttcaaggttatcctacncanagagcc

SEQ ID NO: 8005 - DNA, 279 bp, Homo sapiens
gcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtgg

SEQ ID NO: 8006 - DNA, 271 bp, Homo sapiens
  misc_feature (1)...(271): n = g, a, c or t
ctgattgattgaatgcaatgtgattgattgattgattgattgatatataccaaaattcatatggatgtcacacagtgacagcattgtacaagtaacgttaatgacctccaacaaacacattttaaattanactggtcaagctaaaaggaatgttggagccaaaagaaatgtagtggaattcagattgtctattaagacttgaaactatacattagaatgatgtggaaccctaatactancancaactgnnacagcccncttnaaagatttg

SEQ ID NO: 8007 - DNA, 531 bp, Homo sapiens
  misc_feature (1)...(531): n = g, a, c or t
tgagtccaaacattctgaaaaccgtacaaatgtgtttacattttagtgggggcttcctgcatctttaacctctttaaattgacataggtaagatcttgtgtaataacacatttgcaaatatgcagatgcattttcaaatgaatataatctgatttagagaatattaactgactatcatagtagactatggataatactctaataattaattacaggttaacatttttaaaactcaaagcatatgctttaagtttatgctttaagccacgttatgttctacttcagcctaatacaagggagaaatttggagggggccctcctagctttctagtctcattattcccaaattagaaacattaccagcctaacactaactctggggtctaaaatgaagttattttggcagccctagagttttcttgtcattgataactgaagattggcctttgtgcaggttaaataatcaaatcttagaggaaattgacatgcttttaaattatctacaaatattagcccnttaaaagattatat

SEQ ID NO: 8008 - DNA, 449 bp, Homo sapiens; identical to SEQ ID NO: 7970
  misc_feature (1)...(449): n = g, a, c or t

SEQ ID NO: 8009 - DNA, 297 bp, Homo sapiens
cctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacag

SEQ ID NO: 8010 - DNA, 385 bp, Homo sapiens
ctggcagaccccccaaccacatcagaggagttttcatttcttcctgggctgcttatctgggaagccttcaaagaattcgttacacatcatggcgatgcaggacaggaagacacagtactcttggaagtccacctcgttgtccctgttgctgtccaagttgctcatcagcttctggaaagcagcttcatctgtccttttccccaagaagctgggcagctcccgggtcagcagctcctttagttctgacttgttgagcttgaacttgtcaccctctttgcccgagtacttgtggaaggtggacaccatcacatccagggccttctccagagggcacgccatgacagcagtcaggatcaaaccaagaaagaagaagcgctgaggagag

SEQ ID NO: 8011 - DNA, 398 bp, Homo sapiens
aatcgctgtcggatcgatacaggaaggactcccgtcgttgactgtggacaaaatttgcttggagaattagcccggatcctgggctggtcatgggatccaagggactccgtcccgcagatgtgccattgtccacatcaaaaccactggattctgcagaagtgatagcaatcagcggcagaatcttcagggggaggctggttggtcgttgaatgttctctgattcacttttcaagtcagcttgttccaactgtctgaaggcgagagggggaagctgaatattgcgacatgaaagtctccggacaagatagggttccattccgcggaaagggtcttcctcttcattactggaatgtagtgtttcctcagaggcacttttgctccgagaaagcaaatcacag

SEQ ID NO: 8012 - DNA, 278 bp, Homo sapiens
  misc_feature (1)...(278): n = g, a, c or t
aggtntgacntcctaaaaacnaagtcaaattagggaaggatggccgtttccttgagtcaaaagcccagcaggattgcattataatgtatatttcttctgcagcataaaatggctgatccattttaaatccattttgaatcagtttgtagaagttagcatcaaccggaatgccagggtaaggattcacaccaagtgagaagatttcccacagtaatattccatatgaccagacatcactcttaatggtgtagatgccttcaaacaggctttcgggggcc

SEQ ID NO: 8013 - DNA, 305 bp, Homo sapiens
  misc_feature (1)...(305): n = g, a, c or t
ccaatatgcctttggagcacagcctatggtttatgtttcttttatgaccacctttaatatctgtcaaacgactagacatgctatagctttacccgaaggtaatttgattgactgtgctctgctagaagatggtgtatgggtccctctcgaggtaactgccaataaatgataagtggtatttgttttagataatgcctctacctcagtggtagctttgataatggcaaattgtaattgcaagtgccattttcagaataggcattggtttattttangaagaggataataaanttccttttagttat

SEQ ID NO: 8014 - DNA, 231 bp, Homo sapiens
ccatcatccatgaagaaaaggcactgaccatggaagtgatccgccaggtgaagggagacctggccttcctcaacttccagaacaacctgcagcagactccactccacttggctgtgatcaccaaccggccagaaattgctgaggcacttctgggagctggctgtgatcctgagctccgagactttcgaggaaatacccccctacaccttgcctgtgagcagggctgcctgg

SEQ ID NO: 8015 - DNA, 157 bp, Homo sapiens
  misc_feature (1)...(157): n = g, a, c or t
ctggtgttaatggcatgcaggcatatgtgatgccaaccatgagggctggaagaaccagaagccaaagaagaatatgaccgcatctattctaaagctactgtggtggtttctcatgcttnagagtctcntaagtctcctggttcctggtgctcaggcc

SEQ ID NO: 8016 - DNA, 262 bp, Homo sapiens
  misc_feature (1)...(262): n = g, a, c or t
ccaacatggtgaaaccccagctctattaaaaataatagaaaaattagccaggcgtggtgacatgtgcttgtaggcccagctactcgaggctgaggcatgagaatcgcttgaacccatggaggtggaggttgcagtgccactgcactccagtctgggtgacanagcaagactccatcccaaaaaataaaaataaaactctaggtggaggcttaatcttttctttaaatcagcttcttagagcactctanaantcatctgtaac

SEQ ID NO: 8017 - DNA, 288 bp, Homo sapiens
ctgttgagaatatactgtagggggtgaggatggaagtgagggtggtatttggaaggctagtgcaataatccaggcaagaaatgaattaaatggtttgagtagggtgaaagcagttgttctgcatgtattttgaaggaaaacccaccaagatttgctgaaagattaaatgtgaaatacaagagaaaaagagaaatcggccgggcatggtggctcacacctgtaatcccagcactttgggagaccgaggtgggtggctcacctggggtcaggagttcgagactagcctgg

SEQ ID NO: 8018 - DNA, 309 bp, Homo sapiens
  misc_feature (1)...(309): n = g, a, c or t
cgcgtaggcgagttggtctgaaagcccccggtatcattcctngaatttcagtgcgggaaccaatgcagactggcattaaggctgtggatagcttggtgccaattggtcgtggtcagcgtgaactgattattggngaccgacagactgggaaaacctcaattgctattgacacaatcattaaccanaaacgtttcaatgatggatctnatnaaaagaanaanctgtactgnntttatgttgctattggncaaaaganatccactgttncccagttgntgaagagacttacagatgcannatgccatgaag

SEQ ID NO: 8019 - DNA, 620 bp, Homo sapiens
  misc_feature (1)...(620): n = g, a, c or t
tttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgngttatcttttatgttgttgntgntgctgntaaactataatatgtgacttctttttttattattttttggttgaatgctttaaaaatcttttaagtctgtggatctgctgatgtacagngcctttgctgctatggatcaaa

SEQ ID NO: 8020 - DNA, 446 bp, Homo sapiens
ctggtgcttctgccttaccccatcctctcctctcagattcaccgaggactgttcaggtggtaacattctcttagggtagggaactctgcagagggagagctgaggaggttccggccatagttgtttgtaatcttagggctctgggcttggctgaaacatgacggtattgcttggtttcaggcttgacactgccaggcgcctattgcttgacctctgtttaaatgagggacttcaagactagacagcatggctcttttcagtttattgcatgaaggagttacactagtccaagttaaaagcggaccccaaatggttacattatacaagctgtgaggtttttaaacctgtgacaagggagagaagggaaattctactcattgcaaggaaatcctcacttaagcttcagtgagccacaagcacttaaaacccatgaaccttcagacctc

SEQ ID NO: 8021 - DNA, 609 bp, Homo sapiens
  misc_feature (1)...(609): n = g, a, c or t
ccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacaggatgcttgatgttgtagaaanctgggnacatataggataccaagcnnaaattataagaaaccta

SEQ ID NO: 8022 - DNA, 252 bp, Homo sapiens
  misc_feature (1)...(252): n = g, a, c or t
tcttacaggcagaaactcttagagctcacaaattggaaacaactgcaaacttcanagtaaattcatagcttccaaatacaaatgttcacattgtccctccgctatttttacacaaatgcattcnggtgaagacagcaacacacattgggaaaggacatctgcttcctattttagtcccanaatcacttttgcttctagtcccaactgttccctctccccaatcccaaccttatccatgtnacagtatgaatt

SEQ ID NO: 8023 - DNA, 342 bp, Homo sapiens
cctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgacgaggcccaagatgagccccaaaatcaggggcaaggtttcttccagttgctcccgctcatccactgggcatttatgctcttcactgaagacaaaatctgagataatgtcaaaaggttggatgtgga

SEQ ID NO: 8024 - DNA, 274 bp, Homo sapiens
ccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaagga

SEQ ID NO: 8025 - DNA, 178 bp, Homo sapiens
  misc_feature (1)...(178): n = g, a, c or t
ctgtttcatagtcattgttggtttcttcaggttgtctctttctgatggcaatcatttgacgtccaggtggctcaaattgggcagccttcacaggatcagtggaattggctgaaatccgctttttcctgcantanatcaaggccactacancagcaacaatggccagctacannaatcc

SEQ ID NO: 8026 - DNA, 321 bp, Homo sapiens
gggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctgg

SEQ ID NO: 8027 - DNA, 241 bp, Homo sapiens
ccaagggtcatgatggcaggagtaatcagaggtgttcttgtgttgtgataagggtggagaggttaaaggagccacttattagtaatgttgatagtagaatgatggctagggtgacttcatatgagattgtttgggctactgctcgcagtgcgccgatcagggcgtagtttgagtttgatgctcaccctgatcagaggattgagtaaacggctaggctagaggtggctagaataaataggag

SEQ ID NO: 8028 - DNA, 428 bp, Homo sapiens
ctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttgg

SEQ ID NO: 8029 - DNA, 383 bp, Homo sapiens
ccatggacaagctgaggaagatgctggttccctgcccacagacctttcaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacag

SEQ ID NO: 8030 - DNA, 529 bp, Homo sapiens
  misc_feature (1)...(529): n = g, a, c or t
cgccttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggntccccaaangat

SEQ ID NO: 8031 - DNA, 382 bp, Homo sapiens
ctggagtgaaggctggatacactaattcttttaaacaagtgcccattatcacattttgcatttttgagtgcttctgagttgaaaattaaaaccatgaaatttgaactgcgttttatttttcacctgctgaaagaacaggatcctacagcaattaaaaaacaatcacataacaactatagctacagtgtgctgtttggtttgcctgtttatgatttaaattttgtgaaagtcaatacttgttttgaagatttttttgtgaacaataaaccactgaaattggcagaaactgatctgaataatatatgttcttagtatagttctttctctctttttttgttgaagttttaaacatgcagtagttttgaaaaatgtaaggaatatc

SEQ ID NO: 8032 - DNA, 508 bp, Homo sapiens
  misc_feature (1)...(508): n = g, a, c or t
ctgccgctgctcgttgttttttctgcaatgatatttgggactattacaaatcaagatctgcctgtgattaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtagaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttanaaaaatggaaaaccagg

SEQ ID NO: 8033 - DNA, 394 bp, Homo sapiens
ccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgacgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggc

SEQ ID NO: 8034 - DNA, 550 bp, Homo sapiens
  misc_feature (1)...(550): n = g, a, c or t
ccttggtcctagcacccactcgagaattggctcagcagatacagaaggtggtcatggcactaggagactacatgggcgcctcctgtcacgcctgtatcgggggcaccaacgtgcgtgctgaggtgcanaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtgga

SEQ ID NO: 8035 - DNA, 337 bp, Homo sapiens
  misc_feature (1)...(337): n = g, a, c or t
ctgtttcatagtcattgttggtttcttcaggttgtctctttctgatggcaatcatttgacgtccaggtggctcaaattgggcagccttcacaggatcagtggaattggctgaaatccgctttttcctgcagtagatcaaggccactacagcagcancaatggccgctncagcaatcccagtgaccacagccacaatgatccccatcggtgaagagctgggagcttggacagtgatggtcacaggcttggatgagtacagcgtgtagcctatgtttcctgtgcagtggtaatcaccactgtgactgtggtttgcttgtgggatggagaagttgggatc

SEQ ID NO: 8036 - DNA, 449 bp, Homo sapiens
ctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 8037 - DNA, 383 bp, Homo sapiens
ccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacag

SEQ ID NO: 8038 - DNA, 626 bp, Homo sapiens
tgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatga

SEQ ID NO: 8039 - DNA, 388 bp, Homo sapiens
ctgcttcaggggaaggcttgtggcttatatctattttgttgtattcctctagttcaacatgtctgcccccacccttacttctaacacctctgcccactccagtattccctcagaacctagcctggtaacgaatatatggacaattaaattacatcccaacatcattcatactttaatatataagaaatcagagcagagaatcagggcagccagtccctgaaggaaaagtctgtgacaaatcacaagtatgatcacagcacgaacttttctattctagcctggcctctaggaagaaaacagagagtgttaccggacttagggggaaaaaggacatgcttgatgaaggacagaaccccattgttctccacatttcctggctcacagaagg

SEQ ID NO: 8040 - DNA, 198 bp, Homo sapiens
cctgaaatacgttcagcacacctacaggactggggtgaaagtggataaagcaacatttatggttggcagctatggacctcggcctgaggagtatgagttcctcactccagttgaggaggctcccaagggcatgctggcccgaggcacgtaccacaacaagtccttcttcaccgacgatgacaagcaagaccacctcag

SEQ ID NO: 8041 - DNA, 344 bp, Homo sapiens
  misc_feature (1)...(344): n = g, a, c or t
gttaaacactannttaaaaaattttaaaatgaatgatgccacatttctatataaagaaatgagcattattaatccctgttgttgtaaaacatcattgaaattgtatgctattctctttatataaagtcattctaattatgtcacatgttgaagatgtaaccaaactattataaaggctgcttatccattcacatattgaatagattaagtttgggttttttaagattgttaatttgttattttctctttcctctagtcaaagtgggaaaaagcccaccggtgaggggctccctctctggaaaagtcagcctaccttgnnatttttcaacgatgcatactttgcc

SEQ ID NO: 8042 - DNA, 480 bp, Homo sapiens
ctgcagatgtgctggctcctgagggacccgggggcttactctgctcttgggacaccttattccttttggcttcagtcttttctttgtttggagtttttcttttctgagctacaggaatcctccctcttgcttccgatgtcagtttgtttcttgcggtgggtgcaggtgccgcaagacccacttcttcctggtttatttttttcactggagctttttcttgtgttttaattttcttagcaacttttgacttctcttttcgaagattgttaacaaggtttttaagtgatggcatatctttggcaagttctattagtttgtctagacaggcaacgccttggaactttttttccatcaaatctgtaatcttaattctgttgtattcctcttgcatttttgtagttagtcctaaatcataggccagtaaggacttaattgatgtaaaatgataatcatccatgagctcaaatcctttcagcaaaa

SEQ ID NO: 8043 - DNA, 549 bp, Homo sapiens
ctgttttcctgttggaaagagctctttgatggacccctttccatccacccttattaggtagtagtctctcttgaaacccacacagatagaattttcacaccacgccatggacttgggcacatctggcacactaaagtccccctgcaattcatgaaattccctgtccttccagaaatagagctgcagcttcttttttactgccacacacatccgtaacacctcctcaccggtctctgtgtgctggaggtcacaagtaaacagtgatgctccctttgcctttgaaaccgtagtgatttgttgaaatgtcaataggtcatggacataaatgttattttctgtttgggaggaggtataacatcaggatcaatgatcataattctctagcatagccactatcgaggcaaaaaaagtaactgtgttaacatctagaagaagcaaatggcagatgttggttgaagatgtcccttcagtttcactaggatgattcattctcacctataaccagtacaaagcatttaagaggtcacttggtcttctaaacttggatat

SEQ ID NO: 8044 - DNA, 444 bp, Homo sapiens
ccagttttgaggatcagaggaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcagg

SEQ ID NO: 8045 - DNA, 258 bp, Homo sapiens
  misc_feature (1)...(258): n = g, a, c or t
gaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttanc

SEQ ID NO: 8046 - DNA, 496 bp, Homo sapiens
gaaatttttccttaagtgtctggtgatccctggatttctgctcataattaaggaaaagaatgctgactcactggacccaggcagggcttctctcccagattgcaggcttgcctcggggatacacgggtttcccaaatgctagaatgaaaagagattttattttggcttgctaacatcaaagatactagtttctccagatggtttattcagaacactgttgtcttatttttatttgtctgagattaaatgtcttcccctttaattaaagggaggtctctgatgaagtaggtttgggaactgctaccttggtgacagcttgagtctttcctttagtgaagtgcagcacaattccacgtgctcggtgaccttctcttgattagggtgccttggaatgtacagaacctaacttgaatatacagcactggtttcttggataagaagtgtacagtgatctaaacttgcaaaccaaaatacagagatgatgggaccaaaaatt

SEQ ID NO: 8047 - DNA, 605 bp, Homo sapiens
  misc_feature (1)...(605): n = g, a, c or t
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgatatatcatgagtgattccaactatgttgtcaggggcaatgncccgtctgcctgtaaaatggatggcccccgaaagcctgtttgaaggcatntacaccattaaga

SEQ ID NO: 8048 - DNA, 341 bp, Homo sapiens
  misc_feature (1)...(341): n = g, a, c or t
cctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgacgaggcccaagatgagccccaaaatcaggggcaaggtttcttccagttgctcccgctcatccactgggcatttatgctcttnactgaanacaaaatctgagntaatgtcaaaaggttggatgtgg

SEQ ID NO: 8049 - DNA, 390 bp, Homo sapiens
ccttggatgcagatcaatgctccaataaagttcattatcagctcctcctgccttgtgacaggatgatttgattttacaaaagtccctttgaaaacaagagtaaacgcagacagcttctagagaaaagtctggtgaagcagcagttgataatagattttcttttagtgatgaaattaatcttgttttggtaatctacagcctgttagggataggtggagggatgaagtccttaaaactaaattgttcctctacgaatcttcgacctgagcctgcggagagagtagccccaaatccatctctctgctgaaaggtcgcctgttttggtaggtgtgaggacattccgaaacacggccatccacattctgatacatcgcttcttctgcatctgcc

SEQ ID NO: 8050 - DNA, 630 bp, Homo sapiens
  misc_feature (1)...(630): n = g, a, c or t
cctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcatcatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccaatcaaggatggatgcagatccagaggtttctggcagccagtacctcctgccccatgctgcccgcttctcaccctatgtgggtggggccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagnaaccagagctcananaggctagatgattgattac

SEQ ID NO: 8051 - DNA, 553 bp, Homo sapiens
attgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagacttt

SEQ ID NO: 8052 - DNA, 317 bp, Homo sapiens
ctgtgttggactcagggttcagagctgccagcttggggtacctgggagggcacagcactgcctccagaaattcctcaatcttgttggtgtctgtgtgcacttcagtgccatacagcaggaatgggagctgcccccctgggcacagcttctgcactgtctcggtccgccttttggtgtcaacggtggtaacattgaaggtgactcccttgagccacagtaccatgaacagtctctgggagaatgggcagttcccaatcttggccccatcactgccagccttcacgaacaattcgacctgcggttgttcttcagccatg

SEQ ID NO: 8053 - DNA, 386 bp, Homo sapiens
  misc_feature (1)...(386): n = g, a, c or t
cgagcggccgnccggcaggtccaagatggttggggcataccttggttttatacattttagggagacataagacattaatcaatatatgtaagaagaacattggttcagtggggagggagcttccaggtcacagataggtgagacacaaacagttgcattcttttgagtttctgattagcctttccaaaggaggcaatcagatatgtatctatctcagtgagcagagagataactttgaatagagtgggaggtgggtttgccctaagaagtttccctaagcttgagttttccttagtgattctggggccccaagatattttcctgtcacagttgacatccccaacacagtgtttagggctcagaaaaagatncccctaaaatagggt

SEQ ID NO: 8054 - DNA, 414 bp, Homo sapiens
  misc_feature (1)...(414): n = g, a, c or t
ggatctgggagtnncttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtanttagcntattttatgnaccatggttatatgattaatcttgggacaaagaattttatagaaatttttaaacatctgaaaaagaagcttaagttttatcatccttttttttctcatgaattcttaaaggattatgctttaatgctgntatctatcttattgntcttgaaaatacctgcattttttggtatcatgttcaaccnacatcattatgaaattaat

SEQ ID NO: 8055 - DNA, 367 bp, Homo sapiens
  misc_feature (1)...(367): n = g, a, c or t
ccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgnctctctcacattaagggagtaggaattaantgaaag

SEQ ID NO: 8056 - DNA, 513 bp, Homo sapiens
ccaagggaaactgtctggattggattgtcgaggttttcgcttttgtaaagcttgacccataatgtaggaaggtattcagaggaagtgatcacatttccacttaaatcaaattgattaatctgccggaaaactatgatgtttacatcatcgatgtcattattcccaacctcaatcaccctatggtgggggagcgcccgctcaatgtggtcgttgccttctgccttgagctgaacgtggtacacacatcccggcagcaatccacgtaatctgaacttgccctcttcgtctgtcacggtgtcttctccgtaaatgctgcagtcgttctggcccaccgcttccatggcaaccccttgttcgggctctccgtttaaggaagacactgtgccatagcaactgtaagcggttcggtaccccgtgatggtgatcttcaggttctggccttcctgcacctcgatcatctgtgaggatggctcaaaccggaactccttcatcatgggtttgaagtaatactgg

SEQ ID NO: 8057 - DNA, 452 bp, Homo sapiens
  misc_feature (1)...(452): n = g, a, c or t
ctggtgaactgaatgngagtcacctntnttccagttgctttttcttttttatttacaatgntcaatttctgaatgatgtaatctggacatcttttgngctggttgatctttacaacaacatntccaaaagcccgagtgccctcttccattgacggccagnattctgcacacttgntcctgtttccttcttcacatcgagtgaccatgacaataactgtggctttctgttcccaaatcatcctccagaaatcatcaacagtttcatccctgggaccttgtgcagcaatgtatttcctgggttctttgaaaccatcaatatagctggcatttatgtagtttgaccctgcatctccgtttatctcananagttcaacacggttataatcataaggaagaatgtcaacataacggtttttattctggttaaagggctttcgagcttcctttatagg

SEQ ID NO: 8058 - DNA, 190 bp, Homo sapiens
  misc_feature (1)...(190): n = g, a, c or t
ctgggacnacnggcaccnnccaccatgcctggctaaatttttgtatttttagtagagacagggtttcactgtgttaaccaggatagtctcaatctcctgacctcatgatccgcctgctttggcctcccaaagtgctgcaattacaggcgtgagccactgcgcccagcccaaagtggttaatattaatatg

SEQ ID NO: 8059 - DNA, 328 bp, Homo sapiens
ccaggaagccggccagttgagttagaaaacatctctctttgaggtttacgaactgctgtttgttctctgccaactgggggcgcaatttctcgttgatttctagaatgttcatctctgccttctcgttggaccaagggccggctgataccaccatgctgacgtttgtggcagaagaggtggagtcagggacttactgttgtgaaaaatgtgatcactcccacagcactttaggatccttcaccacaaaaacaaggttcgaggtgcctcaactcagagctgaaagcactgccagtagctcagactctgataagagtgaggtagattgtgg

SEQ ID NO: 8060 - DNA, 294 bp, Homo sapiens
ctgggcggatagcaccggacatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggaacagctcgtacacttgccattctctgcatatactggttagtgaggtgagcctggcgctcttctttgcgctgagctaaagctacatacaatggctttgtgg

SEQ ID NO: 8061 - DNA, 549 bp, Homo sapiens
ctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagagg

SEQ ID NO: 8062 - DNA, 515 bp, Homo sapiens
aagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggcgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaagg

SEQ ID NO: 8063 - DNA, 457 bp, Homo sapiens
  misc_feature (1)...(457): n = g, a, c or t
cctttgaaaggtaagttctggcaggaggaacagtgtatctgtggcaactttgtttttccttattccattttatgaagactcagttctaaatgtcagccatgttaggaacttcataaatggagctatttttggtcattactatggaaggacctcttttctaagaagccataaagaaaagttgcaagttagtcacagaagttttggattgcctgtagatttctttatgataggaaattagtgagttaatattctgtttattttctgacacagatttttctttgataaataaaagactcttattcattaagatcagcttcttgttctgtttttcttggagtaaataactgtgaatttgggtagattgattttactttgttcagtttcctctgtaaaatgaggattttgaactgtatagtcaaatatactctattcattgntgaagtaagaaatcttatgc

SEQ ID NO: 8064 - DNA, 193 bp, Homo sapiens
  misc_feature (1)...(193): n = g, a, c or t
tcatcaatggagaaacagagtctgagtggggttaaagaacgggcttcccaatgtcacacagtggtgctagaatttgaagcaaagtacgtcagattctaaagccacaatctttctacactttcaccccaaaatgaggagtaagaatgaaagtgacactgtggatttaaggaagataatagaaagtntattanaa

SEQ ID NO: 8065 - DNA, 447 bp, Homo sapiens
ctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagat

SEQ ID NO: 8066 - DNA, 145 bp, Homo sapiens
gtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttagg

SEQ ID NO: 8067 - DNA, 436 bp, Homo sapiens
  misc_feature (1)...(436): n = g, a, c or t
ctggctaaagntcaanaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatacagttgaattatttgaaattncagnaaaagaattaacatttgaccaactncagttgttaaagctcactcatgtgactgcactgaaatctaaggatcgaaaagaatctgtggttcaggaggaaaattccttttcanaaaatcagccatttccttctcttaagatggttttagagtctttgccanaagatgtagggtttaacattgaaataaaatggatctgccagcaaagggatggaatgtggggatggtaacttatcaacatattttgacatg

SEQ ID NO: 8068 - DNA, 454 bp, Homo sapiens
ccaacacccacttctctggttgtataagacagggacctaaaaagggaaaggatgggaggaggatcatcctgcagtgatcatgtagggcttcatgctataaatggttttgcatttccggagatgaaacaagtctcttcaccacagaactactgcagatcatagccctatggtctggctggttttgtcaatctggcagttcagggtcagtgcaaaggacatccccaacacctcaatcacacatacacagatggtgatgattccgatatacaggaaattggaatgaagccacagtcttgctttcgcatagcaaccctccacttttcgatctgaggggcaagatgctggtgggccactggtccaatcactcgtgccatttataccacaacactgcagaaatgactggatggagtcccacgctgccttggtgctattgtctgagtggtaacggtggatg

SEQ ID NO: 8069 - DNA, 449 bp, Homo sapiens
ctggagagtgtagatcccaaaaattacccaaagaagaagatggaaaagcgatttgtcttcaacaagatagaaatcaataacaagctggaatttgagtctgcccagttccccaactagtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 8070 - DNA, 513 bp, Homo sapiens
  misc_feature (1)...(513): n = g, a, c or t
gtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctancactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataa

SEQ ID NO: 8071 - DNA, 447 bp, Homo sapiens
ccagcagaacacagagtggattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgtcttgtacgtagtagcaactcagtaaatactttttgaatgaactagtatagtattttaattagctagtcttcatgtactggtacaaaagaacagtgtcatcttacag

SEQ ID NO: 8072 - DNA, 442 bp, Homo sapiens
ccaatgtctgttaaccattaactctcttcatgattgcaccagttagaccatttgccctgatggggggaaaaagaagaagaaaaaacaaaatagaagaaaaaaagtgacaagagaaagcaagctgctaatggccgatcccaacacactttctgggagacagtagatgaaatcacagcacagtgaacacatgctgcctaaaatcagccttgttggggagtaatcccaactgccacccccaagacacagggtccagtccacttatctatagtctgagatgttcaccaacaaaaatggattaaagaatcttggacacaaagggccagaagaaaaagcctgagatgatcggttctgtgatttgttgcagagtgataaagagtaaatggtgagtaagtgttgtgtccaaaggtggagactccatagtcggcagacaggagagggatgg

SEQ ID NO: 8073 - DNA, 595 bp, Homo sapiens
  misc_feature (1)...(595): n = g, a, c or t
cctcctcgaccaaggcagggaacttcaatctgtataagtatctgcagttgctggaataatttgaagaccccatggagctaaggagattaagtggaggattttcattgtttcagaggggcaaggggcaaatccattgctaattctttaatgatgaaaaatggtaagaagttgttaaactcctttggggattttaaaaagtgatacgtaaacagaagagagagagagagagagaaatcacagtagtgaggctaacaaaaataatgataaaaaggttagaagaacccaggatacttagtggatgcctagacaacataaaaatagatttatagaaggaagcaatggaatttgaatataaaagggtatcagaaagttaatgtgttgcatctgaaattcaaagtatttccttttggctacacaagaaagacttttaataaaaccctttgtatatatttctgaaaggnaaatattttatagggaaatggaggattggaagaaaatctgttccatcatgtctgggtattagaattttgcttaataacttgccaaaatattacgcttccaagggctatggcattatgtgtgtacccaattaaag

SEQ ID NO: 8074 - DNA, 231 bp, Homo sapiens
gaaaaacaagatggagatccagggcaaccccaaataccgcgccctctctgagcaaggcgtctgcaccctagagatccggaaaccctgcccctttgattctggggtctacacctgcaaggccataaatgtgctgggggaggcatctgtggactgccggctggaggtcaaagcctcagccgcacactgaagagtcacgggaggaggctgtgatgaggagccaggtgctgcagg

SEQ ID NO: 8075 - DNA, 291 bp, Homo sapiens
cctgttctggaaatggcaggtcacagcagcgggcagtcatgttgtggatcagcccaggaatatgtttatgcttggtgagaactctttggtttccacagaggtggcccatgaggttgggggtgactcgaccgatgtcaatggtcaagatgtcccggtcatagttggggtaaggagcccgacgggcaaagcactcatcccgagtagggctgggagggtggcggcaacacaagtggtggtgggtcttcacagcatactcccggtcacagtatttgtcaagggtatcctcccagg

SEQ ID NO: 8076 - DNA, 504 bp, Homo sapiens
  misc_feature (1)...(504): n = g, a, c or t
ccacatcttcgaacaccgggtcaccagtgaggctgctcagggtggcaaattcaacaatgaaggtcccaatccctgccgtacaggtgacaggggtctctcctgggttcacgccatgaagtaagttcactgttccatatggcatgccagtgggggtctgaaaggctgggaggagttttcgggccgcctcctcagccattctcaggagaggcccggaacagggccatccagcctctacttccaccccagccttcttggagagcagatgagcagacaggagtcctcctaccactcgaatgtttgtttcaaacacagaggcgttcacatcaatatcaaagtccacgctgtcctggagcacttcaaccactctttggaattctgagacattccccaaaatcagcaaggtgtccagtgcatcaattagagtcagagaaaaactgccccaggtgtcgtgcccgtcacaggtgagaggtcgcagctcatcgaagggaaaggcatnctccaggt

SEQ ID NO: 8077 - DNA, 427 bp, Homo sapiens
  misc_feature (1)...(427): n = g, a, c or t
ccagggggaattgagggaggctctaagctaggggcactgcatggtgggacaggatggccccttgaggactgaaccctggggagaagacaaacagtaataataaaaacaaataacaagtactttaagaatggattgtatgacctatagtgacagatgacatcactaatactgaaagcttcttatattaataattttggcaaaatgtcattttgtaatatagtatatgctttccaggtgtgggggtggtaaagtaatgaggccaaaatcatcctgccccaagactaatatcttctaatggtgcattancaaggaaggcagaaatcaatatttagatatcagtagagtacataatnctgtagaaagaagaagagcacacatgagacaganaaggaggtggatgctcctgngttgagancaaggngtgggg

SEQ ID NO: 8078 - DNA, 370 bp, Homo sapiens
ctggcagaccccccaaccacatcagaggagttttcatttcttcctgggctgcttatctgggaagccttcaaagaattcgttacacatcatggcgatgcaggacaggaagacacagtactcttggaagtccacctcgttgtccctgttgctgtccaagttgctcatcagcttctggaaagcagcttcatctgtccttttccccaagaagctgggcagctcccgggtcagcagctcctttagttctgacttgttgagcttgaacttgtcaccctctttgcccgagtacttgtggaaggtggacaccatcacatccagggccttctccagagggcacgccatgacagcagtcaggatcaaaccaagaaagaag

SEQ ID NO: 8079 - DNA, 582 bp, Homo sapiens
tagtaaaataattttatttagtttcttattttaaaaaaggtagcatttcaacatataaatttagactcaagattacagtgtatatttgccaaaaggaacaccccgaaagacggccagcctcagagctgagagggcacagggaggcacactcctcacacatggagtttaagcagaagtgctttaagacttcacagcggcatttccctgttcctcagccccgcctccagggccatcactttggggcaacagcttttgctcatgtaactataaaacatctctaggaatgaaagcacagaggtcaatgatccagattttccacaacaatcatctgcagcaacaattcgacaggtaaagattttatttttataattcaaaagttcttttaaggagaactaaagaacacaaaattcatttataaagagaatttatagaattaaatgagcaaaaatgaaaaattattttctccatattacaaatgcctctataggataaggcccaggggaaagacccattcaaatctgggctttcctttcccaaataaagtgtttggcacaaccaacaaactgtcatgagactgacagg

SEQ ID NO: 8080 - DNA, 604 bp, Homo sapiens
ctgcaccattttgcattctcgctagcaatgtgcaaggattacagttttttcacatcctcgccaacacttgtcttttgtctcttcaacaaatggtgttgggaaaacaatacccacattcgaaagaatgaaattggacccttatcttatgtcatacacaaaaatgaactcaaaatggatcaatgacttaaatgtatgacccaaaactgtaaaactcctaagaaaaaaaaacaggagaaaagctctatgacgttgatcttggcagtgacttcatggatatgacaccaaaagcacaggcaacagaaacaaaaataagtaagtgggactacatcaaactaaaaagcttctgcacagcaaagaaaacaatcaacagagtgaaaaaaacaacctacaaaatgtaagaaaatatttgcaagtcatatgtctgaaaagtagttaatatccaaaatatataaggaactcctacaacacaatggtaaaaataaatgaacaatttgattacaaaatgggccaaggacttgaatagacatttctccaaagaagacataagaatgccaacagctatatgaaaaaatgcttggccgggcccagtggctcacccctgtaa

SEQ ID NO: 8081 - DNA, 151 bp, Homo sapiens
ctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaac

SEQ ID NO: 8082 - DNA, 482 bp, Homo sapiens
  misc_feature (1)...(482): n = g, a, c or t
ctgtggcgagtccgtcctttctttattctggcaggcttnggtttggggatgtactgattatttgcctggtactcgagttctttacggaagtagtgaattgctttgtttaaaccttcctccagcgggaccacgggctcccaccccagcatcagctttgcttttttgatgtctggttttcttttctgtgggtcatcctgggcttcggagagaaactgaatttcacttccgctaccaacaaggtttttaattaactgagcaaattctaggattgtgtgttcttctgggttccccaggttgaccgggctgctgacgttgctgttcatgagagccacgaggccattcactagatcgctgacgtactggaacgcccttgtctgagacccggatccgtataccgtgagtggctccccctggagcgcctgcaggatgaagttgctgactactcgcccatcgttcatgtgcatgcgtggcccaaaggngtt

SEQ ID NO: 8083 - DNA, 558 bp, Homo sapiens
ttctgctctgtgagttaccacacccaggattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctgg

SEQ ID NO: 8084 - DNA, 373 bp, Homo sapiens
cctgagctcatcctgagctagtgatgccagtgtccagagcacatggagtgaccctctgagtgccgagtgcttaggcagagctgccgtgctctgaacttgagctctggtggggctcccagctccatcatgcatggtgactaggggaaagatggggctggcccaggactcatgctgaaagagaaattcaatctaacaaggcccatattaattatattaacccgggaaatatgatgatgagcaagaaaggagcttatgattcattttatgagaaggataagctcccaagtcattacagcataggaagaactctagagccacaagagatgcttcctgatgtcagggggttggtgaggagaatatcatgccaagctgg

SEQ ID NO: 8085 - DNA, 610 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgatatatcatgagtgattccaactatgttgtcaggggcaatgcccgtctgcctgtaaaatggatggcccccgaaagcctgtttgaaggcatctacaccattaagagtgatg

SEQ ID NO: 8086 - DNA, 468 bp, Homo sapiens
ctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaagagagcagatttactatgctgggcctgtcaataatcctgaatttactattcctcagggagaataccaggttttgctggaactgtacactgaaaaacggtccaccgtggcctgtgccaatgctactatcatgtgctcctgactgtggcctgtagcaaaaatcacagccag

SEQ ID NO: 8087 - DNA, 387 bp, Homo sapiens
ccaggttgggatgcagagaaaaacaggcaggagggtgtcaatctatagcatcctgaaccccaaaaggtctgtaactggattctctaagccttgagaagttcagaccaaagcttcagaccagggaaaatattttggaaagatcagtctttccaagattgagctcctttccaagaagctggacaggaaacccaataaatgtggatctgaaaaaacaaaatccaagagagaagcaaaatgggctgggggtgtgcaataagagaagcaaggaaaatggaaagactgtagctgaggatcttttattaaaaaaaaatggatgggactttggtgatgagagagaaaaagggcaaaagtctgcagttaggaatttaggtgaccgaagactgtcct

SEQ ID NO: 8088 - DNA, 386 bp, Homo sapiens
ccaggctgaggttccagatctgttgccatcatggccccttcagggtcctgggaaattcctggcttctcctaaatcagggtgaactgggcctccaggatcaggtctggagcaggcccaaatatagtcctggatctgcctggattaggtgccaatgtctgagtctgggttccagatcaactccagaccccaggctggatctggccccatttgagttctgattccccttggagctgggctctgggccctgggccagcatctatccttgtgtggcatctgtcctgagctggtcctggggcaccatgcatagttagtgttctttgttggcccaccagggtggggctgtccagagctgccaggtcttaactccccaagttccaggttcttag

SEQ ID NO: 8089 - DNA, 560 bp, Homo sapiens
tcgagcggccgcccgacaggtccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgcct

SEQ ID NO: 8090 - DNA, 337 bp, Homo sapiens; identical to SEQ ID NO: 7576

SEQ ID NO: 8091 - DNA, 604 bp, Homo sapiens
cctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgct

SEQ ID NO: 8092 - DNA, 555 bp, Homo sapiens
cttcatcctaattgaggtgatacaaaatataagaatattccttcatcctggggcatcatgtggtcatctgagagctcatttgattacattaaaaatcgtgttccttagagagagagtgccagtatttagactttttgagtgtgaatcaggagggaaacacacatccattgacaagaagatggatataattatttttaaaaagagtgatttgatcctttggaggaaaataaattctggtggaccttctaagtaactgctagaatgattgggtaatgtatacagcttttgcttctccataaataatgtaagtattaaaaaggagattttaaactagaaggaaggaatctctggagtgagaggaaaagtttaattgtatttcagtatctatgtctatgaaaagttgatatacggtgtcactgtggtatacccaaacttgtttatacacatgtataaccagtacacagtaagtaccatgagtggcttttagtgattttatctttttaccttgtagtacagtctccctggtgtctcacaaggctagtttacttactttgg

SEQ ID NO: 8093 - DNA, 564 bp, Homo sapiens
  misc_feature (1)...(564): n = g, a, c or t
ccaatatgcctttggagcacagcctatggtttatgtttcttttatgaccacctttaatatctgtcaaacgactagacatgctatagctttacccgaaggtaatttgattgactgtgctctgctagaagatggtgtatgggtctctctcgaggtaactgccaataaatgataagtggtatttgttttagataatgcctctacctcagtggtagctttgataatggcaaattgtaattgcaagtgccattttcagaataggcattggtttattttaggaagaggataataaagttccttttagttatcaaagtaacaccttttattgttaaatctcaacttttgaagaaaacactttcaatttcttaactttttcctcagggttagtgagttagtacaactacccaaagaagtgttaaaatattgagattctatatgtgtgtgtttatatgtgcatctatgtattacgtatacaaaatatttcacctcaaaggactttttgaaaaggtaatctttggtctatagtacagtgttaagctcactgataatttanaatcattaagttcg

SEQ ID NO: 8094 - DNA, 556 bp, Homo sapiens
cctttgaggattggaataagacagagctagactcattcctgattgaaatcacagccaatattctcaagttccaagacaccgatggcaaacacctgctgccaaagatcagggacagcgtggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagacctcggcccgaccacgct

SEQ ID NO: 8095 - DNA, 212 bp, Homo sapiens
cctggctcctctttcatccttggtaaagagctctggggggtttccccagaggagcctgtccctctgccccaaatcctatcatgctcccttatgaccttctttccagaccccctgagtgccgatcccacctgtgaaaggggaggagcagatctggggaagggatatgcccagaggaaatcaacaagaccaaagagacgtcagagtcctgatgg

SEQ ID NO: 8096 - DNA, 566 bp, Homo sapiens
ccactgtgaaaaaacaaccccctcaaaacttcaggagaatgtatataataaatgaaggtacaatttcataccttcacaggattattgagaaggtcaaattacataacagatatgaaagcactgtgtaaactatgcggactatgctgcaccaaataactgtaaagaattattaactagactgtaaatgccttgagggcaaggaatgcatctgcaacgggtatttgtgaagtacttgacagtttgctaaggacttctgtggattttcctcatatgctactcataacaaccctggaaggtaaggggaattgttatcccaaattccaaataaagacactgcaggtcagacatcacacaggtggtaaatagcaattctggtacttactttagatattctgctacaggcttgctattcaaagtgtggtatgtagaccagcaacattgactctctgtgctatctttcttttttataaactcggaattatttcaaaataagaagtttctaacaaaagagattcagaagagtcaaacccttgggtgtgaaaaagttttaggaagactttcctgaa

SEQ ID NO: 8097 - DNA, 136 bp, Homo sapiens
  misc_feature (1)...(136): n = g, a, c or t
ccccccccttttttttttttnttttttttttttttcgcattcaacttaaangcttttattgacaatgtctnggaacnataagcaaacaatgcttaaatttttnattcaaattnactttccacatgtcaaaanacct

SEQ ID NO: 8098 - DNA, 431 bp, Homo sapiens
ccacttcacatgatggcgggcctttaagagcacaaagaagtttaatatggacaacaacaggaaaaagcaagaagaaaacaagtagggaaaaacagctaacctggagagaaagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctgg

SEQ ID NO: 8099 - DNA, 590 bp, Homo sapiens
gagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatag

SEQ ID NO: 8100 - DNA, 601 bp, Homo sapiens
ccatcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgctacatggaaggaaagaaagaaaaaaagaaaacacacaatattacttgctccataccctaaactgccgataccacagccgtaaaatgaaggtgtctagtagttgttatagcacggtagtccattctttctaaaggaccactt

SEQ ID NO: 8101 - DNA, 594 bp, Homo sapiens
  misc_feature (1)...(594): n = g, a, c or t
tctaaataagaaaataaataaataaaattccagctaggtacatattcttcttgggtacaaagctcaagtcaactatcaattacataattgtaatactattacttgaatcagccattaaaaaatgctctgaatttattagtaaagagctatgaagaagagtcatttgtaatatcatacaaaaaaaaacaaacaaacaaacaaaaaaaaacatgcttttaccaacctgggctgagaaaccacagaagaaaccaaaccagaaatgcacaagtgtaaatgcaaaattcttatagaagaaatagcataagaatttgtacattcggaaataagaccaccttccatgaacaaggagaagcctttggagatatctaaactgtgcaaatgaatagtcgctggctaagactgcttgcaatccttcctggccgctgatgccaacaccaatgtgagcacctacaaaggaaagaggaacactgtcactcccaaaacaaagccacgatctcttttggaaacttgncattcctcttttatttacggaaaacttacagccattgnaattataatttttcacatatattatctgatgaaacacttatgata

SEQ ID NO: 8102 - DNA, 428 bp, Homo sapiens
cctcagttttttctctgtgcatcaacagtctacatatcaagtttgatgagtacctctgaaaaaatatcctaacacttgcagcattggagtcatgctagaatcttttctgcaataaagtattttcacttcttttcttcttctcaatcttctcaatcacctgcccctagaatctgagtggtcctaacctagacctcttgctggccgagatttagacaatgtggttgtttttccttatcttgactaatcttcccgaatcttacattgtgccttaatttgcacatctgcacctctaatgtctgcctatattatctccttggctcacaaggaccttgtgggagagctgctcacatctcaacatgtaaataaaatgtgcctttgggtcaacacaggagaggtgattccaacgttaacaagttagtcaaggaaac

SEQ ID NO: 8103 - DNA, 401 bp, Homo sapiens
ctgaattggcaaagtaaggtttactacacaagcccctctttttcttctgatatccccactcaaatggaagcacactccccagcacatggggatcccttattaatctttactaaagaaccgtgaaccagcattttccagttatcaactggatatttaggcatgaatctggacatgtccatctgcttaagaaatctgcttaagaaatctgtaacagctacaggaaaagacacacccagggccagagattctacaaatgccagaagagtggatgtgatagagaattttttctcaagttttgggttagggcaccagttgcaattttaatccaggggaggatctgggctgctgctgtagggggcaagtacaccagggaggtgggtgtggacagaggcactgggcag

SEQ ID NO: 8104 - DNA, 530 bp, Homo sapiens
  misc_feature (1)...(530): n = g, a, c or t
cctcaggaaatgggtagaaatcacaggacaatctctcttcccaccaaaaaaaagttgcatattttggtaagtgtttgtcctagagggaaaaacaactgaaatttacattagcagtgctgtgcaagattcttacataattcaagacctaaaaccagcctgcagtggaggtttcagtcctctgttcaggtgcttagacagaagccataagctgatgagcatgacagggaaaaggaggcagtgaagacaggtgacaggcacctggcagggaagaaggattcaggaatgccagactccttgaaatcatgtgggttttttttttttttttccttttaaagtcatctntataggaaggtgctgggcagggatcccagagaaagaaagggtccaagactccattaactgccctggatgaagggcactgctacagcagctagtaccananactctcctatctcacggttgaggcagacccaggatagaatagagaataaaaggaatgcttataggaaacaattttgtatggaatgcta

SEQ ID NO: 8105 - DNA, 603 bp, Homo sapiens
cctcagtgtccaccctccacttccaacccaggaccataccaggtgaagtgagatatgaagaagcatatggtctctttgtacatctgcctcagaacttctttccatcttccaaaatggagagaaaacatgcctaaatggtgccagcatactagctggtaatgaccacattagaacagcattgctactttgacttagtgacttacattttgcttcagttcctcaaataagcattgcgtcttctatctctgacttttctgtcttttctcaatttcaatctgtcaaaacactactcgacctataagacctagtatgaatgttattagatattccctaataacctcagccagaagtggctatacattttttaatttctatatcttttgtttatttttttagaacaccgtatcatatgactattgatatatattattttcactatctgacagtggaatcctgagtacagggtaatgtttgatagatctctatataacctcacaatttaaagccatgattgcaataggggctcaataaaagtttattaaattgataaatttactgaattcctaaactattatacaatcagtgtatattttacacagtgaa

SEQ ID NO: 8106 - DNA, 111 bp, Homo sapiens
  misc_feature (1)...(111): n = g, a, c or t
ttttttttttnttttgggtnccnatnaaattttattaacaaaatatgacngtgggggggccacagtttgccaaactttgccttggaggacatgcanaggcaccctcaaaat

SEQ ID NO: 8107 - DNA, 392 bp, Homo sapiens
ctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggaactgataatgaactttattggagcattgatctgcatccaagg

SEQ ID NO: 8108 - DNA, 555 bp, Homo sapiens
ctggggcacgccgagggagcagttccttttgcaaagatgagttagtgcggatcagcacattagcaaagcaaaatatttaaacatttttaaaagctgctaatccttccaatttccctcctgattgtagctcaagctgcagcctctaaacctgctaaaaatcaggaagaaacccctcctctggagggcagatggactgaagtggctacagccagtgtgggtacggaaagcctcccgctgaactgtgatcatgtgacacctgcagaccctgggaagggctgatctgaatcctggcagcaaactcaacctcttcttttgcttggggggcttgtgtttaatacaggtcattgcgatggaagaagtctcagagtctctctcacatcaagaggacagatggggacagggatcctggagcttttcttctcctgtgttctggttgcatacttgaatcccaggaaacagtgtgacacggtgccaatttactgccaaacatgcccggtttgtcaacagagccagacaaggaggagaggagagattcatgccccaaacacaggccag

SEQ ID NO: 8109 - DNA, 608 bp, Homo sapiens
  misc_feature (1)...(608): n = g, a, c or t
cctggggctggtactaaaaggaaaaagaggaaagtgaatctgagagaggactgggaatatatttctccctcctcaagcaaacagcaaatcagcatatagttaccaagtgttcacctataatacacagctagaacattactttcagttgccaactggagaatccaggaggccagtggtattggtgaggccacacatacaaaaaagggccacagagaatgtcaagaagatgctgctttccaaagaaatttgagcaaaagctgaaactgaatttaaagtataagaagagctaggctcagaaaaagttgtactgtccccaagtcagcagagaaccaagccctcctaagagtatgttgtctgctacatagacttctgaaataacagtttgctttgtgtatgcctataattgaaactgtaactatttcaggaccaatttacttgatttttgaatactgntgctatggtgatcttctcaactatctaagaagtaaaagagaaaaatttcacaggacttggacagagattttcaaggaacacaatttcagtttttaccccactttccaatcacatccaaattccagcatgcctggttcaaganaagttcagataca

SEQ ID NO: 8110 - DNA, 328 bp, Homo sapiens
ctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctgg

SEQ ID NO: 8111 - DNA, 569 bp, Homo sapiens
  misc_feature (1)...(569): n = g, a, c or t
cctcttggctctggagaaggcatccttagcatcctcttctgaagggtgatcataagccccaagttaattaaataggcccaatgtctgcctgctctttctgtattcccttcctgaatctagttcatgtcaacaaatgtgtactattattgtagaaaatcgaatgctctcatacttttaataggtttgcttcttggttaatatgcccaggtcaggaagtggcttatatttcaggagtgctctctaatacttattgcagatattcaagcatttattctctcacacacacgcacttaaaaaccgcacactacctcacactctgcaataatccgatagtatggtggtcatcatacccacatatatacatgataagatagaatgcattgcttaaatagcacataagtcatctataatcctccacaccctgtaataccagtagcacaatggttttctatttggaggttgccaggagcactcaaaagtaagcttctggctcctacaacaacacatccaactgccttggggacaacatgattgncatccttctagtacacactcagtccaaggccagg

SEQ ID NO: 8112 - DNA, 348 bp, Homo sapiens
ctgcataccgctgggtacaggagaaagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaagg

SEQ ID NO: 8113 - DNA, 177 bp, Homo sapiens
ctgctcagcctcctcattcagtgaagtgagggtgagttgtgaggcaggcaggctcctcagaggggagggggaggggaaacgtcagttacttgggctgtgtccttacgccaagactacaaaacatcgtaagcctcactatacaacactgagctatttacaatggaaattctcaatcag

SEQ ID NO: 8114 - DNA, 606 bp, Homo sapiens
ctgctctggagaatctcaataaggctctcctagcagacattgaagcccactatcaggacccttcacttccttaccccaaagaagataacacacttttatatgaaatcacagcctatctggaggcagcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctg

SEQ ID NO: 8115 - DNA, 421 bp, Homo sapiens
  misc_feature (1)...(421): n = g, a, c or t
cgcgtgagccactgcgcccggcctagtttgtgctttttacttaccagttaggggttatattactgtgtaacaaaatggacggttatttctattcattaacaagattcaagtaatagcctctttagccacatattccttaataacacctttagaccttataggggtaattattttctatatacttttccaatgtatttgaaagtttgttggctcttcttccgtaattatactatatcctcagtaaagaaagtttggcatacagaaaagttgaaggaagaaaattttcaatcactgttgttccactaccaagaaataatacttggaggtatttcctttcaatcttcaacatgaggatgctaatgtccccctnataaggggccttaaagtcactgactctgtgcactatttcatgagaacattg

SEQ ID NO: 8116 - DNA, 563 bp, Homo sapiens
  misc_feature (1)...(563): n = g, a, c or t
aggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttngg

SEQ ID NO: 8117 - DNA, 542 bp, Homo sapiens
caaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagtt

SEQ ID NO: 8118 - DNA, 408 bp, Homo sapiens
ccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtgg

SEQ ID NO: 8119 - DNA, 567 bp, Homo sapiens
cctgaacttctccccagcaaatgaagttagttgctttagaaagagatttagaactctgtcttacagcatacttctccccctaggcaagtctctatctctggagctggggaacaatggtgcacttctctttgaatgacaacccagctagaggacaaaaacactttgtggagttggggcaacagcctcgggtctcaacttgcctctcccaatgtggaactgctggattacaagctggggcatgggtgactgtgccttcagtattctcagtggtactgtacacaggtacagcctctgtaccatgagtaagaaatagttcctgcctctcagccccactcatccagaacttgacctcaccaacaggccactaaaaaaaaaaatcttgatatcctattcctttgagaaagataccctccaactaggaaataaaggaacaggtaatcttgtgttcttggctgcaccagtctggagtgaagtttctatctcagcaagctgggaaagaggaaaaggagtgggtcttggttcaataccacagaaattcaatgttcttaccaagttttagtagatatt

SEQ ID NO: 8120 - DNA, 493 bp, Homo sapiens
  misc_feature (1)...(493): n = g, a, c or t
gggatggggaggttgcgatgggccgagattgcaccactacaccccagcctggataacaagagtgaaactccgtctcaaaaaataaaaatagaaaaggactcagaagccaacttgaagtgcctctcgctgccaaagataggatagtctgagaataaaaagaataatgactgcaattagttgaaacacatggaaataaaaagaaacgtaaggtcatagtgatactttttaaaaggccaaggaaacacagtgaaacaaaattcattggtcccattagagtaatagggcaccaattccttactttgaaatttggcaattaaaggaacagaattcagcatttattctgcctttcctgaatgaactgtattttagagtaaccaaatagtcctagttgatgagggaatattttgntcgtttaatatgaaaaaatattctgatgtttagtttaaagaaaaatggactccaaatatttcacttagtatactagagtatttca

SEQ ID NO: 8121 - DNA, 284 bp, Homo sapiens
ccaattgatttgatggtaagggagggatcgttgacctcgtctgttatgtaaaggatgcgtagggatgggagggcgatgaggattaggatgatggcgggcaggatagttcagacggtttctatttcctgagcgtctgagatgttagtattagttagttttgttgtgagtgttaggaaaagggcatacaggactaggaagcagataaggaaaatgattatgagggcgtgatcatgaaaggtgataagctcttctatgataggggaagtagcgtcttgtagacctac

SEQ ID NO: 8122 - DNA, 568 bp, Homo sapiens
  misc_feature (1)...(568): n = g, a, c or t
atgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggnttctatgggcganaatgtg

SEQ ID NO: 8123 - DNA, 252 bp, Homo sapiens
ctggcttcccacttcttggtacccggttaactgccaggtgggtgacagtgatgccaggctcgcccactactgcactggacacagcctcaccaatgccaccttcataataatggtcctccacggtgaggatcctgcccttggtggcacgagcgctgtcgagaatgagttttctgtccaggggcttgatggtgaaggggtccagcacgcggatgttgatcttttctttcttcagcagttcggcagcggccaagg

SEQ ID NO: 8124 - DNA, 454 bp, Homo sapiens
ctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgg

SEQ ID NO: 8125 - DNA, 487 bp, Homo sapiens
ccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtacaag

SEQ ID NO: 8126 - DNA, 606 bp, Homo sapiens
  misc_feature (1)...(606): n = g, a, c or t
ctgtggaaagaagtcgcaaaacactggaagcaagagaaaaagaggaagaaatgaacagagagaaagaattaagaagacaaaatgaagatattgagccaacatcctcaagatcaaatgtggtcagagattgctccaaatcatcttccagggatacgagcagcagtgaaagtgaacagagttctgactcttctgatgatgagttaattggccctcctttaccccctaaaatggtaggaaaaccagttaattttatggaggaagatatcctcggtcctttacctccacctcttaatgaagaagaagaagaagcagaggaagaagaagaggaagaggaggaagaggaaaatcctgttcacaagattcctgactcgcatgagataacgctgaagcatggcactaaaacagtgtctgctttgggtctggatccctcaggtgcccgtttggtgacaggaggatatgactatgatgttaagttttgggattttgctggaatggatgcttcttttaaggcatttcgatcccttcagccctgtgagtgccatcagatcaagtcattacagtatagtaacacaggagacatgattcttgntgtatctggnaagctct

SEQ ID NO: 8127 - DNA, 567 bp, Homo sapiens
ctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatat

SEQ ID NO: 8128 - DNA, 605 bp, Homo sapiens
  misc_feature (1)...(605): n = g, a, c or t
gcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaagggatgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggatnggacacgagagtctgaaattcaaagcaaccagcttgaagtggtttgagaagctggaagcaaacatgggctanagagatagggcagaagtcaagacgagga

SEQ ID NO: 8129 - DNA, 317 bp, Homo sapiens
gcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccag

SEQ ID NO: 8130 - DNA, 608 bp, Homo sapiens
  misc_feature (1)...(608): n = g, a, c or t
ctgctggagtagctcgtggtgctgattgatctgcttggagattcttgtgcatcttcacctgttagagctggaaagatgctcaggactatacagcccagcccttctggtttacatataatgaaactaaggcccaccttagtcaactaatgtgcttaaactcaagcaaatggcaaatggcaaaactcaggactctgtcaatgagttttcattctttttctttattcttctagacacatattttataaagaaatgaggcagcatgatgtttaaaatacttaaagtgagaatgagaaaaactgatgtctacatatcatgaaatggttaaaaagtttaacgtgcattgtcttctccattagaacttcttttacgaatttttttctcaaaatctggctcagaaatcttgttttaaaagctccctaaacattcctaggcagaattagtaacgccttcctctttgctaacaaggaactgtgcatattcctgtaatagaatacttaccatattatattgnaagtattaaattattcatctgccctcctcccacctacccactggatcaggcttcccaggaacagcaacagagagcccagcaatttgngtgttctcag

SEQ ID NO: 8131 - DNA, 540 bp, Homo sapiens
ctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatacta

SEQ ID NO: 8132 - DNA, 608 bp, Homo sapiens
ctgacatcctaaaaacgaagtcaaattagggaaggatggccgtttccttgagtcaaaagcccagcaggattgcattataatgtatatttcttctgtagcataaaatggctgatccattttaaatccattttgaatcagtttgtagaagttagcatcaaccggaatgccagggtaagaattcacaccaagtgagaagatttcccacagtaatattccatatgaccagacatcactcttaatggtgtagatgccttcaaacaggctttcgggggccatccattttacaggcagacgggcattgcccctgacaacatagttggaatcactcatgatatctcgagccaatccaaagtcacatatcttcaccactttcccgtgggtgacaagcacgttcctggcggccaggtctctgtgaacacacgacttaaattccagaaattccattcctttggcaacttgatatgcaaagcaaagaagatcttcaaatgtaagcacattcaagtcctcctcttcttccagccttttttggttttcatattcaatttcatcttcagagtgaaatgaattcccatgaagccctgagatttgatccgagtccgggtgtatct

SEQ ID NO: 8133 - DNA, 367 bp, Homo sapiens
ctgttaattctaaaatgaaaccagtcagaccactgacttataaaaatatggtactcatatagatttagcattataaagaaggaatatattatttaaaacatttaaatagtgcatatggacatttttgcatgtggtatataaaataaaacattcatataagatacacagtgcacataaaattagatgtttggatacactcctatctggagactgaaggaaattatctgaaatgtacactgcatgatggattcaaataaaaatgatacatcttttggtattttcaatttcacttttctaggtatacattatgaataacctagttgtatcaaaaggaaaccacacaaaaagggcaggatttagtgctttt

SEQ ID NO: 8134 - DNA, 567 bp, Homo sapiens
  misc_feature (1)...(567): n = g, a, c or t
gctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggntatatgattaatc

SEQ ID NO: 8135 - DNA, 594 bp, Homo sapiens
ctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggatttgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcata

SEQ ID NO: 8136 - DNA, 515 bp, Homo sapiens
gtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccag

SEQ ID NO: 8137 - DNA, 501 bp, Homo sapiens
ctgcttttccttgctttaaaataagctaccagtaattctaaatcagactaaaatgtactgttcctagaccaaatacaggcattcatccttgcaaaaatgttttgcaatgagttcttggcctatatgaaaagcatcaaatagctaaggagagactagaatttatttccaaattctgtgactgacttccaataatcccttatcagtacgagtaccaggaaaatatcagatattaaagatcagatttaattctttggtataagcatgaaactgttactgatagctttccatggcgagcataaaccatgaagcaactcaagaagcatgagagacaacaatgaaatctagtatacaatgcagggcaggccaagaacgatgtctgctttacaggaaaagtcaacactaacaatctactcctgagaaactaacacctatttagatgtttttaacataatggcaaactaaaatgtcaagcttcaaaatgaccaaacttgtaacgtacag

SEQ ID NO: 8138 - DNA, 563 bp, Homo sapiens
ggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctact

SEQ ID NO: 8139 - DNA, 166 bp, Homo sapiens
cttttgttcagtaaagcccaaaatctaggccaatggttctcaaagtgtagttccaggagcagcaacagcagcatccctggagagggagaaagagagagagagtgtatgtgtgtgtgtgtgtatgtgtatgtgtgtgtgtgtgtgtgtgtgtgaagctgtttgtata

SEQ ID NO: 8140 - DNA, 188 bp, Homo sapiens
  misc_feature (1)...(188): n = g, a, c or t
ctgagaagctgatagaggagaagggagctgtggaagctctggcagcagcactggcccatatttcaggtgccacgtccgtagaccagcgctccttgatcaactcaaatgtgggttttgngaccatgatcttgcagtgctcaattgaaatgccaaatattagttatgcttggaaagaacttaaagagcag

SEQ ID NO: 8141 - DNA, 284 bp, Homo sapiens
  misc_feature (1)...(284): n = g, a, c or t
cctttttaagatgatactttnganatgcacgatatnatgagngggangnttttaaaaacgcctntttaataaactacctctaacactatttctgcggtaatagatattagcagattaattgggttatttgcattatttaatttttttgattccaagttttggtcttgtnaccactataactctctgtgaacgtttttccaggtggctggaagaaggaananaacctgatntagccaatgctgntgnantcgtttcctcagcctcatctcantgtgctgnggtct

SEQ ID NO: 8142 - DNA, 604 bp, Homo sapiens
  misc_feature (1)...(604): n = g, a, c or t
ccactcgagcacggtagggacagttcacaggtatatgaagataattgggtcccaggcgatggcggtgagtgtcaggataggcaaaaaggcggccctgaagcattttgtcaggactggcctcaatgccaggtggcatgttgcttgggtcgaaggctatctgttcaacctcagcaaagtaattaactggattccggtttaagaccagtttaccaactgggatgagagggtagtccttgtgaggccaaaccttggtgagatcgaatggattaaatggaaaagtttctgcctgattaaatgtcatgacctggatgtaaaaagtccaggaggggtactttcctgtggcaatggcgttaaaaagatcccggatgccatagtcaggatcttcctgggaaagtctcgccgcatcttcaacagaaaggtttttgatgccctggtcagtcttataatggaatttgcaataaactgcctccccatttgcattaaccagcttgaaagtatgtgatccatatccattcatgtggcgatgtccatctggaatcccccgatcactgaacaagaaagaaacctgatgcagagactcaggacgtaggctccanaagtccca

SEQ ID NO: 8143 - DNA, 600 bp, Homo sapiens
  misc_feature (1)...(600): n = g, a, c or t
atgactttagtcccagctacttggggggctgaggcaggagggtcgcttgagcccaggaaagttcgagtccaagctgggcaacagagcaaaaccttgtctcttaaaaaagaaaaaaaatagagttcagaatagataaaagagttgttattctaagaaaatagactactgaaggagaaaggctttaataatattaaaaataggcaaggtaatgcttttcatagtatagtaagatttgcctaataccatcttatttctttgattaaaagttacttagcttcagcatgcgtgtacattcaaaatacaaaattaaagcatgagttgtcattaatttgcagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgncgttccattcctttttttgaggngttatgagtggggctataacatcgccatcctgcggcttggtgaaatttctgtctgcacaccactgaacaaaatattgtcttgcggcata

SEQ ID NO: 8144 - DNA, 595 bp, Homo sapiens
  misc_feature (1)...(595): n = g, a, c or t
ccagctagtcacagttgttgggtcagtagtacagtgctcaagaacaattcagactaacatgccaaggagcctgaggaaaagtctggtagtcatggctctcccagccagcattcccagtgggggaaactagaagacaccagcctggagaggctgaatattcaggagtccctgagatggggaatggaacagaggaaagtgtcttttgactcatcttaagtactcccctccccaaatagaaacctcaaagactgatccatttcccctagggcctgggccaggagtagctcactgctcactgctgaggagaaaggcacaagatataatgtcataagagcaggacagtggctcagcctacagagttccctataggggaaagaaggcaggaaataggcgcagggtctggtcctgtccctgcaccaccctgagtagctagtcttgggaagggattacaggccctgggccataggctgctcgccattctgctttcctatcctgtttctctccctgtgctgntcccttttagccagggctgagaaatgttcagcacctgaggcaaaactgccatagtacctctgaaagctgaatcaagggggaa

SEQ ID NO: 8145 - DNA, 465 bp, Homo sapiens
taaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttgg

SEQ ID NO: 8146 - DNA, 597 bp, Homo sapiens
  misc_feature (1)...(597): n = g, a, c or t
cctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggntatgactagttttgttaggaacatttgagttacttcaatcattttcacaggcag

SEQ ID NO: 8147 - DNA, 536 bp, Homo sapiens
ccaggcaggtctcgaactcctggcctcagatgatctgcccaccgtagcctcccaaagtgctgggattacaggtatgagccactccacccagcccagagttttcatttgttccttaaaataattaagctggaaaggcaaggacaattatgagcacaactgtagtcaagttgagaagacctcaaaaaagtcaagtttagaccttcggattttccatagaagagaaaaagatactaggttttagggtacagagagccagatctgaagagtagctgcagggggaaggtgctgttagaaggaggatatagacacattctctggggggaacatatggtgactgacccatgcacacaaagggggccttagcgaaactgcagaggactgatccttaaaccaatcacatctttgccaatctctgtcactgtggtgaccctgcagatttgacctttgaactcaggggaatagcaggccccactgagtggacacttttctactggctttccacggtagatgggccgatatgatgcagcacaaatgtc

SEQ ID NO: 8148 - DNA, 392 bp, Homo sapiens; identical to SEQ ID NO: 7567

SEQ ID NO: 8149 - DNA, 467 bp, Homo sapiens
cctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttgg

SEQ ID NO: 8150 - DNA, 564 bp, Homo sapiens
  misc_feature (1)...(564): n = g, a, c or t
ctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgnta

SEQ ID NO: 8151 - DNA, 596 bp, Homo sapiens
  misc_feature (1)...(596): n = g, a, c or t
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgngtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgngcctttcctatcacctcgagaagta

SEQ ID NO: 8152 - DNA, 547 bp, Homo sapiens
  misc_feature (1)...(547): n = g, a, c or t
ccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgncaatctaaaggtaaccggcaacatcaaaaag

SEQ ID NO: 8153 - DNA, 591 bp, Homo sapiens
  misc_feature (1)...(591): n = g, a, c or t
agcggattctgcttttaggagtacccgncaacaagcgggaccgagcaggaatccgnatctgggaacanagcccttngctcctccctcagaatgaacggagaccaganttcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagact

SEQ ID NO: 8154 - DNA, 460 bp, Homo sapiens
ctgctcttcctaatgttggtccagtcctttaaacctgccctacggattctagtctgcccttctttgcccttaattgcttgacctcttatgcttgcctttttttttttttatcacttattttgttcatgttaaacactaagttaaaaaattttaaaatgaatgatgccacatttctatataaagaaatgagcattattaatccctgttgttgtaaaacatcattgaaattgtatgctattctctttatataaagtcattctaattatgtcacatgttgaagatgtaaccaaactattataaaggctgcttatccattcacatattgaatagattaagtttgggttttttaagattgttaatttgttattttctctttcctctagtcaaagtgggaaaaagcccaccggtgaggggctccctctctggaaaagtcagcctaccttgtcatttttcaacgatg

SEQ ID NO: 8155 - DNA, 444 bp, Homo sapiens
ctgttcttagaaagcattccatatagttatccagagcactcaagttttggttctcttttacatagctgcattcggagatactctatgtgagacatgtttaaaaaaagagaaacatttatacctggaatttatattcttccaagtaatcttttagtcttgttggtaaaggcagtccccagatggcaccggtacatttgttaatggtgagcctacagagatgctgcagagatggtgctgacgtgtagagcggtttggtcagataaaggtgaacagtgccgttccggggggcttctggacctgtccgcttatccttgcacatctgaacatagtagtcgatcagatgaaccacactgtcaaattgtttaagcttggatttgacacatatgatagagtccaatctgaattttccgtcttggtattcgattcgaagattagttggtccag

SEQ ID NO: 8156 - DNA, 605 bp, Homo sapiens
ctgtcagcttcagcagaccttggaaaggaaaatggtttgccttagttttacagtttgttttgagaaagaaaaccattcatttgtatcctttctaagttgcaatataaataactgtcattgttcttgtattcttcacaataatgtccattaaacatatatgtatcacatattttacctcactagggactaaggcattgcattatgtcaggattgtattacttttccctctcatattcgtgtcttactcttaataggaagtatgagtaaatcaggtatttttctaaaggtaattttcatttatttagaacacatttctttttggtgacataaattatcaggaacatcatcactccggaaaaaatacagtgggggttctcttgtacataatcctttgaaaataacattgaactaaacatgaaacatacatttatttctctgaaataatttctcttgaatatttctacaaaagtaatttttccccacatctgttattgtctttaatctcctagtccccagaactatctataaccaagttagttccattatttaatctctactcatcacaccacacaaaccccaaaatacaggtagtcagtcacaaaata

SEQ ID NO: 8157 - DNA, 467 bp, Homo sapiens
  misc_feature (1)...(467): n = g, a, c or t
ctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttganaaaacccacctagagcatcancaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgnttcggntagagccacag

SEQ ID NO: 8158 - DNA, 500 bp, Homo sapiens
  misc_feature (1)...(500): n = g, a, c or t
ccaagaattcaaggacttgtaggagataagtgaaggctattacagggattttgtcctggtttggtaggtttctcttggagaaataccactacaccctggtctagaaatgagttttgaanacttggggagttaaagggcactgagttttgctctcaccgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaattnatgatccataatccttgccanaaatcctgcancgaaccatggcatggcatcatcctantnattgatttcantcttttgccttttgctccnctggaatcttgngccaattgcaggangggg

SEQ ID NO: 8159 - DNA, 448 bp, Homo sapiens
  misc_feature (1)...(448): n = g, a, c or t
ctgctggtggagatggatggttttaatacaacaacaaatgtcgtcattttggccggcaccaatcgaccagatatcctggaccccgcgctgcttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgaacgagtgattggtggcttagagaagaaaacgcaggttctgcagcctgaggagaagaagactgtggcataccacgaagcaggccatgcggttgccngct

SEQ ID NO: 8160 - DNA, 381 bp, Homo sapiens
ctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctagg

SEQ ID NO: 8161 - DNA, 313 bp, Homo sapiens
ctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccag

SEQ ID NO: 8162 - DNA, 200 bp, Homo sapiens
ctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcg

SEQ ID NO: 8163 - DNA, 459 bp, Homo sapiens
  misc_feature (1)...(459): n = g, a, c or t
gctggtctcaaactcctgaccttgtgctctgcccgccgtggcctctcaaagtactgcacactatcttaaaggcagtaaatgaatctgagtaagtgagtaagcaatgacagaaaactgcttttcctaccaataaaaaacctgcatatatggtcaagtgacatgatctattcaaagtgattaaaaattgtctttgacaagagattacattaaaaaaataaattttttttactgacctnataattgatttgcattgttcattttgctgcatgttctcattatcattaacatgtatgtttaatacactgttttattacagtatgtataattaatatactgctttattacatgtactaaactagactcatatncacttaaaaaaaaaaagatatgtggagatatccacataccataatagtcacccttttaaaggtacacaattcagtggtttttagacctcgg

SEQ ID NO: 8164 - DNA, 266 bp, Homo sapiens
cacgcccagctaatttttgtatttttttagtagacatggggtttcgccatgttggcgaggctggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccag

SEQ ID NO: 8165 - DNA, 477 bp, Homo sapiens
atcacctggagcgtgaagggccacatgtattgtttggaaggccatctggagcctacattctagtaggagagggaagaaacagatgtagccaaccacagtatgaggtggaaacataaaattacaaagggaaaagaagagaatgacttacagttagatcactggtccttagcctggttgctcattggattcacctggggagtttttagtcgtctcatgccagccccgttgcacccaggaccagtcaaatcagaatctgtgagggcatagtcagggagcatgagtaggagattccagtgtgcagccaaagttgagagctagggaacagatgggggtggggtggagaggcaggccaacaagttgcaagtaattcaaatctccattggaaggggcttctcacagagcaaggcggcagctccagggctctctagtcctttccctcagctatcctctgccactgccatgcagatggcaagatgg

SEQ ID NO: 8166 - DNA, 297 bp, Homo sapiens; identical to SEQ ID NO: 7858

SEQ ID NO: 8167 - DNA, 527 bp, Homo sapiens
ttttttttttggtataaaagcatttttaaactttattattaatactcaggacattaggaatttccagatttttttcagtagcatttgtagaaccacttttggtaacaaatacagtagttaggaatatgcatccaattcagaatgcataataatgtttatcctgaatcctttccggctaaaaacagggctggcgctgtgatgagatatagaacgagaatctacaaaaaacactgtaacatgtttgttttttcccagaggctacatcctcttttgctggaatactttataaatacatattaaaaagtaaggcaacaactccaaacagtccaagctgtttgctcaactcttttcccaattagatttgcaatcccggtgatcaatttcatggttgtattgtttagtgtttgtctttcttatttcaaatggtccaaaaggatgtttttctcacatttctaaaacatctctggtatgtgtgttcaatgatatatgcaactaatactggtcaggtactgaagcctgtgatgtcc

SEQ ID NO: 8168 - DNA, 426 bp, Homo sapiens
cgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccactgcccctcacatcaccttctcatgggtccctctcccactccaaagcccccagtggctcccagatgagccacaatgctgtaacaagccatcaacgtccagggtggcctgg

SEQ ID NO: 8169 - DNA, 131 bp, Homo sapiens
ccagtttgtaaatctgctccttcacgtcgtcagatgtcaacttcaaccaagtggggacgctgcgtcgatagggtaaagccgactgggacaggcccttcccgggagcatgcatgcgacccatgatggcggcg

SEQ ID NO: 8170 - DNA, 359 bp, Homo sapiens
  misc_feature (1)...(359): n = g, a, c or t
ggcgaggcaggggagctgccttcggtacataatttgaaggggcactccctcttgggcacatgccggccctgagtgcctcccttgcctcactctgatcccggccccataatgtcctcagtggaaggtgactgggggccggtgctgnggggagagtagaaagaggggttggcatgactaaaaataccagtatgtgtattaagtattttgagaatgaaatgccaaggagtgcctactgtatgccagctctgctctaggaatggagtagacagtggacacaagaaggacttacgccctgagcacaggtgccaacggtgacaagactggcaagacgtgagggcatgaatggttcattcaggcag

SEQ ID NO: 8171 - DNA, 420 bp, Homo sapiens
ctgttagatgaaaatctaaaggatgaatactttgaggaaatcatggaagaatatgaagatattagacagggccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctgg

SEQ ID NO: 8172 - DNA, 640 bp, Homo sapiens
ctgacattcctgaataagaaggaagcaattgctgcagtcatccaggcaacagctatggtgccatgagtgaggaggaagcagcagagggagtcggattctggcggaggggggagtcccatgaggaaggatttacaggatgagaagtatgagaggaacacaggaattagcttattacaatacaaaaactccaacaaatatgaaagaggcaatcactaaagcagtttcagaaaaatatgctaccaaagggagaaaaggcaaagtagctgagattttcagacaatggctttagtacaaaagagaagcaaggggactatacatgtcatttcactaggttgacttttcattattgttgttgttcttaaaaccttgatctttatttttttcttaagtcgaaagctaagaatctacaaagaattatctataattggttttctctactcatgtgaattcgaaagaagccttccaaaaacgtatattgtaaattgagttgcacgaaaaaaaaaaactcattttagaatcttcttttttattaaaccaaataggcactgctggctgcttgtctcacaattctgctacacatagcagtgaggctcctgacttttacaatattccctgggactattggttgagttacccatga

SEQ ID NO: 8173 - DNA, 323 bp, Homo sapiens
  misc_feature (1)...(323): n = g, a, c or t
acaagcttttttttttttttttttttttttttngctattttaatattttttattaagggctntaaaaatncccanaaagataaataaatgtgatgcaatgatntctgtcctaatatnaaaaactttntttcactgcattgttttccttcacaatggccttcaaatcacaggaggcagngattccatgccatttcctnttnttttattacacnctacaggatttctgaatcagtatccccgccctcagtcttctntttataaatnaaagtcattttcaatccaccgtttaaagggagcgtntttttttnttttccacnaanagg

SEQ ID NO: 8174 - DNA, 309 bp, Homo sapiens
tcgacagcccagtagaggaaaaaggggtggtgccgtgcctgtctcttaatgaagtccagggcttcctgcaggtagatctgggtgaggttggcttcccccgtcttcagattaataggaaattcttcataatatctgccaaccatctcccagtccctgtacacagggatgttgggcctggccttgttgtcataaggtccaaagtggcagttgggggatccaaaccactcatcaaatccgtgcttcagggggtggaactggggcctgtgacccagatgcctctgtgcccactcgccctggcccccaggccag

SEQ ID NO: 8175 - DNA, 568 bp, Homo sapiens
gaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctggg

SEQ ID NO: 8176 - DNA, 554 bp, Homo sapiens
  misc_feature (1)...(554): n = g, a, c or t
ccatttacaaatatgtttaatagcagcatttctttaaagaaaaacaaagttcaaatgcccaataataattatgtttaacacttggtacacatataaatagacaaaaggctgcggagaacactggatttaaataaaggtgttatgggtataattaactataatttattttatgaataaataagaaaaaagtccctggctataaaggatagtggaggtttatttcccaatattcttccatttggactgaacccctgccaactaagcagacatcccactattacaccaaaaagactgctctccccgcgagcaattacaatacatgacaccactaggcccaatggctcagagggaagagtggcctgtggctcttcaatctttatccaaacctggttctagcttcaggagcctttggtcacctgagactttttatttattaatttttatgagacggagtattgctatgttgcccaggctgattctgaactcctgggctcaagcagttctcccgcctgggcctcccanaatgttgggattacaggcatgagccaccacac

SEQ ID NO: 8177 - DNA, 262 bp, Homo sapiens
cctcaagtaatccatctacctcggcctcccaaaggattgggactactgatgtgaggtgtatttgtcactattcatctaactgcatacacattatctgtgcacttactgtatataaattatacctcaataaaaagtttatttacttctttatattaaatgtctattaataagctgggcgcagtggctcacacctgtaatcctagcactttgggaggccatggcgggcagatcacttggggccagaagtttgagaccagcctgg

SEQ ID NO: 8178 - DNA, 569 bp, Homo sapiens
  misc_feature (1)...(569): n = g, a, c or t
cggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccanaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctgncaaaatttatgaagacagaagaagccattatatactcatatggatttgccaccatagccagtgctattcctgcttactctaaaagaggggacattgtttttgt

SEQ ID NO: 8179 - DNA, 241 bp, Homo sapiens
ctgtgatattgtgaaatatatagttggtcttcaactcccttcctggcatacaactcctaaaatctttggcctttccaaagtggtgtcattttgtatgctaatgattggtggctggcgcacttaggtagcttcagggtaggggctggtcactgaaaaaccaagggaggattagaaggttaggactttctgtcccatctcccaacctccaaggagggcagagaggctgactgatttccaatgg

SEQ ID NO: 8180 - DNA, 175 bp, Homo sapiens
ccagtgatggactgctgggaaatctgctggcctgtggtctgagttcccctacttgctcaggctgcccctcactcccagtgtgccagggaggcttagtccggggagcatcagagcagaagacattcggggctcatggctcccatccccactggcctgtatcttcagcaccctctgg

SEQ ID NO: 8181 - DNA, 545 bp, Homo sapiens
ggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttgggaaaacgcttcaaagaggc

(The sequence listing continues in the following parts.)

What is claimed is:

1. A diagnostic kit for the detection of a hematological malignancy comprising at least one isolated monoclonal antibody or antigen-binding fragment thereof that specifically binds to a polypeptide comprising the amino acid sequence set forth in SEQ ID NO: 2244, and a detection reagent, wherein the detection reagent comprises a reporter group.

2. A pharmaceutical composition for the treatment of a hematological malignancy comprising a first component selected from the group consisting of pharmaceutically acceptable carriers and immunostimulants, and a second component selected from the group consisting of an isolated monoclonal antibody or antigen-binding fragment thereof that specifically binds to a polypeptide comprising the amino acid sequence set forth in SEQ ID NO: 2244.

* * * * *

UNITED STATES PATENT AND TRADEMARK OFFICE
CERTIFICATE OF CORRECTION

| | |
|---|---|
| PATENT NO. | : 8,071,732 B2 |
| APPLICATION NO. | : 11/542681 |
| DATED | : December 6, 2011 |
| INVENTOR(S) | : Alexander Gaiger et al. |

It is certified that error appears in the above-identified patent and that said Letters Patent is hereby corrected as shown below:

Item (30):
--March 1, 2001 (PCT) ... PCT/US01/07272-- should be added to the face of the issued patent.

Signed and Sealed this
Twelfth Day of March, 2013

Teresa Stanek Rea
*Acting Director of the United States Patent and Trademark Office*